United States Patent 11,001,841 (CCCTC-BINDING FACTOR (CTCF) RNA INTERACTOME) - sequence listing, part 36

SEQ ID NO: 86567 - DNA, 1049 bp, Homo sapiens
tgctgttgagttgtacatattgtcattttgagagagtgttagggttttttgtttttttttttcttggaagacgttttatcatgttgcctaggctggtctcaactcccggactcaagcgattctccctccttggcctcccaaactgctgagattacaggtgtgagccaccatgcccaactgagagaatattttcaaaaagtttcctgagaaattatgtgctttcctttgggaggccgaggcaggcggatcacttgaggtcaggagttcaagaccagcccagccaacatggtaaaacgccatctctactgaaaatacaaaaattagctgggcatgatggcgggtgcctataatcccagctacttgggatgctgaggcagaagaatcgcttgaacgtaggaggtggaggttgcagtgagctgagattgggccactgcactccagcctgggtgacagagtgagactctgtctcaagtatgtgctttctattataatagtctgagttttatgtggcccagccctggaagttaccgccagtctcaccggtggcttcctaattgcaattgaagaaatgggaaataaagtaacaagtagcttccccacatgctgacactggctagactgaccctcttatcacatgccttcttcctttctgttctaggccatgggtatcaatgatctgctgtcctttgatttcatggatgccccacctatggaaactttgatcacagccatggagcagctgtacacactgggggccctggatgacgagggcctgctcactcgcttgggccgccgggtaagggacagactcaacttcctgtgcttttgggaagattccctggtcagcctttcacatccttcggtctgtacaaaatcaggctgaggccgtggataagctttgagtaaaattctaaatgtttgtttttaacctgaatttctccactgtcactttaaactgtttcttctttatacaaaaaggtgttctgttcataattttgcctgaggatgtattactgaatgtagccttaattagaaacggcatctgcaaa

SEQ ID NO: 86568 - DNA, 1027 bp, Homo sapiens
gatgggggtgccatgaagttggggtagttggcctgttgccattccaatgcttgatgtggacttttttttttttttttttttttttgagatggagtctcactctgttgcccaggctggagtgcagtggaatgatcttgcaatctctacctcccgggttcaagcagttctcctgcctcagcctccagagcagctgggattacaggcgtgcgccaccgtgtgctgctaatttttgtatttttagtagagacagggttgcaccatgttggccaggctggtctcaaactcctggcctcaagtgatcctcttgcctcagtttcccaaaatgctgggattacaggcctgagccatcatgcctagcctgatgtggacacttttgatagggtcttgtagggctccctagaattgctccatgttcagttagtagctgttgagtcggaaatgttcctctgtcccactgcttggcaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacaggtaagctggaatctgatgactctgcatgtttgagttgaaccaccttgagtatcatgtcttttcatctctgtgtgtacctataaagctataggcaccttttctcttgctcctcacataacccttttcctccagcttttccatctttgttatattccttctccccaagtaagggtatgcctgagaattacctcagatacctaagaggaagattatctgttagttgttgaaaaaaatgctctttgtttgcaaccctctggaacattattactgtggaattgaatacctgtctaaacaaagtgtctgtctctgagtgcctccgtctgcccactgtgtagagctgcctctgtagtacacttagggctgga

SEQ ID NO: 86569 - DNA, 1901 bp, Homo sapiens
cgtcccaaaaaaaaaaaaaaaaagaaagaaaaaaacaactacctagtgatgtagtttaaaaaaaaaaacttgttttaaagtagcatttttaaaaaattggactctatctagaaccctaatataaaactgatttaaaaccaccatgttatcacagtagaagggttagaaatgtggctccttgcatgtttggccttctccatcccttgtggcagtgtgaggcccctcttcagagccctagaattctgtggaaacattctaataaacatcctcacattttatagagcaagaaacagattagagaagggatgtgattggctccatgtcacttaactagttagagccagagccaggactagaatacattctcctgagacctttcttgtggttagaggtgtgcgggtgcttcagtattggggtgtggctgtcataaacagactgcagtcttataggtgtcaggcaggagaggtaatagtataaaatgtaagctcagctgaggcctactagggaccaggttgactgtagagtggggcctatatccagaggcttgagtactatctctgtcccccctcagggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaaggaaacaaaaatggttttctgtgactgttttcttttagccgaaaggttaggatattggcctgggctcagggtgagggagatttagtatctgtgctctggcacacatgatgagaatcccctgaatcccctgaaaccagaacgcagggcctctttgcgctcggaaacgacgtacaacccagacttccagccttgtctttcagcatcagcactagccgggccgtgctgggggatcacccgatgatcaaccatgtcctctccacagagcacttcagtctggaggcctgagtggctacagatggcacatattaaatacagaaggtttccccttgctccctccacctcccacattcgcaatgtgcagcatgtcccatttccttttgaaacatactaagtaacaacacagcttttattttattttgtttttatttttttcccctgaggtcctggatggactttaacaaagggattttatggtcaaaacctccctttccccactccaaacagaaaacaaacataacacctctcctctcagctggtttgtgctgccagtatctgtgctgcagggcttgttcttagtggttttttcctagcacttgcttggagaatagccacctccttgtgccctcctcacagctcctgaggagggt

SEQ ID NO: 86570 - DNA, 1058 bp, Homo sapiens
tgggaaatggtggcacgtgcctccatcatgattcttgctttacctaacctgaattcttgccaagcctaagtctgtgggctgatgctttgttgcagagctagcttggcactttgcaccaagaatctcaagtgctctttctgaccttacccccattttttcctctgccaaggtagcatctctaccccaaaactgttttgttcccaggtcgccaggctctggggcatccagaagaaccggccagccatgaattacgacaagctgagccgctcgctccgatactattatgagaaaggcatcatgcagaaggtgggggctgtgggtctagggacaaggtggtggggggcagtggctgtgagaagctgactggggagagggtcagcagggcagttctcagcaactttgtaggatcagataatgaatcagtcagagagacaagaaattgtggagaatcccaaggttctcctcccccaaaaaagtgcaacactgtaactgagaagcccaagcatggagaagttgagatgaaaaaggagtaagaactgtgaagggagagtcagcttctcaggaaccagcatgggagagaaatgccccgagcatctgcctgtactggtagaagggccacattccccactcccccaccttaccccatacaaaggctgggcggctagccaggctgaccagaccttctctctccccataggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccct

SEQ ID NO: 86571 - DNA, 1176 bp, Homo sapiens
gggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgggaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccgaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatcc

SEQ ID NO: 86572 - DNA, 1353 bp, Homo sapiens
ttttttttctagtaagaatgtctaatcagcaggaaagaaccagtgttaacattctgagatgtgaaataggagcctcaagaaagaatatattagcatgcctgtacagccttggaaagcctcaagttggattttcacgatactctgaggacccagttaccaaaatcctaagcttcatggctcagcccaaggatggcatgttgaaaactcaaaactaaccctcctcccattttacagaggaggaaatggtggctcagagtgtgtgagggactacaaggacagggtcaatgtcttgttcatgtatgtatttcctgacctccgctatgacctgctgtttagcctgccaaggactgccacggaaatgggggtcatcatggaactagaaggggtccatcaggccccagcctcatggggacagttctcatccattccatcattcattcaccagtctgagcacctgctttatgtcaggcactgtacaatgttcattcatagtagagatagtaataatgataattgtaaattttttgaatgttgaattattaatagtattagaggcctggcacgatggctcacgcctgtaatcccagcactttgggaggccgaggcgggtgggtcacctgaggtcagcagttcgagaccagcctgaccaacatggtgaaaccctgtctctactaaaaatacaaaaattagctgggcatggtgcctggcgcctgtgatcccagctactccggaggctgaggcaggagaatcgtttgaacacgggaggtggaggttacagtgagccaagatcgtaccgttgcactccaactgggcaacaagagcgaaactccatctcaaaaaaaaaaagtattagagaagggagatgaatgggagtgactcttcaaagtgtttttttctatcagccactgcttcacagtcttgcgcggtgtcctaagcaggaataaacagagtcccacagtgtcagccaaaggcttcaggaattggaaagctctagagacacccttcctcttgcaccaagcagcaagcaggccttgttagcctcaggaatcccgcttgcttgggcaggttggccattcagctgtcatcacttcccaagtggaaaccaaggttgtacacgtctggtgtagccagagtggcaattgctgatggccactgtagaaaatacatcccttgccctctaagcacctctgaccttgacttggccaggggtgtgggggttcctcaacagggaggatcagtgagcaccaagcaccaagaggatttgggctccattcccttaacaaaatcagggccgcagccacgtcctcacaaggcagagccagagcctgtgtgagccacatgtgccaggccttg

SEQ ID NO: 86573 - DNA, 1091 bp, Homo sapiens
aaggcagcccctaatccccaagacaagctgtgtctacagctgtttgttggctaccagatttatgggagtaggaagggtaggaccccagagacagaggtcatttggaaggcatttttgcagttcatgcagaaaactattgttaaaaaatgcacctgtgttcaaatatttattggtggaatgtgtgtaaatgtaattccaagccccatctcaactagcagtccatatgttctgagcccctgggcaaaatgttggaaaaactccatccattactctgggcccaacactaataaatctccttattacaaacccctcaagatggaccttttttaatccttgggtcttcaaacagataagttggctgcctgtatctacagccagagaggatgtgctctctagaggaattttctaggtcggaagtgttaaataggtggcatatgtgcagccaacgcccattcctgaaccggtggaagacattactaattgatcacagcactctcttattgtgatcacagcactcttattgtgatcaactaaactcaacaggagagtgctgtgatcaattagtaatgtctttggctctttcaggacagtgttcagtagcagctgggcagaatcagtagtgagttattcctgtttgccattctcaatccactgatttgtaaccttccctgctatccacttcactccctgtggaagatgggttcaagaaagttagaaccatctgtcatttacaggcagtgctcagatatattagccaattgtatgttcaaatacatgctttaaaacatgtggccaatcaaattttgtatccacttacccagtatcacatcatttatgctaccaatcacaggactatgcatccaaacaataacacttcatgatttctttaataactgcagagttcagcatatgcacaaagcccatttttaatcagatagttaagaaccaatgagcagcatttctctatttggtggagttaatattgatcgatttctttctttctttctttctatttttttgagacggagtgtctgtcgcccaggctagagtgcaatggcatgatttcgtctgactgcaacctctgcctccca

SEQ ID NO: 86574 - DNA, 1085 bp, Homo sapiens
atgatgttgtccctatgctctgttcttgtgtacacagttggttatcagtgggacctagtcatccactcatcacttaaaagttaaaggttggaacattgctcaagacaaaggttataggtttgttataggagaacaacccagttgctccttttaccacccctttccttgcaggatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaagttaagtagccactgtcttttgtgggtggtagtggttaatttatacagtactgattcgcagaatgtttaagctttttaaacatagtgacgcttagtagtttttttggaagctaacttgttttatccaaggggattttacatgtaactgaagttcccctgtcttcaagcactaaaacgttgatcttaaccttttttttgaagtgcttgcctggtaatagaaaacgggttctctgcctattttaaaatagtgaatatacgtaaattttctctggaaggctgaggcacacttcaccatcaacatgaattactgtactatcctgtactgcagtggtgccttcagggactcgaggaatgtaaggttgcctttcccctttctaaataccctcagattcctaacatcgagcccatgctttgtttgatttgttctattccatccattgtcccttttgttact

SEQ ID NO: 86575 - DNA, 1034 bp, Homo sapiens
aggtggagggtttgcggcgctctgagcgcaggggtccctctgctggccatgcctggtgctgcagcattccggccccaggtcagagcgtgcctggggcccaggagaggctgtctaggctggcacccttctgccaatgacccccttaaggagctctggacctttgcctgatccccattctgggcacctcctccttggcaacaggtgtggccaactggagctgttgggatgcagctagcttcagcttatttaagtcagttgtcaagtacccttcctcacccctgcccatccagcttccactgggtcgagggtggggttgccctgggtacttgtggattgccctggtaccagcctgtctagctgcataggtaaggcagcctagtcagacttgagggagcactggcttgagagtcaggcagaccctgtttagccactgactggctatgtgacctttttataccttcattttctctgctataaatgggaaagaattaatcctatcttgcagagctgtagtgaagattatgtggcatgcaaagcatttaggggtgtgattggcagttattaaagcttatttcctccctttcactcaccatctgtggttgatggtgagccactttgaggcacgcagagaggggcccctgcctccctagccagggagtccacaccagggttgggctttggggagggggagtgggggcagctgtagctccttctgacagtgggggtgagttgtgggcactgactgtagggaggtccccttgtgcctgggcaggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccac

SEQ ID NO: 86576 - DNA, 1093 bp, Homo sapiens
tcccttaaggcgtccgtgctctggtgtgtgtcccagaaatagacacgaccctcggtctgagcgcccctgcaccccagcctgcccaccgcgcggaacacctgcaagctccggtccgggtgccgcgctgaccacagccccggcatcacgtgacctcccgcggctctgtctgccccgccccctccagacgcctgctctgcgctgcgcattcgctctggccatagcgggcctcgtgtcgctgctgatgcagcccgagggcgccctcggcgaggagctgcaagtgccgcagcccagggccgccagttggctgaacttaggctccatcaagaagtacttggggaagctcttcaacagcaggtgggccggcggagggtgtgaggaagggagggagggagggaggaaagcggggggtggggggggcgcgggggggggacacggacgccaccaggcacccccacgcacatcgcggcctgagctgggctcggggagcggcctcatgactgcaaagacttgttcccagcccgaagaaatctaaaaaccacaagaaaactgcgaacgccacggacacctccccatcaaaagccacgaaacccccaccatggaccaccacgaacccccagtggctgaacacctcggaaccccgaccaccgacctcctcccggggccccaggtaggacagcctggatgctgggcaccgagccaggggcctcggggctgggggcagcttgggtgctagcgagaggaagttcctgggggcgggcatgcggggagacacagcacccctgtggggggggcttctttctccaggctgggccttggcctccagacgcctctctgcccaccaacccctttgtattgagaggggcctcgacccctcctcatcccctcagtgaaaacaataaagacaaatttttgttgcttcagtgacttctgtgggcctgcgggcagggagggaccagtccatggaacgggaagtgggaccctgtagtttctgctgtgagagaaaaagacctcagctgttgggggtcctcccctgcctcccctggcaacccatccaccttcccccactccacccacacatggccttgtgggtctg

SEQ ID NO: 86577 - DNA, 1071 bp, Homo sapiens
gacggcgctgatggctgtggttctgcgggcagctgctgtagccccgaggctgagaggccggggaggcactgggggcgcccgaaggctgagctgtggcgcgcggcggcgggcggcgaggggcaccagcccggggcgccggctcagcaccgcctggtcgcagccccagcccccgcccgaggagtacgcgggcgcggacgacgtctcccagtcgcccgtcgccgaggagccgtcgtgggtgccgagtcccaggcccccggtgccccacgagtccccagagcctccttcgggccgctcgctggtgcagcgggacatccaggccttcctgaaccagtgcggggccagccctggggaggcgcgccactggctcacgcagttccagacctgccatcactccgcggacaagcccttcgccgtcatcgaggtgagcggagcccggcgtgggccgtgacgcagcgaggggatggggttgtgcggccacctgtcctcaggcatggcaggatacgctgcgggctctgcgcagcggaagcgggaaggagcccggcagggcccagaccagcgccgccgggaatgggagaggccgtaagctcctccggaagcctcccgcccagcccgagtgaggatcctgggggaccccacccgccaggtgtgatgctctgaagaaggcccccaacatgggcgcagttaggggttcagaaggacctggacaggagccgcttgcactgcccctcccccaaagatgtcccggagtccaaggtcggagggaggagggcgggaggtaccccagcgtgagacaagggagtggcaagacccaacggggcaaagggcggagcaggtgggcactggtggccagaactgggtcctgacagcttctggaagggtagggtcaccgagacggccctgcaggccaggctgtgggagccagcggctcaggtccgtgtcacgctccttgaaagcccactcctccgcaggtggacgaggaggtgctcaagtgccagcagggcgtatccagtctggcctttgccctggccttcttgcagcgcatggacatgaagccgctggtggtcctggggc

SEQ ID NO: 86578 - DNA, 1019 bp, Homo sapiens
ccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgcgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagacatttggttttgcttttctgttctccccaacagggaactctgccattggctgggattgatcttgggtttcttgaaacactagatctggtcaagccccaccttgggcctcccgtgatctttcccctgttccaagatttcccac

SEQ ID NO: 86579 - DNA, 2142 bp, Homo sapiens
accttgtggttgggaaggccaatagacagcaagggcaaaggtgcctggacaccaatgggctggacagccaggatggggctgtggaaacctgggttggattgtttgggagacctttcttccgcatctcctttgttgacctgggttgcctggtctttttcaggttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttctttttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaataattcaagccctgccttcaaaatgaaattttttttttagtattatttagcaaaaacaataaaacccaaatttttttaaccatcactcatgtctcaggtttgtgcgtccttcagaggccccaggggagaggatccaaggtatgtctgtctgatttgacctttctctttagagtctcttcttcctactatttaccctctcttttcacccccgaggactcatccagaaatataatgcagggtataatttaagatgggggtccagggtttggagtggtgtgtaggtggagtgtggggaaaaggctgtagtcacatacatagaaccatttgttacaggactgtttggaggcacaaatggtcggcgagctgagaagtaaactttcagatccacctgccactggtct

SEQ ID NO: 86580 - DNA, 1044 bp, Homo sapiens
ctgggactacaggcgcgcagtcccacgcccagctaatttttgtatttttagtagagacagtttcatcatgttgaccaggatggtctcgatctcctgacctcatgatccgcccacttcggcctccaaagtgctgggattacaggcgtgagccactgtgcctggcctttcttttttttttttttttttgagacagggtctcacttttattgcctaggttgggagtgcagtggtgcgattttagcttactatagcctcaatctccccggctctggtgattctcccacctcagcccccggagtaactgggactacagacgcatgccaccactaccggctaattttttgtatgtatttttagtagagacgagtttttgccctgttgcccagtctggtctcgaactcctggactcaagcaatctacccacctcggcctcccaaagcgcggggattacaggtgtgagccaccgcgcccgacctgttctcctgtctttctaaaggtggtatttctccctaggccaatggttgacaaactatgccagcaggccacatctgctcatctgttttacctattgtccatgctacttttgtacaactatggcagaactcagtgctagttgtaacagatgatatggactgcaaagcctaaaatgtttgttacaagacccttaagagaaaaagtttgccagcctctgccctaggctgctatcttaatttggattcttgaggccactatcacatttttatggctctccagatctctgatgcttcagagtaacaatttctgggctctcccaagaataaatgtgcatgagtttcattgcttttctagccagtggcacccaaggaatgtttcttggctactatatgggctgctggcatctagttgttggctgagtggtgagctgggaacttgggatcagccttctggagttatttattcatcagacaggagatgtgggatgcccccaagaggttacatttcgcctgctgtcttctccttccagcattaaagactgtaaatggcaagaaaaaaacatcgtagtca

SEQ ID NO: 86581 - DNA, 1031 bp, Homo sapiens
cctgcctcggcctcccaaagtgctgggattacaggcatgagccacctcccctggccggaaatgtatatatttttaaatctctgaccatcatttgccatcacatagtcccccagccacactctataatgttaaaagtgctttattttcttcctagtgcttatcactgtctgaaatcaccttgatttcagttacttgtttatagtctgtctcccccacccacttcaggctatatttagcctagcatagtgaatgtctggcacatggtaggtatgcagtaagtattagaaggaaggaaggaacgttttcttggaataccagtaactgttcaggtatgtcgtggatttttaaaatttgtttcacttttcatttctgagaaaacagaatctgtccaaacaagtctttcctggcctcctttcttcagcttaggtcctgactgttggcaagaatgaagatgaatcctattctgagtctctttcctctcttccaccctagcttgccagcaaagcacggacagagaaggaggagaagctgagccaggcctatgcaatcagtgctggtgtctctctagagggccagcagctcttccagaccattcacaagacgtgagttgggatcggagaggtcctttgtcctggggtaatgctacctggttgtgctgtctggtggcaggcttttgggtggttgtcttcctaaaagtctactggggaagctgggtagggtattggcaatatgccagcatccagaggtgcaggtgctgtagccccctttccacacagaagaatagtgtaatcacggacaagttgtcttctctggtctttagttgcttgtctgtaaaacttagttttggattagattatccctaaggatcccttctagacctagtagtccataacttagaactagtgatttcttctctttgattttgttgttttgtgcctttctttaaaagctgatgcagtttttattaagggaaagttatatctatatcacttttcccattgtagattgggatgaacacagggagttagagc

SEQ ID NO: 86582 - DNA, 1082 bp, Homo sapiens
acattatgctaaaagtactgtggagtaagatatagggagtttgaagaacagcagtgtttttccaactgtgctgttaatgaatgtgtgacctctgggaactgttttgtgattggtcctctgaatctctgatagtcattgtttctccttttttctgtcttccctcttgcactctctcccttcaaggtgctgggaaatgccaggatgattaaaacacccctcttgccctccagaatctcacatttgttgggagtggtgagggacagcagcatttaacttagtgataacaatatggtgagacccgctctgcactagtggtcatatgtccaaggtacgtgacagcatagagcagggaggagcaaactttttctataaagggccagatagtaaatcttttaggctgtattggccatatggtcttggtcacatctactcgaccttgctcttgtagcacagcagccctagacaatgtgtaaacaaatgggcatggctgttttccaatgaaacttatctaagacaagtggttggctgaatttggcccacaggaggctgtttgccaacccttggtatagagtagtgagcattttagggaagacacttcagatgtgacagtggaggaggggcttgaaaaataaatggcaattattcagagaaagggaaggaagagaaaagggatcaagctgatttgggagtgctcagtttgtccacctctgcaatttagaacttgatgcttttctgttgagctgaactggaggttgttagttctcaaaaaggagggaagatactattaaagaacagtatttatttttcagacagcatgtaacactttatttatttatttatatttttaagacagagttttgctcttgtcatccaggccagagtggtgatttatttatttattaattatgtaaatttatataaaaatatacgtttatataaaatataaatagattatttatttatataaatatatattttttttaagacagagtttcgctcttgttgcccagcctggagttcaatggcacggtctcagctcactgcaacctccacctcccgggttcaagcgattctcctgcctc

SEQ ID NO: 86583 - DNA, 1054 bp, Homo sapiens
tcctgagctcaggcagtctgcttgcctcggcctcccaaagtggtaagattataggtgtgagccactgctcctggctcaatttttgtattattagtagagatggggtttcaccatgctggccaggctgatcttgaacttctgacctcaagtgatctgcctgcctcagcctcccaaagtgctgggattacaggtgtcagccaccatgcccggccctaagtcacttttttgacaattccgtttatttagtcaaaattgaagttgatcataataatgcctcaagccctgtcatagcctgtgctgtcccctgtacttggaacatttttccttccagaatgactggagccttaccacccatcagcactcagttaaatggcacgtcttccaagaagtcttctctgatcacccaggctgaagtaatttgcctgcattattctctctcatagtaccttgtccttcacagttaaggtgaccatatcatttgtagtccaacctgggacatttttgagagtaaaggggaatgcttttattttacacagggacaacaggtatagattaggttaccctattcatagcttttttttttttttttttttttgagacggagtctcgctttgtcgcccaggctggagtgcagtggcgccatctcagctcactgcaagctccgcctcccgggttcatgccattctcctgcctcagccttcctagtagctgggactacaggcgcccgacaccacgcccggctaacttttttgtatttttagtagagacggggtttcactgtgttagccaggacggtctcgatctcctgactttgtgatccgcccgcctcggcctcccaaagtgctgggattacaggcgtgagccaccgctcctggccatagttgtttacttgtctagtgtctgtctcactaaactttattctgcagggatggggaccatacctattttatttactattgaatatacagagccttgcacagagtatttaataaatatttgttggatgaataagatgcctccaattttagtagcaggtgcttttcattaagtctct

SEQ ID NO: 86584 - DNA, 1713 bp, Homo sapiens
ctcccaaagtgctgggattacaggcgtgagccaccgctcccagccttataatcatcttgtccaagtatcgttaagtcctctgaggctctgattcctcatatgcaaaatggggttaacatattttataaaattcattcattaaactcttgtgtggaaggtgtgcatataatggagactgcagctccctcctctttccccttttcattccacgtaggtcatttatccttaacttctaaaatggactctacaagcacttaaccgagcggacgcagctatacaaatacttttcagattcccctttatttcctcttctttcccactccacctaggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaagtatccttccctgcgtgaagcccgagtccgggccggcgtgtaggtgcggtggtcggggggtgggggacgacggcggcggctggggctctctccgggcctaggggcgaccggctaccgcggcgcccggggcgcatgcgcacggccctgagctcccctccccctcccgcgggcccttcggtcagctttggggatcctgtctctctctctttgcgggagctggggctttaccgaggatcagtgggtggaggagggcttgacacggggatggctttttggggggaacgttatgagaggggacacagtaattaggagagggggtggtggtgggagggggctgatggattggagcccggatggaaaggaggggcgggtgaaatattatggggaggggtgtttagggtaaggaactgctggtagggcaaaggtatggaatttaggagggcatgtgcactgatgggatttcgtccaaggaagggcggtgggatggtgaccaaattggtccttgcctgttttgggggagagtaagttcagggcagagtttgtatctgagctagggatagtggcttgtttcgctgatgcgtgtgtatgtgtggtgggggggctgtgctgatttttaggcttctcggtcatttggaagttgctgtttaggggatgtttgcactggaaacctgttccagagagggcttgccaggggcttatgtggtttggggatgtgtgagttacaggtgaaagagtgaagttctcatgctgccttgatcagtccagcacatggagtccttttacgtagtagcagcctcccttttgaaagtagcaatgttaaactgattggaaaaggtggcctgcttctttggggtggaagtgacttctgaattactccaggaaactcagtcttggaaatgaaacacttccttgttgggataaatgtgccacggcttccctttttatgtgagccacaggtgggtttattggaatttttttttggaggagtaattttttatggcatcttttttttttttttttttttaagatggagtctcgctctgtcgctaggatggagtgcggtggcgcaatctcggctcactgcaacctccgactccctggttcgagcgattct

SEQ ID NO: 86585 - DNA, 1048 bp, Homo sapiens
agaatcccggccctggagattatatatccgccttcgcatcagcggagcagggacgctgggagcgcgcgcggcccgccggctagtcagtcccctgacccggaaccgcactggtgccgccgctagccggctgcccacgtgcctgcaacagtggccacgtggggccctgaggaaacgcctttacaaaggtttgtcccctgcgctgcccagtagggaggaaaaccggaggagagcgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtgagacagagaagccctccggcatcctggtccccacccccgagggccctgagtcatgtgtaagccctggtctctttcagcaactgtctcaagggccttcccacccctactctgtagtccctgattttttttccccttgagcatctttgtgcagcttggactcaaacctcagagtccaaccatcctactcattagaccagtgttcttcaaactggtctgatggaaaaatcacctaaggggcgtgtctaaaatgtaaatatcccatcctcatctcacacttactaatttagaaactccaaggggttgggaatttattttttattttttatttttggtttatgggaattcatattttaacaaatatggtgatttaagtagtggagagtcctacctc

SEQ ID NO: 86586 - DNA, 1091 bp, Homo sapiens
atgtatgtatgtatttatttatttattttgagacggagtctctccctgttgttgcccaggctggagtgcaatggcgcgatctcagctcactgcaacctccacctcctgggttcaagtgattctcctgcctcagctgcccgagtagctgggattacaggtgtgggccaccatgcccagctaatttttttttttttttttttttttgtatctttagtagagacggggtttcaccatgttggccaggctggtctcaaactcctgacctcgtgatctgcccgccttggcctctcaaagtgctgggattacaggcatgaaccactgtgcctggccttatttttatatttattttatggagcagggtcttttagagctagatgctaagcctcttgggtctgccaggcaggtccacactgtgccagctccctccccccagggcttctctagggggaactatagttcccatttccttgctggccggggttcttgtcacagggattcttgagttggagatgttgtctctgagagggggcttggacctggggtgcagctcatggtgtgttcagagcaggcggaaggcttggccttgctcttgggaagctagatctgttttttattgtgaattcttgttcccaaggcactgctaaaacctgtgcctcatggcccagggccactcgtctatttggaggcagtgtctctttgcctggacaccgtttttttagactaaggctgtgctggcagtagtctcaggggttgccccacgagcacctacatcatctcccccagaggaccaggctctccctcatgctgcctgaagaatctaccacagaagtccccactgggctgatggggttcctgaagaggaggcagacccagcgggatgggaaagaagtgtcactcaggtggtgcactgcccatggccacttgtgctcgtgagctgggcagggcagctcctgagccagagcttgctatttttccagcccctcgcatggctagaaacacacagccccaaggccaggcacggtggctcacgctggtaatcctggcactttgggaggctgaggtgggcagatcacgaggtcaggagatcgaga

SEQ ID NO: 86587 - DNA, 1017 bp, Homo sapiens
ctgtaatcccagctacttgggaggctgaggcaggagaatcgcttgaacttgggaggcagggattgcagtgagccgagatcgtgccattgcactccagcctgggcaacaagagcgaaactacgtctcaaaaaaaaaaaaaagaaaaaaccattctgagaagtggtccacaggcttcactagattgccaaaagagttcaggacacaaaaaatatgaggagccattaataatagccctgcctcgcacctcttgatcttcccaggccctgtgccaagctcctccgcgtacattctcccgagcctaactaccctgggtgttgggtgctgttctgcctgccagtttacagatgcctgcatggagcgcagggtggtgccctgtgtcttgccctaggaaggggagagcctgaattgaaccccagcgtcctctcactccagagcccttgctctcaaccactacgtgatgtgtgttcacttgtgttacttaaggaattgtgaaaattgctaggtgagagtcagacccagcttgcctatgtggaaatagtatctgaattgtggtagaacctgttgagcctaaattggcctcactagtcacacaagagcacagaaatagatcatgggaaactgtccttggtggggaggggtcatcggtgtcacagcgtcatgggctcagggtgtgaaatgttgttctccgcctccttccaaactccctcaggccaggacaggaacaagagcttttccccaatctccaagagacagaacaaggtaattagaagctgctgtctcccccacctggtgagggaggtcctgagggcctgggtgctggtgggagattctgccctctagggtaggccagttacctagggctgtctcttaaataaagggaacctgggccgggggcggtagctcaagcctgtaatcccaacactttgggaggcgaggcgggtggatcagctgaggtcgggggatagagaccatcctggctaacacggtgaaaccctgtctctactaagaatacaaatg

SEQ ID NO: 86588 - DNA, 1049 bp, Homo sapiens
cagtttctcccttcacttctgccagggactctagatcagccctgcatctccccactgctatggatacagatcagaagcccccctgcactttctcctttggtgcacacctagtcccatggcaggcactgttgggagtctatagggtctccccagctggcagtagacactcacctgaaaaggggtctgttgggtttggccaccatagccatttcctatcccttgggctctgggagcctcatcagttagtaagataagaaaccagggtctatccagttctgcagatttctcctgtggctgtgggcaggtatccctccctctcatccctcatccccaggtacaaactgatgagctccaaggtctccttcgactctcagattcctgagttaggggcctctaaccctgctccatctctccccagggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcgggtaagagctgggaggttggagaagagcaccctggggtagcttcggatgcaatgggctgtgtgggtttcccttccaggccagctgacctttactgtctgagctataagggaatgagggggtaaggagtggagaagtgttgcaagaaagggcccatgaggtagacctgggaatcgagggatcgatggtccggtctggtcctgggaaggcaatgggtcctactctgccccccatgcttgccctctcaacttaggggtgttcagctccagcttcgccttcccctgctagccaagacaggtgggcctgagggggcagtgtgtatcccttaatctctctgggcagtctgggatgatgttggaggaatttctttactatagcagaatgctcagcttccttttcgtgatggtggcttctttacttagt

SEQ ID NO: 86589 - DNA, 1217 bp, Homo sapiens
ggcttctgttggcctagcttgggggaggcactaggcaacagaagctctcagaggctgaggaaagtggtaggctgtggccatggtcaggaggggtcaagataaattcctagtgcctttgacctttgggtgggatgtcttggcttgtaactttttttttttttttgagatggagattcactcttattgcccaggcgggagtgcgatgacacaatcttggctcaccgcacctctgtctccagggttcgagtgattctcctgcctcagcctcccgagtagctgtgattacaggcatgcgccaccacacctggccaattttgtatttttttagtagagaaagggtttctccatgttgatcaggctggtctggaactcctgacctcaggtgatccgcctgccttggcctcgcaaagtcctgggattacaggcgtgagccgccgcgcctggccggtttgtaatttttgatgaaactgtcggggtagagtgaaacaatctcagactcccaagacttgattcacactgcttgaccctgtcacctatgacctagggggtaccctggcctggggccagagcaggtgtgttgggagggggttgcatggtggtactggactccaggatccagagagggtcttcaagggacacctgactccccaggaattttgagggagttgtttgaggaacaagatctctacagggtaacattgtgaacctatggcctttggagcattgctttgtaccatgtgcccctcacttgtctgccctcctccacccaccctttgccagagtttggggtttccaccctacttccataggctcagccctgagcttgtagggtgagatgtagcctgtttccttcatccttgtccggctgtcttggctggatgtgggaggtggttttggatcccggagtggggtaggggtctgtctggaagaaagagttggtgtgaggtagtggggtgggcaggggtctgtctgcttatgatgtcctggaagttgggccactccctggtttggcatccaagtgttaggtcatctgggacacagctcctggtgtccctgacttcccactgagacccaacagatttctctggcagatgtgggaacaaacagctcaggttttaaacatcaggctccccttctccccttcatgtcccaccccagacaggaatctgtgcttgtcccgatcagaccatgaacactgctttgtttctcagggaggc

SEQ ID NO: 86590 - DNA, 1124 bp, Homo sapiens
ggtgtgagccaccgcgtctggcccaggagctgattttattaaaaatttgtttttcatacctagtcctgcagacaggacctgattttaaaaagaaaaaaaaagagtatctgctgaatgaaacctgtgatacgcgacaagattttcacgtgcttcaaatgccaaagcaatcagaaaaaaaaaaaagaaaaagagaaaaaaaagatgtcacataccattttctggccttggagataaatgagaggagagactgtggccattgtactacagtttttccgaggggatttgcctttcctctctcacccttccaccctgtttcaatcaagagtctgtagcaaggtagacctattcatacaggctccccctctgctctgtggtaccagattgttgctagttcccaggcatctgtggaggaggattttgggcgagggccctggctgaccatgaaatccacgctaggcctggatgagagagaccctagctgcttcctctgtacctacagcattgtcatggtgctgcgcaaggtaaggattctgggtgctgagacccaaaggaaagaccatttttctccctctctctgacctactgccctactccaccttaggaaggggctgtttgctccctcgtaccctatacaagtagcagcacgaagcccctttggttgtatcttccacttacctaccttttcactgtcatccataggattgggcccaggtggaaggagagagtgggttatggtatgcctctgcacttccaggccctgggtggggtggggtgagcacactgccaccctcaaatctccctagtggttaagggttgtgtgcagagacatgccagtacatgtgccaacatatccctgcctgtgactgttatgatggaacattgtgtaaacacatataaacaaaagaaagtgctggacacagtggctcacacctgtaatcccagcattttaggaggctgaggtggaaggatcacaaaggtcaggagttcgagaccagcctgggcaacaaagcgagaccctgtctctacaaaaaaatacaaaaaaaaaaaatcagctggatgtggtggcacatgtcttatagtcccagctactagggaggctgaggccagaggatcacttgatctta

SEQ ID NO: 86591 - DNA, 1072 bp, Homo sapiens
aactggtctccttatctgtcttcccgactggcccagagctgagttcttactaatccccgctaacctggagttaggtgcgcgttgcaaagcagtaacgaatccaatcagccggggaggcagacagcagggccggaagaacaaagctggaaagggaaacgtcgcaccggctctgcccagcggcgccagcccgggcaaccttccgcagtcgcgaagccacgcccctttcccaagtacctccgcgctaactcctcccccctggccccgcctctcaccctggattgcctaaggccccgcccaccaggcgtggccccgctctgggagggccgcaatcccgccaacaatgactccacccctccttccgctgagaaacctgtcccttttatttaaagaataccttttacgtcagcccgtcttacgcagcttcgcgtcatcagtgcaaggcgcggaggcgggacttcctgtccctggtataacagcttccgggagaagccggaagagaccggaccctgaacagaatcgcagattgccagcccttttcccgacccctacggaaagacgagtccaggggccgtcctggcgaggtcaaaacatttagtctggtcttttcaggtgaggacttccccatccaggcacagtgccggtccaatccccctttaatttcccatgactcctcgcgtcctgaagccccgcccccagttccccagccccgccccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttctt

SEQ ID NO: 86592 - DNA, 1009 bp, Homo sapiens
agagtttcacaatagaggcaaagggtagggtaggtctttaggtttaggttggggtgccggaattaggaaggtttgtgcccccttctacacaacactgaactccttttttttttttttcagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagaggtgagtggcctgggaagtgggaagctgcttgtgctcatcccccagcccttggttgcctctaaggaggctggtgcagacatgggagctgcagcaaagtgtaagatccagcccctaccaagggcaggtagatactttcttagaaatacacccttcaggccgggtgcagtggctcccgggactttgggaggccgaggcgggtgcatcacgaggttaggagttcgagaccagcctgacc

SEQ ID NO: 86593 - DNA, 1382 bp, Homo sapiens
tcagtcacagacactgaccctccaatagccccagaagcaagagcctagggcccagcaatccatacccagtccttggagttgggcagggtaggacgctggccaagggccagtgctgtctcttgcttacagcctgaggactacgggagcagcagctgtggcctggccgctcccaatgctgggggcttggcttggtgccccatccccttcctgactgagctctatgaaggactcttaaaaaaataaaataaaatgcaagcaaagtgctttgaaagaagggaggacaccctattcctgctaaggggtagaggaagaaggtgaaggcggctaggtgcccataagagaaggctggcacaatcttcattcccgccagtgtgatttcagtctcaaaagatgagtatttggctgagaaatggaaggatactccaggctccctacggagttgtgctggggccatgctgagctgcccttgcaggcagccctgggtgctgggggcagacatgcaggacactgggaagagtcagaaccacaggtgggagggaatctcagagcccaggctccccactgagcttggccagcagctttgaactccttcagaggaccctaaaagtgaaggaagatgacatcctcatttctacctgagttgtgctcgcacgggagggacatctgtactcctgtggatgagaaggggaggccgcatacttgcctcctgtgtcctatggaggagatttccatcacatcctttccacccctccctccccggcccttgggcccagctctggccaggaaaagtggggaggccgtaaaggagaaagaccatgcctttcattttcttcctatgtccttatcgtccatacatcccaaatactaggaagctgaagaagacggtgactcccaccagggagacagtggcaggtgctgtgaagaattggcggtaattgattcggaagtaccagaccacacccaacagcaccacaaagacaggcaccatgaggctgcccacattgacaccaaggctgggtggctcagtggccgagggggccaaggaggctgaggggcctggaacagctgaccctgggggtgagcggtggcagtgaatcacacagttgtcggtaatgttcagagaacgcagtgtgcgggctgggtcttgtagcaggcggccctggtagatcagtttcatctggctttcttgtccagggaagtatttgctgtaaggatgaaagacatggaagaaaagatagagggtgaggaatgagaaggcaaacaggcctggaccaacaaagcaggggagtggggaaaaactggagggtggatttttttttccctcatctttatccttttttttttttttttttttttgagacggagtctcactctgttgccag

SEQ ID NO: 86594 - DNA, 1682 bp, Homo sapiens
ttcagaggtgccttggactcacaacaacacccccacccccgtgtgtgcagccgtgttgccgcccgctgtgctatgagcagtcagagcgccgtctccacaagagtttacaaatgaaaatggaggaaatgtctttgtctggcctggataacagcaaactagaggtgagggctcccccacgtgtgcctccagttctttctcttgatgtctctacgtcgctgtatctggcatccacaccaaagaggaatttgggtagtcagccttgttccttaaagggaatagccagctgaaaaagccaaggatccaggaagaagaaagaacacgaagtcaagatggggaaaatggcaaagaaagcatgatttttggctggggccagttggcagcagatttggttggtgagagtccagggggctgtgactcttgtgaccgtagatgttctcccctggggcccaggccatcgctcaggagatatacgcggacctggtcgaggattcttgtttgggattctgctttgaggtacaccgggctgtcaagtgtggctacttcttcttggacgacacggaccctgatagcatgaaggattttggtgagcttcagggtgaaggagcagcagtccagcccttccctgggactgcctggagtttccttctctggaaactgtgctagatgtagcacctggagctcctgtgagccgggggagggattgaagaggccgtgggaccccaggtgggaacaagaggagagggtcctgcccaccctgatcgccagcctctcctgtccccagagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggtgagggaaccagagctgcccgttctctgcagcctgtgccatggtgtagtcccccgggggcattgggaaggtacagagggtgggttttacttggccccagatgctccacctgcttctgaagttgggggcagagcggggtgaccaccttgacccctttctcttccttccccttggcccctttctcttccctccccttggcaggattgccaatagcaacaatatgaataagtctgagagtgaccaagaagataatgatgacatcaatgacaacgactggtcctatggctcggagaagaaaggtgcttggggatctggggaaacccggggggcattgggatgaggtgggaagcaggaattgggtatacagtggtcacaaattgttgccttgaatgatgaagagagagtgtagttacgcgatttccttttccttttttttttttttttttttttgagatggattctcgctctgtggcccaggctggggtgcagtggtgagatctcggctcactgcaacctccgtctcccgggttcaagcgattctcctgtgtcagcctcctgagtagctgggattacagtcgcgtgctaccatgcccagctaatttttgtatttttagtagagatggggtttcaccatattggccaggatggtctcgatcttctgacctcgtgatctgcccgcctgggcctcccaaagtgctgggattacaggcatgagccaccgtgcccagc

SEQ ID NO: 86595 - DNA, 1105 bp, Homo sapiens
ggcggggcagggccggccggggagggggcgcggggcctttgttagggagccaggccccagcccccgggacaatagagacaccctcccggactcctctccccggccggccggggctgctggcgggcggggaaggagaggggctgggacgcgtcccactctctgggggtcggtctgtcccggcccggcgccggccccggcggctcggctgtcctccccccagtcggtatgatgcagcagcagtgccgcagggacgggggaagagccgaggcccggcctcctacccttcccagtgcccccggctcattcgtcagtccccaccccactctaggccggcagctcctgaaactcgtacccaccgttccgaggggccctgggttgtgggttctgtgtctgaatccttgggtgggggttcctggactttggggctcttggagagacttccgggctggtcctgagggagggcgggtggttatttaaaggaagaacaggtaaggggagtgcccgctcctggcgtgccaccctaccaggctcttcccccccaccccccgccgttcctgctcatggtggctagaaatgtcccttagctctaggctcctgtgggctctgctcccctcgtggagtggcaggctgatttcaagggaagacagagtggggtgaaggttgtagggtcctagggccatttctacttctggtagcagtacccccccaagtggacatcctggctgaaagcagaggtgactctgaggagagtctttagggaaggcggggggtgtatttaggagtctgtgcagttctttgccacaccctgtgggtttgctttgaggccttggagttccttctcctccccctgctgcattgcaccatgggtatcaaagaggggtttgagttttggggacctagggtgagctgctgcctcctatagacccagactctgattggcagtggagtccagggcctgagctcaggcctgggaaagactaggccccctttaggtttcaggccttgaaggaccatccagacttagggagcctgggccttggggagggagagaccctgatgccaggactgagctttgggcagcgaggtggggagggaaggtggccgc

SEQ ID NO: 86596 - DNA, 3508 bp, Homo sapiens
gtagcatggtgtggtggcacatgcctgtagtcccagctactctggaggctgagttggaaggatcacttgagcctgggaaggtcaaggctgcagtgagctgagattgtgccactgcactccagcctgggtgacagagcaagaccctgtttcaaaaaaaaaaaaaaaaaaaaaaaaaaaattagagctgtgttctcagatcccaggggctctctgcagagacccaaaatctagggagcctgggaggggtaagatggggtgatgatatataaatgctcagcccactgcctagcactgggccagcatgctcagtcagcagtagttggctatgttccaacccttgccgcttctgtctcccccagagcctgtctccccaggaccgtgcagcatataaagagtacatctccaatgtgagtctgggagcagagcagcagtggggtaggggtgggggaattcaggggtgtcgaactcatggctgccacctttgtgtccccatcctgcagaaacgtaagagcatgaccaagctgcgaggcccaaaccccaaatccagccggactactctgcagtccaagtcggtaaggagcccctcccagatgcaggggcgtggggcggggggcactgcctggaatggttgggcagagaccagagaccactgatgtgcctccatccctccaaggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgaggtggggcagacagggcacagtgggaggggaggggagtcctgccaggagggccacctggtgactccacatcctttctcaccccccagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttatttttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtttgactgctgtctggtcactggaatcaatgaaggttcacaggggtgacccaacaggtttgatctataaaaatgcttgaagccaatttgccttttcttcctagaactatcttcctcttccctaaagattccataggcaacctaccttcacattgttctgtgctactgttcttgcccttttctcaattccatttgttcaccttgggttgtgagaccactaaagattctgagaagttggagaacaaatgcattttcacccaaagtacatggtcttgg

SEQ ID NO: 86597 - DNA, 3365 bp, Homo sapiens
tgacaggagcaaggcctgcacccgacgccactgtgagagttctatggtgttggagaaacgagtgggggaggctcagcgctgccactgcgcactgtgtgaccgtgggtaatgccatggcccccttctgggactcttgctcagaaggagagaataggatgtaggattcagtgtctgggcgacccctgcagctcccaccatctgtggtagaagccagcaggtctgctctgtggtgagtcccgccaggaggcgggcagggcgccagcctccactccctgcatcacagcgtgggaggcagaagagccagcgaggaggggtctgggtggccttcatagctcagggtgagatacccttgggtcctgagtgaccccatcccctcctccccccagatgaaatatattcaggacttccagagagagaaacaggagttcgagcgaaacctggcccgattcaggtaaggcagtggagcccagaggagggccacggggcactgggggcagcagaataggctaaccctggccagagccttgagtttgccatctctgaggcatggaagaggatgggtcacatgtgagccctagtgtgtcatgctcagggacagagacaggcaggcagccaccgtcccactgagccccagctgaaaggcccaggaggcttggtgggtggggcagctagcttgagtctgccctggcagcgtcccctgctgatccttgctccccgtgtcctggctagggaggatcaccccgacctaatccagaatgccaagaaatcggacatcccagagaagcccaaaaccccccagcagctgtggtacacccacgagaagaaggtgtatctcaaagtgcggccagatgtgagtgtccggccaagggttgggggtggaggatgcacggcggtggccaggggggagccgcgccaggtcggccgggcacggtgcaggggagcaggagaggaggcccctccccaggggtgggctgcatggacagggcccgggccagctggcgtgcaagcgtgtgcgtgtgtgcgtgcgtgtatgagccagtccccttgcacccaggcgggatccccgcctctccgccttcccctcctggcctgtgggggacactgatgtgacctcccatggcctgagggggcgggggcctctgtgcccccttcccccttcccccctccccctgcccctggctgcctgtgcgtgtctgacggcttttggtttgcaggccactacgaaggaggtgaaggactccctggggaagcagtggtctcagctctcggacaaaaagaggctgaaatggattcataaggccctggagcagcggaaggagtacgaggttaggcttccgctgcgctcctccccgtccggctcttcacgagcctctgccctccgactccgtggccaccgcactctgcgggaggtgtcactccccatccctctgttgagggaggggccttctgggcccctcacctctgcccctaccttccccaccccccacccccatgagatctcaggctagggcagggcagggcaccacgtctcgtgtgacaccactgacgcgcagccacccccagctttgctccctgcctgccctccccagcggctctccccctgcccctgccctagctaactccacaccccattgccctccgtccccccacctggctctgcaggagatcatgagagactatatccagaagcacccagagctgaacatcagtgaggagggtatcaccaagtccaccctcaccaaggccgaacgccagctcaaggacaagtttgacgggcgacccaccaagccacctccgtgagcgctgccctgggatgggtgggcgagtgggcagctgggaagttgggctgggctctgcaggtgagaaggcctgctgccctgctcgcttacgggctgcacctctctccccgcggctctgataggaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcaggtgagctgtggcaggggccaccctgccttggggttttgaagcatgaggtctgatcccatcttgggccagtcagtccctggtggcgtgtgccttgggtacctgcctccaatacagtgtggggctgggctgggcttagcaactgagcccgtccaggcagggagtccagcccacacccaggctctggaggcccgctgaaggtcactgtcctccgagtactgcagggtctgtggtgacactgtctccagactgatcctgactccactcactttcccagaaaaagaaagattacgaggtggagctgctccgtttcctcgaggtgagtgttcctccggtggggcagtgggcagagaagactgggacttggcaggcagagccctggtgagcccctggagatagggcaccatgcagtctgggtgccaggcatgcagccccgtgctcctctttcctgtccagagcctgcctgaggaggagcagcagcgggtcttgggggaagagaagatgctgaacatcaacaagaagcaggccaccagccccgcctccaagaagccagcccaggaagggggcaaggtgggcagagggtgcggccgcgcaggcgggggtgggcaagactgggctccctggcagcacccacggaccccgaccctctgcacctggacagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggtcaggctgcctggcggagcgctgtgcccccaggggggctgccagggccccctcttccccttggcgggccgtgccacctcgcccctggccgcctgagccacgcggtgcctgggctgggacgtggggccggcgcccagcagccggaaggcgggaagctgtcagctgagcgccgcagaccaggcgggggcgagccccaggcgggagacatctgcaccagcccatgcttctgcccgccggcgggagcgcctgggctgctgcgcggggagcgcgcgccccctgggggtgggtggaaggctgacgcccgggccatccccgcaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaaggtgacaggggtggg

SEQ ID NO: 86598 - DNA, 4031 bp, Homo sapiens
tgcgccgggtaaccgaggcggctgaggacgcgcgctggggtcggggccggacggcgggagcgaaccgcggggtgcggtgggcgcccagcggggacccgaagcgaccaccgagcaggcgaccgggcgcgagcagaccagggcacttgggaggacgccgagagccgggggaggggaaggcaggaagcgaggcctgagccgagccccggccgctggcggaggagcccgcgcttctcggagccggcaggcgcagttctccccggccgccggagggggcggcggggccggtgagcgctgcgcccccgcctcccggccgccgtcctcccgccctctccttggctcggctccccggaggccggggcgggggcgccggcggggctgggccgcaggctcgggggaggaggcggcggttcccgccgcggtcgcgcctctgtgccgggctcctccgtgcgcgtcggggtggctgggcggtggcggcgcctctggccggggtgggtggctcgggggcggggggcaggctaggccgcttctctccggctgcttgcccgcctgtgcgggcggggacggcgaagggagcccgggaggggggagcggcgggaatccggatccggtccccgggggcggtgcggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaaggtaggggcatccacccccggccctctgaaacttaaaccctctttccctcgtggctgcggggctcactcccttcttcaagggctttttcagtctgcatacactgaactgggggagaaagtgccttgagtatttatgaatcaagcatctcccacacttggggtttggctgaatccaaattatttggcctggagtggctcacctcccctctctccctgtccctcaccctctgtgttagaggaggcctgccttctggggttcccattcagcctgaagtgtgtcccagcccagtgtcctggaatgggaggaaggatgagtgtagaggaagggtcaggaaggggttggggaaggcttctcaggctttttaggaagaccatgaggcttttgtagaggcaggtggagaaaagggctgttttggtggttttaggccccaagccatgggatatatgtactcaactagatctctgcctcattcagcagtgatccagtctagatggggatagagagtaggatgaagctggacagctggccatgcttgtgggacattgaggggagaggggattatgggtccacgtggcccattctgcagaatctctggcccaggttaccagatgcaaatgaaaatggagagcccttttgacttctggccttgggtggctattctcccagcccatccacagtggcctagagctctctggggctgcatttcagtggctgaaaaataactgttccagacctgttcttgcttccctgggtagttgggctgacaagacagcttgtaattctgggggttctccctggagcagggccctgagagtttctgtgcacctgcctaccttgcctcagagctgccctgtatcctgcttctgcttctgtttcctttttcttatttgccagaaattctcccttgatctgctttaaggggctagggggtggtgggtgtctctaacattggtttccagctgtgcaggagagacatctgcatggattttccttactgtccacaccccattctcagtcgttgcacatttagaatatccactcagaacttgaacttggcagcacatttagatatattgcttccctgcttccctccttctctgacaagctacctcgtttcccacaaagccctgaatcactgtaccttcatttccacccctcttccccttacagcaaatagctgcccgttgcagcttggcacagtataaatgataatagccttgaagcaagccagacttgagttcgagcctggctttctaggtatagcatggtctggactggagtccctgccctgatccaatatggccacagtttccttagggctgagccatatcttgtctgtgccttcagatgggaagcaaccaggggctgggatgccctagggaggaagagttgagcactcaagaactggggaacagatcggggggatagcatgagccaggcatgatggcctctgttactctttaccagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtaactgatcccccttttctgacatacacacataccccccactcagcgtggtgggggaagtgaaacaggctgtaaacaggaaggaaagagaccaggagaggcattcatgtggtctcccgttagctctctacctgcccctttgcattttgggaggtggcacggttgacagcactggcttaaagttatgccactttctatctgagtggtcttgagccaaacagcctgagctgtgctgagattgacggaggtgctagcatgctgagattgacggaggtgttagcatggacaaccaggttgaggtcagttagtccccttgttgctggcctttggtgtgtactgactgcctgggcctctgcggtaggcatgggccagtgcctgggtgtcatgctgcctgcttcatttggctgttggcctctgctcttctttggtaaatttagtctagtaaagagtagaagagacccgttataagatgggggtatactactgtgtggcattttccttttcccaacttccccttcctcccacccctcttcctccaggtgaggaagttccgtacattgacagaattgatcctcgatgctcaggaacatgttaaaaatccttacaaaggcaaaaaactcaaggtgagttactaggaggaggagcatgaggggtatgggaggaaaggtccaaagaagggatgtatttgacctccattgtgtccttgtcccttcttccagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaaggtggggggaggagagttaaggtgggaggaggggagaggctgggagcagctggtgtggtgtgggtcagttggaggtaggccttggagaaacctggcatcagggatgagggtgagtcagcacagcagaataggtcctgggcagccacacctgattgccccttcctcggcccacacatggtcaggcacaggcaccatcacagatgtaaaccagacagcaggtgctcagaccaacc

SEQ ID NO: 86599 - DNA, 1029 bp, Homo sapiens
agagcagaggccaacagccaaatgaagcaggcagcatgacacccaggcactggcccatgcctaccgcagaggcccaggcagtcagtacacaccaaaggccagcaacaaggggactaactgacctcaacctggttgtccatgctaacacctccgtcaatctcagcatgctagcacctccgtcaatctcagcacagctcaggctgtttggctcaagaccactcagatagaaagtggcataactttaagccagtgctgtcaaccgtgccacctcccaaaatgcaaaggggcaggtagagagctaacgggagaccacatgaatgcctctcctggtctctttccttcctgtttacagcctgtttcacttcccccaccacgctgagtggggggtatgtgtgtatgtcagaaaagggggatcagttacctcattagaaatctccacccatttgagcttgcacatgtctccagaaaagtctttaaatgctactttttcccagtccatgtgtgattcggtggttttgaacttggagctgtcattggatggaaggttgttcttcatgcattccagcaaagtcagcatgtcttcctgggaccaacggtctggtaaagagtaacagaggccatcatgcctggctcatgctatccccccgatctgttccccagttcttgagtgctcaactcttcctccctagggcatcccagcccctggttgcttcccatctgaaggcacagacaagatatggctcagccctaaggaaactgtggccatattggatcagggcagggactccagtccagaccatgctatacctagaaagccaggctcgaactcaagtctggcttgcttcaaggctattatcatttatactgtgccaagctgcaacgggcagctatttgctgtaaggggaagaggggtggaaatgaaggtacagtgattcagggctttgtgggaaacgaggtagcttgtcagagaaggagggaagcagggaagcaatatatctaaatgtgctgccaagttcaagttctgagtgg

SEQ ID NO: 86600 - DNA, 1036 bp, Homo sapiens
agccacccaccccggccagaggcgccgccaccgcccagccaccccgacgcgcacggaggagcccggcacagaggcgcgaccgcggcgggaaccgccgcctcctcccccgagcctgcggcccagccccgccggcgcccccgccccggcctccggggagccgagccaaggagagggcgggaggacggcggccgggaggcgggggcgcagcgctcaccggccccgccgccccctccggcggccggggagaactgcgcctgccggctccgagaagcgcgggctcctccgccagcggccggggctcggctcaggcctcgcttcctgccttcccctcccccggctctcggcgtcctcccaagtgccctggtctgctcgcgcccggtcgcctgctcggtggtcgcttcgggtccccgctgggcgcccaccgcaccccgcggttcgctcccgccgtccggccccgaccccagcgcgcgtcctcagccgcctcggttacccggcgcagcgcggcctccgggcttcccgctccagcggctccctccctggctctgagtggcggcgccctcccccgctcggccgggcacagccgcagctccctcccgcggcggcagcggctcctcctccgggcgaggcggcggcgctggggcggcggctgctgctgctgtggcggcggcggcggcggcggcggctgtggctgctgcctgctgctcctcgcggcgaaaagcacaaagcacagcgccctccgcctgcaggcagcccgcccgccgccggccccggcctcagctcgcacaccccccgccgccgccgcagcctcagccgccggagcggggaggaggagggagaagggaggaggaggagcgggagggggggcgggagaagcggggcagcgagcgcgtccttccccgtagagcgcacaccgacccccggggagcgagcgccagcccgcccgcctcgccggctccgctccctcccacagcctgcccgggcgggctccgcggggggcagctgggaggaggggcgggagctggggggacccgggcgg

SEQ ID NO: 86601 - DNA, 1023 bp, Homo sapiens
ggtgctgggctcccctcgcggctgcccgccgccgccggggggcagcgcctgcggcctgctttcctagggatggccgaggctttttgacaagctgattgcgtggcggggattggctggtccgggtgtgacgccggtaacaacaaaggtggagttggaagaaattagattaaaggagaggaaaaaaattaaagggggagctggcataggacaggaggtagagaccgagggagagatgcgccaagcggtgtctcccggttccaactccccccacacccgcctcgaccctagaagatccctcgcgcaaacccactgggattttgctctttcccctaccccggcccagtgaccgacgccggggtagctgctgcttcttgaaaaatccccgcaactcccaccccgacacccgtcactacgacccagggggagaactttttgctcggactcctcggatcctaaacccagcgaaacgggacattgagaagcttgtcctaaaacccggaaggcccttgcggagcatggagatcggataaggcggggtgctcccccggttttccgatgtgttgcaaatctaagagcttctttctcgctttttttttccctgtaactacccccccccccttttgcttcagggttgcaaaagcaaagagcaattaaaaaaaaaaaaccgcgcacacactcagacacacaccagtggcgacaggggagagttggaaagacgcaggagagaagcaggaggcaggaggcagcggggatggagcaatgggagcgggaagcaggcaggtttccttgcaaatccccctccggcctcacgccgtctcgccggccccggcaggggagcgaggaccccggcgaacagatggaggagtggagctcgctctaggcagctgggcttggccggagaatggaggagccaccaagcgaccggctgattggaagagaaacgcagagcgatggaggcggggtaggaggacgatttctctgcggggactggcggcggcgtacacgcccgggtcgggcgctgca

SEQ ID NO: 86602 - DNA, 1186 bp, Homo sapiens
gcgcgagggatcttctagggtcgaggcgggtgtggggggagttggaaccgggagacaccgcttggcgcatctctccctcggtctctacctcctgtcctatgccagctccccctttaatttttttcctctcctttaatctaatttcttccaactccacctttgttgttaccggcgtcacacccggaccagccaatccccgccacgcaatcagcttgtcaaaaagcctcggccatccctaggaaagcaggccgcaggcgctgccccccggcggcggcgggcagccgcgaggggagcccagcacccggttctcgctgccccgggtggcagcggggcagcctccgacaagacgtcccttggttcactgtcctgcaggccggggatgaaaggcctggacagggtccaccacccactctcccactgccacggccgtggttgactgtctttgcctccccttttcagaggaaaggttatcaggacaggacgcagggagccagaagaccatctgaaggaagcctgcttccaacgggcccagcctccagccaccgctcctggggcagcgccattgctcctggctctcaggctgccagtctcccacaccgacgctctactgcccgcatctcggccagctgggtcacccagcccctttcgactctcccctggcacgcagccttctccttcactcggcctgcctcgctgctgctgtaattcctcttgtctcctgggagaaatgagattgctttcccaggacttccacatcccacttctatcaggtttcaccaacagggaggaagccctgtcaagatctggtgtgtcctgttttttttttttttttttcccagagggcactggcatgtaggagaagcggatttaccactagtagatgttaatgaaatttcagcttctaggcccctaacttgcaggacctgcccaaggccctgaacttaattttgttttcatcatttggtatttttttgttaaaagagccaccgaccacctccccgctaccccagaactgcacgtgtttctggccctacaaacccagatcgtcccttggaatatacacagggcaatttgtgtaggatcacactgcgctaaaagtgaggcatggtgggctaggcgcactggctcacacctgtaatcccagcactttgggagaccaagacaggaggtcttaagtgattaagcc

SEQ ID NO: 86603 - DNA, 1096 bp, Homo sapiens
gtcaggagtttgagaccagtctggccaacatggtgaaaccctgtctctactaaatatacaaaaaatagccgggtgtgggggcgtgcacctgtaatcccagctacttgggaggctgaggcaggacaattgcttgaacccgggaggtggaggttgcagtgagccgagatgagatggtgccagtgcgctccagcctgggcgacaagagcaaaactccgtctcaaaaagaaaggaattcaatttgttctcaagggtcagggagaatggagggtggggtaccttccaggtaggtaggggagtggtttggccaagggcagggaggtgggaatggtgtatcgacagcacagggaagtcttgactgcagaggtgagtccttctagaagaggttcatataagatggaaaaagcaaggtcaagtttgaagaaccctaactgcccagaagggtttggacttgattcaggaggcattagggagtcttgcaggttcttgggctgggaagtgacatgattaaagtgattcacctggaagtgaattcatacaggaggaattcgctgtaaggaggcaaactgggaatctgtgcatgtcagtgagtcagtagcagaggcgggctgacatagcccatgctatcataggacctgcagtcagcatggggcccgacgttcagcaagagtgagcactggctggccatggtgctcacgcctgtaatcccagcaccttgggaggggctgaggtgggcagatgccttgagcccaggagtttgagaccagcctgggcaatgtggcaaaaccctgtctcaaaaaaaaaaaaaaattgtggccaggcgtggtggcaagcgcctatagtctcagtattccagaggctgcagtgggaggatcacttgagcccaggaggtcaaggcttcagtgagccgtgatcgcgccactgcactccagcctgggtgacagagtgagaccttgtctcaaaaacaaaacaaaagaaaacactagtattgtgcagggagtggcaggagcagagggagctggagtaaggcagggcttcttggagggagagacatttgatctgactcctgagggacaagcagtaactgtcccagtgatga

SEQ ID NO: 86604 - DNA, 1542 bp, Homo sapiens
gagataaaacaggactggtccaaggttcaagacagccagaccctctcctaactccagaggtgcctttcgtgcccggggagggctcttctggccccagggtctctcaccctgtctctctcctgtccctcccctccagctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattgcgtattttctaagagttttcaacatagtttggcttcacacacaacttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaat

SEQ ID NO: 86605 - DNA, 1082 bp, Homo sapiens
tggggatcagacctgtcctgggagggggaggaggagtcaggcctggctggaagtaggagaagtgaggaagggagattcagcaaggggatgagggaggggtcaggaatgaaatctgagcggcaaaaatggggatacggtgttggggtcagtgggccagatcccgggaggaagtggaggtggtactggggtggaggggtgacagggattcgtgcacaaatattgggagttggagggaatggtgcagtgttgttggggtcagctggggtgatggggacgtcagtggaggatagtgtgggaatccctgaagtgtaagatcgtcttggggatcttgccgcaagatcagggtggtggaaaggcgtagagaagaagtgttacagggatcggcaggggtgaggtcgggggtcacggcggatgatgacggtcagtgagcctgtggtgcaggtgagtgaggcgatgaatgcaatcgtgttgaaggttgcagagcaacaccgcaggtccttgtgagtgacgtggggtccctgcagtaaggttggatggccactctagcggaagataactgaaggtgaagggtgggctctggctgttggaagtcactggatcttatgctgggggcaatgttagaagatcattgtgggcatctcggggtggggctggctggatcagagggttgatgctggagaggtgggtgctcgtgtcgggtgatgttagagtcgatggaagtgaagatggggttcacccggtgatgtggtcggggcggcgggggtcaggggttagggcaggccgtgcgctcacagctgctcctgcagctccaggatcacgccttccagctcccgtttctcgcgctggttctgcgccgccgcctcctccagctgcagctgaagccgccggttctccgcctccaggtccttcagctgcgactcgcgcagacgcaccagctcctccaggtagccctgcggggcgccggctcagcccgggcggctgggaggacgtcccggccgcggcccccatccccgccccgccccgggatgcccggatcccccgcccggcccgcccgccccccgggcccgccggcgtcgcgcacc

SEQ ID NO: 86606 - DNA, 3041 bp, Homo sapiens
ttttcttttagacagagtctcgctctgtcacccaggctggagtgcggtggtgtgatctcagctcactgcaacctctgtctcctgggttcaagtggttctcctgtctcagcctccgaagtagctgggattacaagcgtgcaccaccacctgccgctaatttttgtatttttagtagagacagggttttgccgtgttggccaggctggtctcgaactcctgcctcaagtgatttatccgccttggcctcccaaagtgctggctgggattacatatgtgagccaccgtgcctggcctccataaggtttttgaagggtgaccaggtgtccgcctggacccagctgctggggtactgcatgtgtagaggcagggaggcctgagggctgtgggcagaggctgagggcgtcaggcaaaggcctagcctgggccagccccatcacagacatcacttgtgtccctcctcttcccctgggctggtgcctgcttggccaggatgccttcgtgaagatcgtgaggcacgagggcaccaggaccctctggagcggcctccccgccaccctgtgagtagccgggtcctgcaccactctcctctggtacttcctgaccctttgctccctgttgaatggctaggtggggcaggtgatgctttaaaagtttgggtccttttgggagtcccagctaacctctctctgtatccccagggtgatgactgtgccagctaccgccatctacttcactgcctatgaccaactgaaggccttcctgtgtggtcgagccctgacctctgacctctacgcacccatggtggctggcgcgctggcccgccgtgagcatagtcttgggcctttgacctccctctgtccccacctcggcccaaacccagtcagtcccagctcccagccccaacctctgccagcctagggataggggggtgttctaggtccccagacctgggacagcaggtaggtgatgccatgtaagacctgtgatctcacttctccccattgtcacccccaatccccacacagtgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcaggtaggcacccaagctgcagggggtgggtgagggaaccctggggtgatgcacaaagggtctacagccaagtcccagctttgtgactagtgaccatgaagttacttagcttttctgagccatgggtttctcatctgtgaagtgggcctagcaggtagagtatttgcccaggcggtcaggagattaattcctacagagtgcctgcttctgagcctgcatgtagcagacaagactcacagctgggagggagtggtggcagtgaaaggtggacggtctggggccacttccttgcccttcccgtctctaatcagtgcatcccccaccccaagccctgtactggttcaactatgagctggtgaagagctggctcaatgggttcaggccgaaggaccagacttctgtgggcatgagctttgtggctggtggcatctcagggacggtgagtggactgggctggaggtgaggccagcggaggtctccctgcggggggcctgaggatttttggagatgcccagaagcagaccccatgaggcctttgtccctcccagccgcaagagccatctgggaggtaggggtgggggtccaggaagtggagctgagccctctccccgcccaccccaccaggtggctgcagtgctgactctaccctttgacgtggtaaagacccaacgccaggtcgctctgggagcgatggaggctgtgagaggtgagggcccagattgccgtggcaggggacaggtggggtcctgaatggggtctcactgagccggcctcgcgtttgcagtgaaccccctgcatgtggactccacctggctgctgctgcggaggatccgggccgagtcgggcaccaagggactctttgcaggtcagtgtgtgggtgtcgggggtgggggcatggcggacctgcgacctgacccctgacacgggcctcctttccactgcaggcttccttcctcggatcatcaaggctgccccctcctgtgccatcatgatcagcacctatgagttcggcaaaagcttcttccagaggctgaaccaggaccggcttctgggcggctgaaaggggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttctgcctggtgcctgtccctctggggcctggggtggctgggagggaggcttgggagggaccctggtgctggtttggctgcccagagtggcacctatgaagaggacctctccagtttggcgagagtcggggtgaggacctagagtgtaagggaccacaagtagacattctggtggtgaggtccctttggggacctcccccccatgttagggttagaattgggggtggtaggggctgggcacggtggctcacgcctgtaatcccagcactttgggaggccgaggcaggtggatcacaagggcaggagattgagaccatcctagccaacacggtgaaacctcgtctctactaagaatacaaaaattagctgggcatgctggtgggcgcctgtagtcccagctactcgggaggctgag

SEQ ID NO: 86607 - DNA, 1046 bp, Homo sapiens
gggcaggccacctcgtctccccgagccttagttttccccggcggaggggggcggacagtccctgctttagaggtcattgccagggttgttgaggcaacagatgtttcgagggcggtggatgagggttgggttaaagtctcacagtgggccgggtgcggtggctcacgcctgtaatcccagtgctttgggaggctgaggcgggcggatcacgaggtcaggagatcgagatcatcttggccaacatggtgaaaccctgtctctactaaaaatgcaaaaattaactaggcgtggtggtgcgcgcctgtagtcccagctacttgggaggctgaagcaagagaaccgcttgaacgggggtggatgttgcagtgagccaagatggtgccactgcactccagcctggcaacagtgcgcagagcgagacgccgtctcaaaacaaaagtctcacagtggcccagcctcctttcctgccatccctggagttgtggtctgtttgaggtttggttttcaggactgaagcttcaagatggctgaccaggaccctgcgggcatcagccccctccagcaaatggtggcctcaggcaccggggctgtggttacctctctcttcagtaagacctaggggaggtggggtgggggcgggtggggatggggcagaccggagattggaggctgtgtggtcctgggggaggagtcctaggggtggggtcctgaaaggagccttcagacccgcttcctcccccagtgacacccctggacgtggtgaaggttcgcctgcagtctcagcggccctccatggccagcggtgagtacctgacctggaactagtgaggggtggtgcctgggcaaaagaaagatctcccagaggctggccgtggtttctcatacctgtaatcccagcgctttgggaggctgaggtgggtggatcacctgagatcaggagttcaaggccagcctggccaacgtggtgaaactctctcactactaaaactacaaaaattagccgggcttggtggcatgcgcctgtagtcccagctacctgggaggct

SEQ ID NO: 86608 - DNA, 1022 bp, Homo sapiens
cgggcgtggcggcgcgcgcctgtggtcccagctactccggaggctgaggcaggaggatcgcttgaacccgggaggtcaaggctgcagtgagcctagatcgcgccactgccctccagcctcggcgacagagcgaggctgaaaaagatgctgtctaaaaaaagatgctggaagtgcgtgctgctgccacgttaagcgcgacgtggagaccgcgaagttggccggcagctctcagcgctggacaggcatggaactcgcccgcgcggccccgtcaagggggcgggaccgtcgcaggtccgggcggagacgcgagtgggcggagccggggacactccgggcttgcggctggtcggcccgcggcgggcggggcctcgtggcgcggtgtaggggcggggcccccttggctgctttcggcgtcggcctaggtgcgctgcgagcgcgcgcggaccgcgcacaggcggcggagccggtatgggcccgcctgaccctgggcgccgcgccgcacgagcaccagcctagagccaggtaggcggcactgggccggggctgggggcggagacggaagcgggggtctccgggcggccgtgcgagccagggcaggtgctggggccgtcgagctggcgtggtccccctcacctggcggctctccgccgttcggggccgggagtgtcgccgagggtcggggagacgtcctggtcctacgttcctacttcccgctctcccggctgcgccccgggcctgcattttggggcgggaacccagagactgctctttctctccgggccccgggtctggcccgtccggccgggcggggagggccgggcatcccagcccgcagtcctgaggaggcgacgggcccttcttggtcaccggatctgtttacacgtcaccctcgatgcccggccgtccctccacgcccagtaacttgggctctcaggtgcctgcccggggccttggtgctggagtgggggctgtgggggcagcacaggtactctgattttggggccacgagggccaaatccgcg

SEQ ID NO: 86609 - DNA, 1050 bp, Homo sapiens
agcgattctcctaccgcagccccccaaggcgctgggattacaaatgtgagctactgagctggctcgctcctatcctatcctgccctgtcttgtcctgtcctgtcctgccctattctgccctattctccaaactcggttgacatgctaggcaggccccagagtgagttgaaggatggtttccaggacaaagataaacagccccaaagccctttcctcaaggtgctcagcaggacagggagcagggattggtgggagacagtctcaggctgaatctaatttaagatacaaggttgtgcgccagttgccaggtgtagggagaggaagtagattgtctccaggtggggaagaagagatttcattccaccttaggagcatctccttgagctgagtctgggaagattttaactggcaggtggaggaggaggtgttgggaagagccctgggaaaccagatgggaagggcaggcttggcagggattgaatgccatgttcaatgccagtgggcttcaggagctgctgggtgcctggcacgggctgggctgtggtgggggctgtcgaaagagaagtggcttcctagtctccagatcggccctgccttcgaggaattgatatgggagggtgaggagagaaaatgtaccacagaacagattagccagtgacaagagtcagcctgcttggtgccaaagggcctgggccaggcagagatggatgatgggagatgggccaggagagaggagaggcccagggaaagcctgatactgggccgtggaggaacggcagtgtctgcacaggggatggagactgctgcagcctgagcaaggaactggagctgaggatgaggcaggggcagggggatggctaaccaagctcgaggcagcagaagtcggaggagggaaagggtgccaaccgagctgtggagtcgtgtggcaggggttctaagcctggagctagagcagacccagacagcggataagacacctggcctgctgaggacctagtactagtctgtgccctggtgacacatttgtgcttattttccttcctgtgtatc

SEQ ID NO: 86610 - DNA, 1367 bp, Homo sapiens
cggggtgcaggtatgaacatagtgtcaggcaaggaggcatctggaggggaaccctggcttttcctggggggactccctccctgcaccctagccctgtcctctcccatggctactgatgccttcccctcaccccagaggtggcccacatctgcacagatcagacccacaaaaatcacgtcttcctgactctcataagcctgcccagtgaggcccaggcattaggccatgtgctggggactcagacccacacatatacgcatgtcagcattcatgcttacaggtccgcacatgctggggcaagtgtcacacacggggcgctgtaggaagctgactctcagcccctgcagatttctgcctgcctggacagggaggtgttgagaaggctcaggcagtcctgggccaggaccttggcctggggctagggtactgagtgaccctagaatcaagggtggcgtgggcttaagcagttgccagacgttccttggtactttgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggtgagtgcccctcagcctaggcaagagctggcagcctgggttttcccaaagggtcatcttggattggccagaggaggacgccaggcacaagtctgtggtttatcattttccctgtctttctaggacaaatggcccacaacactgagcaggcatctgggtggcccctgccaggttgatgcccactgctctgccggccactcctgcatctttaccgtctcagggacttccagttgctgccccttcccagaggtgagcgtgccatcagcccagtggaggggcttaggtctgcatttatgcttttcctgcactctaccacctgcagataaaagggccctgccaatgcaggtttctctgtgttccacaggccgtggcatgcggggatggccatcactgctgcccacggggcttccactgcagtgcagacgggcgatcctgcttccaaagatcaggtgcagctggggtgtgggtgcagggcaggcagacgggcagcatgtggagtctggaacccaggagcccagctggcgggggcagccctgattcctgcccttgtgccctcattcatgtggcatctgtactaagcaacagccctgctgtggacagaggggcagcactggggataggagggtgcgggagaaagtgcaagactccaggtccaggcgttgtgggggtggggagaggtcgagctgggccggtctaataccaacccatggtcagtgggtgccccttc

SEQ ID NO: 86611 - DNA, 1085 bp, Homo sapiens
ggtcatcttgtccacaggtaacaactccgtgggtgccatccagtgccctgatagtcagttcgaatgcccggacttctccacgtgctgtgttatggtcgatggctcctgggggtgctgccccatgccccaggtacaaatctgggggagatgggggtatgtggagggaagtgggggcagagttgggggccaggggcagggggtgaagacggagtcaggaccattttttctcaggcttcctgctgtgaagacagggtgcactgctgtccgcacggtgccttctgcgacctggttcacacccgctgcatcacacccacgggcacccaccccctggcaaagaagctccctgcccagaggactaacagggcaggtgaggaggtgggagagcatcaggccaggggctggggcggggcctcattgactccaagtgtaggaaaaagtttcctccatcctggctgcccctcacgtttgctcctcttccagtggccttgtccagctcggtcatgtgtccggacgcacggtcccggtgccctgatggttctacctgctgtgagctgcccagtgggaagtatggctgctgcccaatgcccaacgtgagtgaggggctggagccagcttggctgtgtgcccccagccacctggccctgacacgcaccttacaggggctctgtggcatggggctggctggctgcttgctgggagcctggctgatgcagggttcatgctaccccctagtgggggattggggcagtgccagccatcagcctggctgctccctgtgtgctactgagcctggaagtgacaaagacccacccctgtccccactcaggccacctgctgctccgatcacctgcactgctgcccccaagacactgtgtgtgacctgatccagagtaagtgcctctccaaggagaacgctaccacggacctcctcactaagctgcctgcgcacacaggtaccagaggcagggtgcagatacaggggtggggccccctttcctcccttttaggcctggccttaggatcactgcaaggtggtgtaagcggtaccctccatcttcaacacctggttccagctgtggagccgg

SEQ ID NO: 86612 - DNA, 1231 bp, Homo sapiens
ggctacctacaacgccctttcctgcccaccccccaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgtgagtgcctccctgcctgcccctggataggggagctaagcccagtgaggggacaggaacataatgccattctgtgctcccttccccgccaggctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccaggtcagtgccaacccccatcctggggctgggtatggccagggaccaggtcccacctcgtccaaccctctcgcccccctctgaccatccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaacagtgtctgatttgccgccctgcctgccctccccagggccccagaacaggggttcacgtccactgccaacactcccctcccctaccccacagaaagacataca

SEQ ID NO: 86613 - DNA, 1035 bp, Homo sapiens
agcccccaaccagaatcaagtcttaatggttaaagagctccatcacccaaaaaggattgagggcctaccttcaactgaacagctaatgcataatctcagaaactgtgagtcaaaattccctggaataactccactttatccccaatctccttgccacctagaccaaggtccattcaccaccctgtccccagcactgactgcactgctgtggccacactaaagcttggctcaagacggaggaggagtgaggaagctgctgcaccaatatggctggttgaggccgcccaaggtcctagaaggaggaagtgggtaaatgccatatccaaaaagatacagaagcctcaggttttatcgggggcagcagcttccttctccttccccgacctgtggccaagtcacaaagcaccacagctgtacagccagatgggggaagggaggagattagaactgtaggctagagtagacaagtatggaccagttcacaatcacgctatcccaagcagaaagtgatggtggcttggactagcacggtggtagtagagatggggtaaagattcaagagacatcattgataggcagaaccaataggacatggtaataaactattctcaggaaaggggaggagtcatggctttcagccatgagcatccaccctctgggtggcctcacccacttcctggcaattctagccaccatgagtccaggggctatagccctttgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggag

SEQ ID NO: 86614 - DNA, 1981 bp, Homo sapiens
ctgtcaagtttagataatcccctcctccctctgcttttttcctctgctcttcccttctgtaaattttaaaacattttcctcccctctggccagtgggttgtcaccagagcacttgctgtgggcccatctggtcttgccttctcagcgccacagggaaggccaagctgttctagtggtggaagtgccaccattttggggtagtatctttgaccatctttggtgacgttacgttatcccaggtgaggtggaaagcgtctcacctggaacctgatataactcaggctgcaattccatccagttcccacatcaacggagccacacatttggcactgttatcttggtatccctcatcccagaagaggcatctccatatcccagaaaagaagatcctatcatgaataaaagctgtatggcccagagaggagctcatgtgtctaaagtgaagggtatattttcttctgttgtgttgatgtttccttcttaatttataggatttttttaatgtaaaaaattgcactgaactctataaacgtaaatgctgctttttgtagctcatataaaaaaggttccatatttgtagtatactgcaataatattttttacatccagctctttaagtgatcctcgttctggtggctttgtgtaaatatgtttgccctagttgaattaagaaactctaaaggttataaaatgaaaacaaaaaataaaatatttgttttctgctagatgcaaaactgactaagcatgtatattttaccaaacttatgtattttttgaagttatgaactataaaatgttaaaacattttttgctgggacaaaatgttaagtaatttgcagtatgtagtgcccccagtattgggatttttgagctaatgggcagcagtcagctgggggcttctgagggatgctcatctttaacagtctccctcatgtacttttgctgttttacacagagaaacaggtagaccccacagaggagaaggaggggattcaacagctttattgtctggaagcagtgagatttggtgattgtctggggggattcctgggtttccctgggtaccttgttccaggcagtcagtccatttgccttcctagtacttagccccctctgacaattttttttttaatgtgccttttgggttggtagaaacggaagtagaagtaggctggaggatgagttgggacagtcttccttttgttgggaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaac

SEQ ID NO: 86615 - DNA, 3756 bp, Homo sapiens
acctacctataatgaatgataggatataagagattagtattttataaggtttatgaaatgtactcctaaacctgctttttgttttttatttttctaaatcatcatgtagtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacccgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcact

SEQ ID NO: 86616 - DNA, 2078 bp, Homo sapiens
tttgggaggccgaggcaggtagatcacttgagaccaggagtttgagaccaccctggccaacatggtgaaacctcgtctctactaaaaatataaaaattagccaagcataggggttcacgcctgtaatcccagctacttgggaggctaacgcatgagaatctcttaaacctgggaggcggaggctgcagtgagccaagattgtgccactgcactccagcctgggcaacagagtgagactccatctcaaaaaaaaaaaaaaaaatcttaattatgggcactaacagttttgccagctgttcattacttgaacttcccccataataagggctaatggaaacaggactgctttttaataccataatggtcttttccaaagttctggaaccatttttctggaagaaatacaggtagttccatttttctaggtgggattactgtgtcagtctgtgtgtatgtacacatatatatgttgtacaggtgcttcccttctccctagcccttttagagttgatggctttgtccctgattgttcagtataatagtttacagattcactaagagagctcgtgtagtaatgcttgctttattttttttttctcttccactcttgttttattttttacttttttttctttgtgatgtgacattttcagctgatgtattgaaagcaaatccttctaatttgggagcccagatcacaagagtgagtttttctactagtgtctttagctgtatatctttttttgtgtgtgtctttttacccttcccccctcccaatttaaaaagattcaaaacacatttcataaatattaggtaagaaaattcctctgtctgttgaacatcatgcctttctacaaagcaatgtccactttatactgggtcaaattccttttcccaatgctgttgtaaaagcataggttaatgtatatgtttcgttttgtttgtttcttgttattatctaatgtcttgaaaataattttagttctgtcttcattgcagatagatatgtctgggttctgtcaccagtgtgtcataacactgttcttttttggttgtagtttgttttgttttattttaaggaaaattatacagtagcttctgaaaataaaagacccattctgttacctggattttaagtaataaaatctttgacttatctctgctctccctcctcatcccctggatattcctctcagggccatgaaggaatgcaaagcctcacatactactttcagcaggctgaccagataaaagtggtcagactggtgagctctaaacatgctagcgctggaagacctgtcttgggtttatttaatagttataggaaacctctactcatgctgaaagaaaaaaaaaccacctttttatggtgaaataaaagtatgctttctatttgttctaatttaaataaccccccccccccatgtaagctgtacattgcttttcaagatcttacacctgggtaattttctgtactagcctaacccctttctgttctctttggcttgtgttattacaatttatctcatgttatgtttgtctagttttgcatcctggaggagcaggtgattaaatagtccctttctttcctcccagtgttctaaaatttgcttgttgcatttgagatcattttattttgcctaataaagcaaatgatatgctgtcctaattagaaatgcagatactgcaagtgctatacccaaagtaatcagccattgtgttttcaattgccataagagaatatgataatgtgttcaacactaataccatgactgttggttgagggtcatgtcctaaaggctttgctttctgattcccaagttactgtaaatcatccaccctctgtatctttctttcttttaacccagagattaaaagatctgaagcagagagagtttgctcgaaatgtctcttcaagatcccgcaaggatgagaaaaaacaggaaaaagcccttcggcggctccatgagttggcagagcaaagaaaacaagctgaatggtgaggatattttttatcagagggttgtacagataattataatccttaaaattttaaattatagatttcagattataat

SEQ ID NO: 86617 - DNA, 1046 bp, Homo sapiens
tgttggcttagtgtaagttacagacaaatttgatactacagatttttctatccctacgtccttgcctccttaattattttgcatatctttaaaaaatttgtctgctgatggatatgacagtagaatcattttctttagcatttcaagaggcctaaaattcaaactccaaagaatattgtttcccaaaagtaaattaattaatagcagcaccacctttatagtcaatcctccttccctccctcccttcctcccttcctttcttcctctttttcttttcttctctctctctctttctctctttttggctgcttcctttgtaccttgttacctactcaggatttttcttccaatcttagcctcttgtttgtgccactaaaggtcctcctagtacataaactagagaggtcacaaattatctcatagatatattttatctggccttcacattattagtttttccctttttaatttcagttgattcccaaattttaaaaattcaattttacataatttaggctttggcttatcttgaaaaattaaaattatcagacaacattgggcctacatttcaacataacagttgactaaagctgaacagttgccatctctttgctcattctgcaactagctgtgatctccacttcatcttttctcttacaccaatctgtgtgactcattatgttacctgccaaactcctgtaaacatttgaatttgtgactcaggcctatgcttttccttccttcccacacaggttcccgtggcttctgactgatactggggaactggcacattgaaaagctgcctccttgctaatagtgttgggaccaacttccttgcgatttcagtctctggtagtctgatccagattatcaaaatctggtactgtaaagcatcttcagaaattctttaggccaagcgtggtggctcatacctgtaatcccagcactttaggagactcaggcgggcagatcacttgagcccaaaagttcgagaccagtctgggcaacatggcaaaacccggtctctacaaaaaatgcccccaaaa

SEQ ID NO: 86618 - DNA, 1027 bp, Homo sapiens
tatatcccttatccaaaatgcttgagaccaaaggtgtttcagatttcagattttttgggggttttggaatatttgcattatacttatcagttgagcatccttagtccttttaaacatttgtttatttgaagacaattgttagtatgacgacacacagattacccaccaaagtaccacttgtgtttcatccagcttttactggtaccactaaatattatgaaaagcccttttttgtcttctcagatagactgttttctctataacattcacttaaagttttaccaagttcattttttgtttctttgtatttcatgggtcttgaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcaggtgagttgtagttacttgctaacagaagaaggtacctatctattgttacaacaattggattttatgagtataccccccaaaacttggtgtctatgatttcttgtgtctgccaatctttatctgcagtcatccaacacactttgttttttcagtggcagaaatcctgacatagacaccacctccagcccacactcccacatatacactatttgacaaattgtgttttgtaaatcttatataatgtttttgccttttattgatttctaagtttttatttaattttgtaattcagctgagggtcactgggagctttgtttccatttctgctcttaacgcgttaaactttgaagagttattcagcagactgttattttcaagttccctacataagatttcatgctttattggctaccattttctattattaagtcattttgctattcaatataccttggaagttagataaattttgagaaggaaaataaaattagatgctatcttaactttaacaaaaaactctgttgctgcatgttgaagagctgataaatgaattacactt

SEQ ID NO: 86619 - DNA, 2493 bp, Homo sapiens
accctcgcagccagtgttaaatccactctaggaaatgggactttagagcaccagattaaaaggaaaactattcttttctctaagggcaactaattgtttctttttatttaaacttttcacagccccattaaattgtaaagcatctcctagtctatgaggaacatcaaaaaaaattgtaaagcatcttttgaaaacaaattcaacatactgagttgtaattataaagttttactgcatcatgtttaaaaatgtactttttctatttaaccatgccagttgagatttttttttttaaactaggttaaaaagttgtgtaggaggatatcagtgggcagagtaaagtgatacttgatgggaagttatttggggatcttaaaaggaatttttaaagttttacaatttaaacctcctgatgccattgcttaaaagtgctttgcattacttattaatgtaattttgccatagtaatttgaaattaatcccaactggacgtcagccaaggtggttaattgggtttaaactaggaaaggaaggtcttgagtgtaagctgtgagaatggcttgtgtttggttcactgtagctttctggtctctgcactccaaggcaagatctctaaccacccaaaacccaatgtgtaaaatgagctgttggtttggctttgcaccttaccttgattatgtgttcctgttacagggagaacagatcccattccaatcgttgtcaagtatgatgtcatgggcatgggtcgcatggaaatggaggtaaattgatctcattaactcataagttttgtgagatattttgaaataatactaattccaaattcagatgtctgtgcaagaatacatttatcagatgaaatgtagttttaatatttttctttggatgactaaaaaatatattttacattttcatttagtgctacttttgagacaaatagaatataaacagagctgctgttttaactggcacataaagaagttaagtgatttgccgagggttatacagcaaggcaatatcagacttagatccagaccttggtacttgcttcagtaggcagtgttgctcagctcttaaaatgttgctgtgataaaagctttgcctttgtagaattgggtacggctgtcacctgtaatacctgcttttcattgcctaaaatattttcttcattgactcctaattcctttttttttttttttttttttttttgagatggagtttcgctcttgttgcccaggctagagtgcaatggcgcagtctcggctcactgcaacctccgtctcccgggttcaagggattctcctgtctcctgtctcagccttctaagtagctgggattacaggcgcatgacaccatgcccgggtaatttttgtgtttttagtagaaacagggtttcatcatattggtcaggctggtcttgaactcttgacctcaggtgacccgcccgcctcggcctcccacagtgctgggattacaggtgtgagccactgtgcccagcctcaattttcaaagaattaggagtcgctgggcgcagtggctcacgcctgtaatcccagcactgtgggaggccgagacaagcagatcacctgaggtgaggagttcaagatcagcctggccaacatgatgaaactccatctctactgaaaatacaaaaaaaattagcagggcattgtggcgggcacctgtaatcccagctactcaggaggctgaggcaggagaatcacttgaactcgggaggcagaggttgcagtgagcggagatcatgccattaaaccccagcctgagcaacaagagtgaaactccatctcaaaaaaaaaaaaaaaaaaaggaaagaaagaaaagaaaattaacattgaagtgaagtctactttcaacaaatgtgccttttggaaactaccagcctgaaagtaacaaactattttgcatgtgattttctctgtgaggtgacaataaagcaagcagtagctaagcaaaattacaatttttttttgttttcagataatactgtagttgtgcaaataactttttcatagctaatcttgggggtactttaggaattaaatctaatcatatctatttttgtcaagcttgattatgctgaagatgctaccgaacggcgccgtgtcctagaagtagaaaaagaagacacagaagagctgagacaaaagtacaaggtatttaaacaaagctattcattgggagatggggaggtgctcactgaataagaaagaactcaaattttgttgaaaatcatcactgttgctaacagcatttgtttgacatttggtggtaattagtagtagatctcagatttctattacattcctatttattggctctgtataaactatagagataataatacctacttctaaagtgtgttagaaagattacatgaattagtgtttgaaaacacaatgcctgttacatagtaggtattcaagtagtggtagcagtaaaaattgttaaaagtcctttgaggccagacacaat

SEQ ID NO: 86620 - DNA, 1880 bp, Homo sapiens
attgcactccagcctgggcaacaagagcgaaactccatctcaaaaaaaaaaaaaaaaagttgagttttctagagaatacatattagcagacactcttgctacctaccttttgaggtcatcactacaaattggtattcagatattgtaagtgatgttctttaggattatcattgatagcaactgaataaactgagggggttttttgttttgttttgttttgttttttaatgctgcagcctcttcctgtatgtagtgtttggtgtcttttcccactgggatctttccttggtctatagcctctttaataatgttaagaaattactacttggcccaggcaataatgtcaccttcaagattgctttgaaagtcatactgtttattttctgtgagttaactctgagtggagtaattttaaatgtgacagctcttgtgatgtcggtttctctagagctgtccttcaaagattggttttgttgtgtgctgaaagaaggatattggccagcctgggaagtctcggttaacaggaagcaaagttctgaggagagccacttaaagagttgtattcattcataacagaattcaaatgcacaaagttctccaagcactgaagatctaagattattttctagactgcttaattgttttatatatatatttctagagaagtcttgcggacatctcacccatactccaagcctcctagagttcttttggtgaagtaaatgacttgattactgtccagttagttgatctgatagagtcttagatgtcatttcttttaaaagtcctaccttgggccctgaatactgatttacgagaatgaatagttaaatgaaagattggaaactagagctagttctcttactttaaactgacaccctaccccctgccttattgaagagggtgttgttcatgttctcaagtagcagtacaaaaatctcacaccttggtctgaccagtatgaaaacagctgctgtagcacaaaatgtccttcctctgtccccggctgagattgggggagggacaaagcccaactgttaactttaccccatcctgtctgcctgctagaaggcctgtttcctaccctaatggtttctgcctaacaaatggtatttcttttttacagcattatgatcctggacttgttgtggtgatggtaatcttagcagtggtaattttttattttcagactgaattactccttttgtcatcagtgcaccaatatgttaggcttactttctctgttgtagccttcatccttctgcttggtctttttcattttcctttcctttccttatgcaacttgtctgatccttgttcattaaagggtaatgttaagaagggatgtatctgtttgtgttagaactgccaataaaatcagttaaaacattaaattctaatactgtcaaaaacttgatttccccacaatgtaatgggcactagcacttgctactgcaatttataaataaattaaaacaaactttgactgccttagaaggcaaaagtactaatgcagagtttataaacaggggtttacagaggtaatgaatttgtaccaaaactttcttgattcttgcaaaacgaattctgacagatcaaaaaagataccaaaataaattgctttgacatttctttttaattcattcattggactatttgtttttaccagtaaatccctgactgagacgttatgaaagtgatattgcacctaggaagtcatttttataacctgtctttaatttggtccttttgctaaagattgcagtcactgcttatttattataccattgggcatagggtagtaatgcattttcattttgctttactggcagtcctttgattgtatctaaaagaaggctgtattctagaagttgttgttt

SEQ ID NO: 86621 - DNA, 1072 bp, Homo sapiens
ctgtctctataaataaataagcaagacctgtctcaatcaatcactataaatattttactgatttcttaagaaaaatcattttttgtctgggcgctatggctcacgcctgtaatcccagcactttgggaggccgaggcaggtggatcacctaagttcaggagttcgagactagcctggctaacatggcgaaaccccacctctactaaaaatacaaaattagcggggcatggtggcgagtgcctgtaatcccagctactcgggaggctgaggcaggagaattgcttgaacccaggaggcggaggttgcagtgagctgagttcatgccaatgcactccagcctgggtgacaagagcgaaactctgtcaagaaaaatcattttttgagaaaatattttcattaatattatagtgacatagatacatttttctgaagtctttacagaagctaagttgtctttctatcttactttcccttttcaattcatgttttcctttataaaaaggaaataatgcttaatatttattatgtgccaaatattgatctagagtctggatgttttgcatggtctcatttaatgaaatagatattaatatgctcatttaattttattttttttaattttttttttttgagatagagtttcactcttgttgcccaggctgtagtgcaatgacgcgatctcggctcaccgcaacctctacctcctggttcaagcgattctcctgcctcagcctcccgagtagctgggattacaggcatgtgccaccacgcctggctaatcttgtatttttagtagagatggggtttctccatgttggtcaggctggtctcgaactcccgaactcaggtgatctgcccacctcggcctcccacagtgctgggattacaggcgtgagccaccatgcccggccactcattttataaatggaaagttttggaaagatgatacagctaccgagggtctgccattcaaatataagcctaactttgaaatcaatatttataccttttcccttcttaggaaaagctgatactgaaaataggaataggttggtgggggaatagcaaatat

SEQ ID NO: 86622 - DNA, 1347 bp, Homo sapiens
acataatttaacctagaatatatccacatttattgcatattgaggcaatttatgacagatttctttgaccatactaaacctttgatataaataaccattcaaaaaagccctgtcactctagtgtaaacagtaggcatcgcatgtgatttctgggcttatgcttttgtaagttcttcacattgactagttcattgtcaactttccttttgatttgagtttaggactcttaacatatctcacatgcaaccatccactaaaattttaagcctggtccttttgggcttttttgtcaaagctttaaaaattattttgacccatgcaaggcttttgccaacaaaagttgcagttcttggtgctccagtgctgatgtcttgttactgaatagattggagaatagggcatgcagactctggaatgaagttatctgtggcaggatattaaattgtactttgtaaactgagtttatttttgtacccattttcttattcacatttcattctcctttagtatttgttaaaatatttcagaaattttaaaaaagttattatatatggccgataattattagtattaaaaaataaaagacctgaagaaaagataatgttgacaagatatctgaaggaaacaacacaaaaaaagcactactgatgagaaatattatgaacaattgtttattatagaaacagaggatatgtttaattcagaataaagcaagagtgaatgatagttgtattttgtagcatttagactggattcagttctggaaattgttttataaccttttgtcagctttgaaatggaatgtagttcaaaatttttatttttctgtgaaatacatttagtcaataggtgtagcccagaaatggtgcctgaagtttctttgttacattgtgtaagtactatttgatgatttggctgattctttggtgacagacaaaagtttagctcctaggaaaaatgaatggggtctgatattatttcctatctcaccctgtttagaaggttcgatgagtacatttagacaaccaacacatatttactgacctaacactacattcttgttataccagcagtaaataccctaagacatggagagtagataagacatggttcctgactttcaggtttatttcccagtccctcaagtcttgcttttttttttaactgctgtagacctttgaagtttccttgaagccaaggatgatgttttctacttttgtgcactcctttcatacttaaattaagtatgtgatcagtctgaatatttaattaaaaaattgtttcaacccccttgtgagtaggaagtctcactaatttttgtgtaaaagtacttggtgcagggtgtaa

SEQ ID NO: 86623 - DNA, 2363 bp, Homo sapiens
ccagacagtttaatgtgcaatatttggttttaatgcagaaatttgtggtttcgtcagctttataaattgatttcaggaaatatgggattttcaaatgatttacctttgttttctgctaacattacttatattgtgacttttaatcttttctggattaatactataaattacattttaatacatatagaatactttgtgtttagaatttttcagtgttgtccattgggtgaatatgatcattttttctgatacagttagtgcttattttagccttgtcttggtacttcacaataactgtaaaaagcaaagaattggacaaagaaagggctgcagatgtttccaataccttgaccccttaaacgaaagctgacatttaattgttgtttgtagcatttttttcatgcagtttacattgaaataccttttcgaatgtgctcctgggaagatgagacattatgtatgttggtttctacccctacatgcactaatggttctttactgttaacttattgctaggcctgtttcattctaacatcttagcatttttgttagactacatgttgaaatgcatcactcagtctgtgcttgagctcattttatttttctgtttaatcaacttaatttcttgttttactaacctcactgttttttcagtttaatattggctgcatgctagttaaatatttatattatatatattatttttttaaaccaatcaagtctagcctggattttgctctgattgttttttcatttctagtggtggggcagtcttacacttataacttactttgtatcatgaaagcctgacacataaacaaaacaactaaacacagtgtagattttctttaaaaaaaaaaaaatcttaaagtggtgctgtttaggtggtggatatgactgtataagtaccttgattttatgctttttagtgttattttaaaacttcataaatgtattcttccccttttccctttccccttttactccatttaaaaatgttatatacaaaagttgcccaacacaccatcagaaaggacccttaccccatatgttcttcccatgtaaaatactagccagcttttctttttacattaatgtccctcttattgggcacatttaccctattattagcacctttttgcatgcatatatgtagaagtatctcttgctcatcatctgtttaaatgtctctaggaagggaagaatatattattggaatatttttggtttgtctctctgttctgtctgtcaggataatattggacaccgcttactccagaaacatgggtggaagctgggccagggattgggaaaatctcttcagggtaagtgtttacatttaccagagaaaaaggaagaaaaccatttctgatgcagatcttgtacctgaatgtatttgttgtgtttttaaaaaagtacttgggtttctccctactacctttttccccttagagtagtctgtttgtcctataactgtattttaagtcactgttaagcctctatatttgccagtaatttgcaagagtaagctgctgtgtcatcgaaactttcaagtcaaacatactgtgtgtggctcagcctgttttaaattttttttttggtggaggtgatgggtgagtggagtaaaaggaatgcaaaatatcagagtatgctttctttgtgctatttagtaatgtattctggcttcagtattataaagagaatcattcagtagcagaatttaatttttattcttttaaattctccctgaagctggtgattgccctggctcttttgctctgcaataagaaatttatgtagtggtagagaagaaaaattaacctccatgaaacataaaatgaaagcagaggtttttgagggctctctgagcagagaggttatttctcaggttcctatcaaggtctggaaaatgtatggcttaaagtttccattgcatttgttactctgtttataccagtcatttgtattaaaaacaaaatactaatatttcagcttctgagttctccctagttggaaaccaaccaactgcgttctctttttagctttctcagattcaagagctactgtttgttctttgcagatgtgatatgaatgctacctcagaaattatgggaattggccgggcgcggtggctcacgcctgtaatcccagcactttgggaggccgaggcaggtggatcatgaggtcaggaattcaagaccagcctggccaactggtgaaaccccatctctactaaaaatacataaattagccaggcgtggtggcacatgcctgtagtcccagcttgggagcctgaggcagagaattgtttgaacctggaaggcggaggttgcagtgagccaagatcgtgcacctgtactcca

SEQ ID NO: 86624 - DNA, 1714 bp, Homo sapiens
tggagattgtagtgagctgagattgccgttacactccagcctgagctacagagtgagactccgtctcaaaaaaaaaaaaaaaatcctggaataattggaataatttgcaaaaattacagtcgttaacagagagaatagattgcttgtttcccaaagactggttattgagtttcttgttctttcacagagatagttttgatcatttcagaggtagacaagtctggtttgttttactttgttataaattattttggtgtgcctccttgtgttagccgtcatccttaagcctattggatttttgacgagtgtttataaaacctttttttcttttactgataggaagggagaccatactgaatactagcccttcctgcagagtcacagagctgccttttttcctccaaaagcaggtagtttgaaatgataggaaaggtccagtttttctgtgttggtcattcatttaccctaggaggttggtgaggggaggagagattctgggagatgtgtctattgtttctattgcctttgttatgattggaaggacttagagtggcaagttaaatattttattatagtccctgagaaagtggatttaattaaagaacagttttaacctaaagttttagaagagaaatgccactaccattttctatcaatgatttttttctgagaaggtgacagccatcctcttgagtggttttgtaaaagtggtgctaatgtgtataaccttaattttttcttttttttctccctctccctttaacatttgcttttcctttcactgttgtcagtcacaacacgctgctcttgaatctctcagctggtcttgactcgtgaatttacttatgctttcactctttaataaatacattacttgcaagcagtgaattgaaaacaagacaaaaaaaaaaacgaccattagtgattggacagtttcttactttgtgttacatttaactgttcttttgacagcccagtttttaaagccaggttcgtatggaaatgctttcactccacttgcactgcttttggaaatagcatactgcttcatctgtctgtttatttgagtgcattcataatataacacaatcagcataatgtctcatctccacttagccaaagattgagttttctttaaaaaagaaacaacaacaacaacaacaaaatggagggggggggagcaacaatttttgtcagcattgtttaatgcctaaatcttggtgccaaatatagttatgagtctgttaagagattaaacaattatctgataaaccatatactcttaaagtcattctgctatccttgtccttcctagaattattcagttgtaggaattatgatatgaaataaggattttctgcacaggtaagtttgttttcatagtagtaaaataagggcctgtttacctttttgttttctgctaacattacttatattgagacttttaatcttttctgttttagggggtaataaagttataaatagtcagacactgaacactgggtaagggaatgtttttcctggcagttcagttaggaggggggaagggaagaagccccagcagccagtagtgttatattatatttttgtgatgtgtagtaatgtggaagtcagtgcttgggatcagtagtgtttctaattctttcaaatggtatagagcaaaaataacttgcagcacacttttgtgcaccataatgattttatatgtatattt

SEQ ID NO: 86625 - DNA, 1835 bp, Homo sapiens
aaaagtagccagacgtggtggcacatgcctgtgcatgtgctgggattacccagctactcaggaggctgaggcaggaggattgcttgaacctgggaggcagaggttgcagtgagtcgagatcacgccactgtactccagcctgggtgacagagcgagactccgtctcaaaaaaaaaaaaaaaaaaaagcgctgggtgcagtggctcacacctataatcccagcactttgggaggccgaggtgggtggatcacagggtcaggagatagaccattctggctaacacggtgaaaccccatgtctactaaaaatacaaaacttagccgggtgtggtggcacacgcctgtagtcccagctactcaggaggctgaggcaggagaatcgcttgaacccaagatcgtgccactgcactccagcctgggtgacagagcgagactcgatctccaaaaacaaacaaacaaaaaaagatgagggatcagatgggagaatgactttaagctatatagaaggcagaatgcatgcatcatagacttaaaacatgttgttactgttgtggttggaagtgcaactacccatcagccgctagtcggtccttgctctacctgactgattaaaattctttctttatggttgtcaggatgacctaataggtttaaaaatgtagtgtaagcttcaaactccagttgctgatgtttagtttgcgcatcttaaggatttggaagtatatgtataattgggttttgtgatgttgcatatctgtctagatctgtggactccactagttccaaactgtaattctttataagactgctgatttgacatttagcagtgaccatatgtggactgcactagaaataatgtgcttcttggagctgaatggtgtagcattactatatggcttttctctctagtcttcattgtgtcatctgtagtgagctatagagtttttttgtttcgggaatttttacaacttgtttgcatgggttcacctagtagcattggttcttgcttatagtctttaatacacaatcagcaaagcttacaatccactcaagagacttactattttgtcactgttgaaaatgggctaaatgatgtaaattgaatgtggctgtcaactaaaacaaaattcagtatagaattagtattcatccagtcatggacatacctgtagcatggttttctcttgagacataataggccgtttcctactgtaaaaacttacagccagcttcatacaataaagtaaattttttcctgtgttttggcaggctcccgtcatacatgtgtattggtggtgctgttaccaaaatgatcattgttactatggtggcatacagcttcatggagcagaaagtttctacttggtatttaattaataaaatgttgaggaatggctgaaacagttaataatgaagtatttttacattgctggtattgtgttttcagcatattggtagtttataatacagacttcttgttgtcaaagatcttcccgcttaaaaattatattccttttctcacgtgtttattagagaagaacaaatgataaaaattagcattttaatgatatatttatgtgtagaaatagggggagaaaaaaaggccaactgaggtaatctaggtgaaaaagtttgttttcagtttagctacatggtttaaccagaattagaagaagaacttcatttccaaccaaagaacaggccgcacagccaccattttggggtcttgagcagagagagaaaacaaataggtggtttgtgagaactctgaattatgtagaaaaccagcttttctacataataaataagctttgccttatttattaaagttaggat

SEQ ID NO: 86626 - DNA, 1056 bp, Homo sapiens
tttaatttttttaaataaatgaatgttcagaaatgtatattagtaattacacttctaatgaaaatttacttctgaaagataaatatatgcattatttgtgatgagatagtttaggttgtaggagagaacttcatggcctacattgtattaggtagaagtagggcacaggatctgggagaataaacaaagatgcaagaaaaaataagaaaaaaaaaaagaagtattgacacacaagataagagggatcttatttctgttgcctgatcatttgtgagtaaaattttaagtgtttttctcttttttcaactttttttttttttttttactttttttggtcacagaaaattttaagttttaagagaaactcctacagtgattggcatcaaagtaggtagtgttccctccctcccaccaaacaaaagaagtcccttatcacctgaggaatgcccactaaataataagtaaatatttaattacatggctggctggctatattaagctgttttgtttttaggggaaaatggtgttacttctaacacagaaagagtgctgaattaaaatctttctctgcagcaatatctattgagaggtgctgactgttttgctacagcatgcaactcaaaagtggctgaaaatatgcagctttgggagtctacagatcattgcaggagctaaaggtctagtcatttttttttaaccaaaggtaatctgcagcagctggtaaccgtggaggtctctgcacaggtttgtgccaagaatatgcctgtgtgaagggttattgtgagtataggattaaggtctttttattttgtagtaggctaaatttgatgcaaaccagcaagatgggaaatgagacatgaagatgcaataatgtattatgcttttagtgaacttccgaagcttagatttgttagtgagatattggtatttcaattttattaggtaaatgttgaaaatatatcaaaatccagtatttgtaaagcatttaataatattttttgaagtttaattttcccttatttgcttcaaccaaccagatatctttcaatgagattt

SEQ ID NO: 86627 - DNA, 1190 bp, Homo sapiens
tgcatgccatacagtaatcaattaaagcttgggatgtaatctaatatttaatatgttgggaaatcagtccaaaaaaatctagaaacacattagaatttcaatggaaaaatatctttttggcccataccgatactttgttgaaggtagcaagttaaagtttagcattttgtgaattgaataaaggagtaaaatgtattttgatcctttatagcttcacctttcttgggcaatataattatgtatgaaatgttcctacataagtagaatatgtatggaaatttttttttaaatgttatattaaaaacatttaaggagtaatatgttttatttaccagactgttgtgaaacatggcaagtttggtctctgtagcttaagaaatgtggtttttgtcaaaagctgattatttctatcttttcacactgcttagttttggacactgatgatatcaagcaatagaacaaggagatttatttacctggctcttagttttaaaaaaacttcttaatttttgaacattattttcactttgaaaaacccgttatttttaaataacacagtctattgttaaaatgtctaaacttgtcattattgtcagcagttactatttgtgcttaagtgtacatatttaataaggatttcggtgagttattggtaaaacttgagtggggaaaaaaagtcaaaaagggaatcttaatctttataaccatcatgacaagccccccacttccccttaagaaacactagcttcttcctcaggaaaataagaaggcaatttagagaatacggatattttaactttagcttttattttcaaaactgcaacatagtaaaggatcaacatatatttatgttcctaattaggttggtgttgtgtgtgtttgtatgtgtgtttagatgtttacagaaatttacacaacttggggtgttcgacatttttcttccacagcagttggcccatattagctaagcagccatgatctggtttgtattgcacggtctgcctttttttaatttcttctctagggtttctttctccccacctccctttcttatttctgtctttctggtccagtgaacactgcatatagtaccttctgtcttaatgtgctggcatgatgctagacttaggcatggcagtaattgatgacgcatgtgataatgctgcagagggagaattctcatctgatat

SEQ ID NO: 86628 - DNA, 1034 bp, Homo sapiens
atggggtttctccatgttgcccaggctggtctcaaactcctgagctcaagctatcctcccacctcggcccctcaaagtgttgagattacaggcatgtgccactgtacctggccaagattgccattttctgaaagcgtagcagaagttcatgagatcttaattatgaatcagaaacctatgtaaagttttcatttttgctcttgtgacttagtttctagtattttattaatgaaaatggtttctagcttgaagtagatagattccagttcgtgagttctattaaaattccttccctgaaacaacttggtacttttgcttgtaagtctggcattaattttcttttcatattagcattaccatttagcattaagtgaaagcagattcatggtaattaccaaaggaattacagatgaccaccacaaatactgaaagaagtcattgatttgatattgcagtgaataccagaagatgttgtaataattttccacttataaaaagtgaattgtccatttaactctggaggtctaagcaaatgtgcttaatgcatatcgtattagtcaatgcaaaaagttaaatatgcccaggctgaaagaaggtgtataatgtatggtcgttcttataccaaatgatttctttggaatttaaacaaatatgtttagtattttattcctaatttaggaagaaaaagcaactaaagttgttctgacattgtacacagatgagtagcacgtaactgttatttagtaagccccatagatagtaaggaataaaagttgttagtgagcaaaacaggagtatcctgccatttgctttaattcttcttgtgatagttttgaggtacaataattcctgtgtgcgtgtcactcaagcaaccagaaagtgtctttgtaatacgcatttggtctcatctcatgaagttccagttgtttgttgtcatccttgtgactctttggtaattacattgatttcaaagaggaattctaattcatcttactgtttcatagaattgagacacaaaatagctttacaggttt

SEQ ID NO: 86629 - DNA, 1010 bp, Homo sapiens
atttaagtcacagaagcatattagtgtattttctgtatgtaatatagttggcattgtaattcaggtatgccagatatgacacatggacaagtgttttaaatcgtttttcctatgtctcgctcccgtaatctggaagaaatgccacaagctgtgaaaattaatgtcagtttggcttgggatactgaaatttatacaaaatcattactcttccctgtctcatagtatgataagtgaaaaggattagaatcagggctgtaccagtttcaaaatactgatgctgaattgacatgattgttagcaaatgcaaaatgatattgacattggttaatacattcttaggagatcgagagtgaccaaagtaaagtcagcataagagaagtttccctggaggtgatttgaagggtaaatggtatataatcacttttcaaatgtgggacatatcaaggacatctcaacatcacagagagagacttaagttgtaattaggaaagattggggttgggaagaactgtgatcagaggacttcatgtgatgatgtatattatttgttttcaaagtaggcatgggaggcaggaagaaacagatctggacaaatagagtattatgccgagtattatttcagggctcttacaatacagtcaaaatgatagaaaaacaggtactcctgttgtacctttccctttcttctatacatgtaacacagttctcattagagtactgcaaagggattctttcatcacagtttctcatgtctttatgataaattgtataaccaaagctaaaatttgtgacttaaaaatatttcaagatacatatgtaataagctatcctgattgtgctgcttcataattgagatacatttccatgtgatttctgtctatctgggtacatgataaaaatttttaaaaggacagtctgtttttcttttctttttttcttttttttttggagacagtgtctggctcttttgtccaggctagagtacagttgtgggatcttggctcatgcag

SEQ ID NO: 86630 - DNA, 2272 bp, Homo sapiens
attcctgtctcgttcaccgttgaatcctcagggtgagctgagattcgaagctaagcagtctggctctaaggtcgcgctttcggcccaacattatgctgctatttagtgaagacgatggacttctgcgcacacggggaagcaacagtgagaaaagacacccggaagtgagcaacagcaaaacatccagatttgtccgcacggtgccccctctgacctttccctccggaagctctcgcggctctcgggcgggagtgcgcacgcgcggccaccggggtcgctccgggtcgcgcgcggagcaggggctagagggaagggtcagcctccagggctggcaggcgcctgcgccgcggggctcccgtcaggacgcgcattctcgctccctccctcggctgcgcgcgcccggtgggcgtgggaggaggcggggaaccggggaggggtgggtgtcgcaggagggaaggagcgaaccggagagcgtcgtcctgagaggagtgaaggcggcaaaatggcggaccgcttctcccgcttcaacgaagaccgagactttcaggtaaacacgggcgtcgccgaggatgcggggaaggcgctggtctagcccagaacctccttcatctccggctcccagccctctttccttccagttttgctccgacttgcgaaccagctcgctcttctcccgtctctgctttctcaagaggcctcccggcttgagggaggccgcatctcctcgcacccgcattctcttacccctgaaactcaggccgcggggcttgcggcttccgcctgtttggcatcggatttcggaaccgggcctgagcgccgtgtgaggggctgtgccctccaggtctgcccgatctgtgccggcgaagggctggctcccaggggacaagaggggtggttgggttgggctgagagggcttgggggagagtattgctgaggccaaggcttccgaaccccgggattttgctctcacggatccttttggggtccttctcttttctttcttcactgtgataaatcaattcctttcattgtctgcttttcctcttccttacctgggaaaaggttgccttcgctatcagacgccttattggttagtcatacattgagatttcgcggggcataagtgttgctgttattaggctgttaattgggcttggaaagcagtaagttactggactatgatccgatgtgagcctaacctcaaatcctatctcgaaagatttgtgagaagcgtgatgataataggccgtccacgcatggggtcactagtgccaaaagcttgatttttctttcttcaattgcaaatgttagtatggaaaaatgcccttacgatggcaagctctattgagtaaaaaataaaggccaaattagaataacttgttttttcgctgttgaaaatacctttctgttgaaattgttaccgcggaaatctcgaagactaaaagggatttagtagagattggctatttctaggtaaaatacatccgtagagtctcaaaaaaaaaaaaaaaacactgcattactaccgcatatcctggcaactgcaatttgggtcgggatgaatctcagaactcaagtttttatcccgctgcagatcctactcaaagcagtacgaaagcactctagatgtgtttcagaaggcagtttaaagagtttgaattccctgagatgataggattggtaaataaataggtaaagcagtttaacaattttaactcagcactgttaacagtctagtacatagaacgcttatgagaagttttgcagcagtaagggatctgggggctgttaaaaagccttgtgatcatgcgcctgctgtatagctgcagcacaatacaggagagtctcaggatgttctaaggatataatgcagattcaccaaagtttgaagcagttcatgttagccttttgatccctgagaaatatatatatatacacacatatatatatattagcaagcactataaaatatgagttggctgcaaggtgtatgagctttattgatttttaaattaccggtagagacatactgataactaaagcccgcaaatgcttttcagaggagagaataatctcaaggtgacctaataaaatcgaaaatagataatatggacagttaagttttgagggaagatgactgtcaaccacagaattccagcaggcttagcaaacaggattttcagggcctttaatgaagattttgaaaattgtggatagcagagtgtgaatgctgtttcctgaaaaacattcagggggttagcctgtactttt

SEQ ID NO: 86631 - DNA, 1051 bp, Homo sapiens
tcttggaaaagtcccaacagagatgaagacgtggaaaaaaaaatcggggtcggggtgtgctggtggggagagggcagagatccggtgaggaatggcttccaccccctggcccattcccctgcaggctggaagatctttctcctgtctggcttctcttcttttcaattcgctgcaccaagtgcttccagtggcccaaaaatgctttttgaagtgtgttttgaaacagcccccaccaacatacaccccaccaggagtactgatcctgcctcccttcatgtctaggggaagcattcgcctttgagcacttgtttgcaaatctggggagtttgagacctcctagcatctcttcccttctttccctgcagtctattcactcccgcagccaaaaatctctggcgttcaggttagcagtttctgggttggtttgtgtgggtttttgttgttgtttggggcttatttttttcaaaaagtgataaagacgggtgggttggagggaggggactgatgggctggtgggctttttagttttcctttgagaaaaagactggtttatttaaaatttgtccagaaaaaaatgaaaaaaaaaaaaaaggtggtatctttgctttagaagaagtctctggataggccctttgtggctgtgggggtgggttgagtgtttacattacattctatatcacaagattgataggatgtttaaagcagatgtttcttatcttcccctgagcccctacaaataaagtcaagacttttctttttttgagacggagtcttgctctgtcgcccaggctggagtgcagtggtgcgatcttggctcactgcaacctccactgcagcgtttctcctgcctcagcctcccaagtagctgggactacaggcgcacgccaccactccttgctaatttttgtatttttagtagacacagggtttcaccatattggccaggctggtctcgaactcctgacctcgttatctgcctgcctcggcctcctaaagtgctgggattacaggagtgagccacagtgcctggcctgtcaagacttctcttaag

SEQ ID NO: 86632 - DNA, 1026 bp, Homo sapiens
ctatagataaataattcatctaagaccatgaagtcacatattaggccttagttattgtctcttgggaaagtacagcgaagacattaaaatgcatatttatgtaacatacagcacatttcatgtgacagataattatctggagctaatggtagcttataaagcagagttgaaagggattagagaatggtgacatggggcaagataaatgtttttgaagaccttttctcccttttccactgaagaaataaagtctttaaaacctaagttgtaattaaatatatttatttgttctaggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatatgtactaaaggtcttgaagcaccactacagcaaaaaagggcagagatgtttctttctcaatttaatagatacaatgaaaatgtagattattgtagatacccagagtatgttcatcctaataaggctaagcttaataaatgttcaaattttagtgtccaagatagcaaaaaattagccaatggcacacctgaaacaccaactgtagaagcagacacctacacaaagttatttcaggttaagccagcgaatcagaaaaaaatggaggagacaatccctgatcagcagaatttcacatttccaaaaactacgcc

SEQ ID NO: 86633 - DNA, 1042 bp, Homo sapiens
tcactggctggtccactacgggttttaattggtctttgaaatccaaaagttggcatgagaccagaaaaagaattatcaccatacatcatattaaaataagggtacaaatggcttaagtcatcataagaaagtaagtcataggaatccaacagtggaacaactgaatggccaaatgggtgggtggatcttaggggaaacccatttgaaccaagttgttgaaaacactgattatgccttaaatctcccatcatataattattagaaaagcatgacacttgtgtgcgattcacacggctattgtctccacctctcgttctgtggctattagaatgaccctgtgactccagtagatcttggtatgtattttgtgataagccatctaaatgctttggaccttcctcaggatcataatgtccactctggggcttggcttgaaaattatgtttgtttacattttcaattatcccatacttctgagctgaatagttatcacaaaatccatttggctgctttatttttttatccgtaaccaatttgaagagattttcttctccaggctttgttagtccttctatgtgattgacagattggattctttctgcaccactgtaactaaaatcaaaactagaaaatgctgaagggttttcttggcaatatttctgaaataaattgctatttggggttaagtttgtggatgatagttgggggaaatctgaagaatggttagaaccttttgaagctgcacttaaatgactatttaatttcatcaagttaccttgatttcgataaggaataggagtgttattttttgtttgaacattcatccaagttggtctgtttaaattgatacctcctgaagatgttgctgagtttgataataaattcactgatttaaaatactcagaatgtgggggatcaggtttagcaaactgttgcttttctgtgacgttagcaaaatcattagcgggacaagctgtgtgaggttttagtccatattctgatgttaagccaaaatcagcagtgaatactgcttcctttgcaa

SEQ ID NO: 86634 - DNA, 1009 bp, Homo sapiens
tgttcaaacaaaaaataacactcctattccttatcgaaatcaaggtaacttgatgaaattaaatagtcatttaagtgcagcttcaaaaggttctaaccattcttcagatttcccccaactatcatccacaaacttaaccccaaatagcaatttatttcagaaatattgccaagaaaacccttcagcattttctagttttgattttagttacagtggtgcagaaagaatccaatctgtcaatcacatagaaggactaacaaagcctggagaagaaaatctcttcaaattggttacggataaaaaaataaagcagccaaatggattttgtgataactattcagctcagaagtatgggataattgaaaatgtaaacaaacataattttcaagccaagccccagagtggacattatgatcctgaggaaggtccaaagcatttagatggcttatcacaaaatacataccaagatctactggagtcacagggtcattctaatagccacagaacgagaggtggagacaatagccgtgtgaatcgcacacaagtgtcatgcttttctaataattatatgatgggagatttaaggcataatcagtgttttcaacaacttggttcaaatgggtttcccctaagatccacccacccatttggccattcagttgttccactgttggattcctatgacttactttcttatgatgacttaagccatttgtacccttattttaatatgatgtatggtgataattctttttctggtctcatgccaacttttggatttcaaagaccaattaaaacccgtagtggaccagccagtgaacttcatattcgtctagaagagtgctgtgaacaatggagagcattagaaaaagagagaaaaaaggtaacacaaagttaaccacttaggaataacagtatgttccttttgcctgtcttcattctgtttaccttagtgtagtgtaagagtacttgccttatttctttttgctttatttgttgttgttttaaa

SEQ ID NO: 86635 - DNA, 1009 bp, Homo sapiens
agttggagaccagcctggccaacatggtgaaacccagtctctactaaaaatacaaaaaattagccaggcgtggtggcaggcacctgtaatcccagctacgcgggaggctgaggcaggagaatcgcttgaacccgggaaacggaggttacagtgagccgagactgcaccactgcactccagcctgggcaatagagtgagactccatctgaaaaaaaaaagatagaaaaatactgtggtattgtggtttacatttgttgtcttttgataccaaaacagaattttcatttaaagtggtaatactctatttattaggcttacgaaaactattattcatggtcgaatcatatttagaaaattctacatctaaaaagtatgtaattttttacagactgaattagcccttgccaagaattatcctggaaaaaaagtatccagtactaacaacactccagttccaaggctgacttccaacccatctagagttgatcgcttaattgtggatgaacttcgagaactagccagagtaagctgtaaaaatagataacagtggatggattttttgttaaattttttttaagtttcaggccaggcgtggtggctcactcctgtaatcccaccactttgggaggccgaggcgggcagatcacctgaagtcaggagttcgagaccagcctggccattatggtgaaaccccgtctctactaaaaatacaaaaattagctgggggtggtggcatgcgcctgtagtcccagctacttgggaggctgaggcaggagaatcatttaaacccaggaggcagaggttgcagtgagtgaagatcacgccactgcactccagcctgagtgacagagcgagactctatctcaataaataaataaataaaactctcatcaagttttagagctttgaagggtttttaaatcacatttacatctaactctctgaaatatatttttttcatgtttggtcctagaactataatatttaggaaaggggctgggtgcagtgg

SEQ ID NO: 86636 - DNA, 1039 bp, Homo sapiens
atattttgcgtagttgtgttcattagtttgcttctgtatttttttaaaactattgaaagcttaactttttctgtttctcatcacttagtatctttgtatagaacttgagtaatttattcgttaatatgaaatgttggtattatgtgactcagaagatcttgggttttaacatttctagcatgagttaaactataatgtactgatgaaatttaattgaaatatccttgactagaaacactgatgttttaaatgttagtgtttttcttagttttagaaattctggtattaaaaaaaaaaagagtgtaatcataccacataaattttctttagatgatgtgcagaagaaactgattgagaatgcaagagtaactgtagggagaaacattttgatcactgatatgccttagaactacccaaatgaattacattgagggtagtcaaataaaatagatcatctcaccacagtcactgcatagaaagtggttaagtttaacataagacatgttggatgttataaaaacaaatactgtactgaatttagtctcaggaaaaaaataaattactttgttgaaaacatttggtttcatttttctaaattcatatgtttctaaccttaagagtcactcatatcagaaagtcaaatgaatttcatttaagaacttatactaagttttagatttcattattaacgcacaagtaataatgttggtttataaatcaatgccattcagatatccatggatctaaccagatctccttcaaagatgaaatttttgctctatctttatgctaatccgtgtaaaccagaataaaaattttagggaagcttttacatgatactggtcagaaatgaaataccagtccgttaataagaaccaaacacttaaaaaaattctttgaaatattgttaatcatatcacccaatagataatttttaaattagtcggttgtccctttcagtggcatatcctctaacagatggttcttatgtacttgtatttctgaattacaacctataaaacattgtacttctgaatta

SEQ ID NO: 86637 - DNA, 1042 bp, Homo sapiens
gttaaacatcttatttaactcttttaaggcattttaacagagccaagtacataaacatttagtcagttacattactactctgttcaccaaaactagcctagattctctaatattctgccattgaatgatataagtacttattctagaatgaaatttcattttgatgaaatattttgttttcttatttttttgtttctttggtaaaatattttaaaattcagatttaggtaaatctgaataagagttttattccaaaggacattttaaaacttttgtaatatagctttaggatttctctgttagaccaaggataaacataagggttttttttaaaaaaccaggaatagataaagacgattcaggactcagcaggtggagagaggataagtagaatgaggaaaggcagcagtaggtgtgatctgtgtgacctgtaccctaatcccttaactcacctgtagttctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgc

SEQ ID NO: 86638 - DNA, 1119 bp, Homo sapiens
gagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttccccctttcaagaagggtgattctggggccgactcagggtttaggtgccccctggtgtggcctagatgtccccacctgggccatctttctggggaggactctcccaggtagggaaggccagaggtggcccagtgcctggagggttagggtctctgcctgggatatgcaagaggaagtaggaaagggaggtctcatggatgatcctaggctgctagaagtccttaaggccccatctagtccattccactccctacccccattccagagccgagtagtaagtttacagatgtttcccccattacgtacccccacccatccctgctgcagcgagcctgagagccaggtagagccaggcacagctcctcagtcttctcacacagtcctgccggtggccttccctcatgacccttgcttgggagggtggagcactggctccttgaccctaaaaggtagctggcagggg

SEQ ID NO: 86639 - DNA, 1049 bp, Homo sapiens
agcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaat

SEQ ID NO: 86640 - DNA, 1314 bp, Homo sapiens
agtagagagtgagatgctgtttattctttttttttgagatggagtcttgctctgttcaagcaattctcctgtctcagcctcctgagctgctgggattacaggtgcacaccaccgtgcccgggtaatttttgtatttttgtagagacggagtttcaccatgttgaccaggctggtctttaactcctgacctcaactaatctgcccgccttggcctcccaaagtgctgggattacaggcgtgagccaccctacccaactgagatgctgtttattctaacatttgttccactgtgaaccttgaggttagatttcaagtattcaaagcagtagttcctagagatatcataattagtaattaaattaagatttaatatttgttgattttattttggtatttttccacttttatcagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtca

SEQ ID NO: 86641 - DNA, 1103 bp, Homo sapiens
acatttggccagagctatgcagagttgccagagcttaataatgagcaataattcatcttggaaacttttctgttttgctgtttaatccagtacagatgcaggtgttttctttctgtgactttttgtgagtagttgtatctgtaaatcacctcccatggagacgggtgttcctgtgactgagagccagctgttgggtgttttagctaaacagcttgctcctagttagctgctcaaatccccctgagaggtgtatcggctgcttcagggaatagagcagatggggtgaaggtttttgcaaggcctttagtgacctgctttcaatttgctgcaattcttctgctttggctttttcctataggtgccagagttcatctgcttcatatttttactactgacgcatcttcctgtcgtatattcttagactgtggtgacttaagaatctttgggtcacctgttacatggtttctcctgccacctgtatggggaggagaagactggtattcaaactcaagcctgtttctatcttattctcattgatttttatgatacatagaaaactttgtttctttctgaaaatggcattttagtgattcattgttttctgtgggagaaagcttatgacctgctcttttctttttcccttccagagggaatctggaaaaattgcaatcaaaacatcatttctctaagaaaattttgggtaaccgaagttctggacaacaggtaaagtgtgtttaaactttggtggtgctgacaaatcatctgtaatctgcagaagtaaactgggagagggaggaggacaagttaaaaattaagtctactttgtgtcggggctttattggggatttcccatatattacctcatttaggtggtttttacctggatcctggatgtagatctgggaatctcagaaagaatctgtcctttaaaatgctgttttaaatggatttgctgttgattggatttaatgtcctcacagttcagtttagcaatcattttttaatgtctaccataaataaggtacagaagtataatttgtagattctgttatatagtaaaggggtacaatatttattgcaagaccatttactgggcttctaag

SEQ ID NO: 86642 - DNA, 1036 bp, Homo sapiens
gcctagagaatgagtgacccattacagaaatgaggactaatgttttcaaaatgttccccagactgcactcatctcccaggaattatttgacatttcactgagagtaagaatgggtaacttgtggccgggcgtggtgactcacgcctgtaatcttagcactttgggaggccgaggtgagcagatcacctgaggtcaggtgttggagaccagcctggccaacatggtgaaacgctgtctctcctaaaaatacaaaaattagttgggcgtggtggtgtgtgcctgtagtcccagctactcaggatgctaaggcaggagaattgcttgaacccgggagatggaggctgcagtaagttgagatcgtggtactgcactccagcctgggcgacagagagagactcttgtctcaaaaaaaaaaaaaaaaaaaaaaaaagtaacttggaaggagaggaaagggaagagtatccaagaaaaacttactgactcaataggtaaaaacattggtgatactgccattcattttaggaaactcatggttctttattttagaaagaagattgcagctgggtgcggtggctcacacctgtaatcccagcatttgggaagccgaagggtgaatctcctgaggtcaggagttcgagaccagactggccaacggggcgaaaccccatctctactaaaaattagttggacgtggtggtgtgcgcctgtagtccagctactcgggaggctaaggcaggagaattgcttggacccaggagacggaggctacagtcagctgagattgcggtactgtgctccagcctgggtgacagagactcttgtctcaaagaaaaaaaagagaaagggaggaaaggagaaggaaggaaggttagttgctcgtcacccattttgtgagatgttggagttaagttgataaacacatttacacaaaaagaaatgcaaatagtaaacaagtataagagaagtttggccgggcgtggtggctcacgtctgtaatcccagcactttgggaggccgaggtgggcagaacatgagg

SEQ ID NO: 86643 - DNA, 1341 bp, Homo sapiens
ataagtagatgattttaggcaaataataaagttttttggtttttgggtttttttgagatggagtttcactcttgttgcccaggctggagtgcaatggcacaatctcagctcaccacaacctccccctcctgagttcaagcgattctcctgcctcagcctcctgagtaactaggattacaggcatgcaccatcacgcctggctaatattgtatttttagtagagacagggtttctccatcttggtcaggctggtctcgaactcctgacttcaggtgatccgcccgcctcagcctcccaaagtgctgggattacaggcatgagccaccgtgcctggccttgtgcttttcttttgcagttctgatcctaaagactgggattagggtcacatagaacctgtacataattccatctgtaatgtaattctttactagcgagtggtcaagaaagagtccaaactctagtgcaagactgcctgacttcaaattctggcttcactacttaataagtagatgattttaggcaaataataaagttatttgttttttgtgggttttttttgagacagacttttgctcttgttgcccaggctggagtgcaatggcacgatctcagctcactgcaaccaccgcctcctgggttcaagcaattctgtctcagcctcctgagtagctgggattacaggcatgcaccaccacgcctggctaattttgtatttttagtagaggcaggtttctccatcttggtcaggctggtctcgaactcctgacttcaggtgatccgcccgccttggcctcccaaagtgctgggattacagacgtgaaccactgcgcctggcaggcaaattataaatttttaaacctgatttcctcatctttaaaatgagtttaatattagaatctacctgctgaaataattcaaataatgttcattacatttgatcttcaaaaatcctattaattcggctgggcgcggtagctcacacctgtaatcccagcacgttgggaggccgaggcagagggatcagttaagtcaggagttcgagaccagcctggataacaaggtgaaacctcatctctactaaaaatagaaaaattagccaggcctggtggcgagtgcctgtaatcccagctactcgagaagctgactgaggcaggagaattgcttgaaccccggaggcagaggttgcagtgagctgagacttcgccattgcactccagcctgggcgacagagcgacactctgtctcagaaaaccaaaaacaaaacaaaacaaactgaattatgttttacagaaaaacagtgttaatttgagtctgtttggatataacctatagaaaactctt

SEQ ID NO: 86644 - DNA, 1012 bp, Homo sapiens
aggaggattgcttgagtccaggagttcaagaccaacctgggcaatatgatgagaccctgtctctacaaaaataagaaattttaaaaaaaaggaggaaagaggctaggtacggtggctcacgcctgtaatctcagcactttgggaggccgaggcggggggatcatgaggtcaagagatcaagaccatcctggccaacatggtgaaaccccgtctctactaaaaatacaaaaattagctgggcctggtggcacacacctgtagtcccagctacttgcgagactgagacaggagaatcacttgaacccgggaggcggagtttgcagtgagctgagatcacaccactgcactgaagcctggtgacagagcaacactccgtcttaaaaaaaaaaaaaaaaaaaaaacaggaaagaaatgcatagggtttcagagtaagttttgatgtttttcctctatataaatcggataaacttcacacacccctattcttatcctctaatctctaaactatattcaactcccaatagttatagagattattttcattcacatgtttgtagtatttatcagttttggcttaatttattattacttaactaatgagttataacattccttttgggaacgttcaaattagagctggactctattttaggaattccccttgagtcattcttggacttggaattcctaattgcccatccagagtagatgtttatttggattcaaaattttccttcctgaaattatccattctgtggcttcggttaccatatatattttgaatactgccacatttttatctgtagccagacctctttttttatcctggctgcctgttcaacatctccacagagatactcagaggaggtaatttgaattgtgttgtccaaagtgagctcttcatcttggccccacacctagactttcttcagtgtactctattttattaagtggctctatcacacaatttactgaggctggactctttttttttttttttttttttgagatg

SEQ ID NO: 86645 - DNA, 1062 bp, Homo sapiens
ccccgacctcgatccctgcgtctccggcggcgtgcgggctcgtctgaggcttcccgcatctccccgctggaactcctgcctcccgggggttagaggagggttcgttcgagggctggaagcgggaaagcggggcggaaggactgggctcatcgcctcctgattaactcgttgtctttacttaaaatgacttttcccccactttgtcaaacttgagaactgttttgtgtgtgtgtgtgtttccttaagtctctagcttcaaaattaagagtaggcgctaccgctgtgattgtgggcagttgtgtggttggcggctgcgtttggagctctgagttgaaaagatgtacgtgaatgtatggtttagattttgttcttttttttgcgattgtctgattgggagtacttttcctttgcgaaatgggcgaatttggttttctttttgttcattgagaactggcagtgataccgatttcattatgctcatgcttaattttgttagcatcaagacgatgtgaaatcgagtaagttaagtttgaataagttcaggctgagggtcatcttgtatgcctgataagtctaaatttgttatatgtttgtgtcgtgtatacgttcaagtgaatatatgtgaaagcgctataaaaaatcaaactacataaatgaaagggattttaatttcctgataagcaggaaacagcatatctccagtactttaatatctgtagaaaaatgcgttaataatgtcatttaggaataaaatatttctctccctagagagggtttaggtattattcagagtaaaagagcaaaaaaatttcaacctcagagggtatggaaaaaaacagaaaaatacccttacttccagagctcctgattaaaatattgtgagttgtgggttaagtttactgatttaaaaaaaacttagcatagagttgtatcactgcagttgctttgaatgtcttaagtactgtgtaatgtcagaattaaacacgaactaacttttctgggtagaaggtaaaaagctccaataaacagatcttagttttccccagatttttgtgcccagag

SEQ ID NO: 86646 - DNA, 1086 bp, Homo sapiens
aaacaaaaaagggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaagaaggcatcccattggcagaacccttgtttccagcccagggatgaaggtagccagttggtaattgtgaagaacctgcctggaaagagatggacctggaaaaacaggagcagctcaggaaccagaatgtgttccttagtactcatgtgcaaaatatatgctaaattacatgcaaatcaatgtccaatcattataatctctggcaatttggtaactaatgctgttacactatctggtctaggacatttctggctccctggggccagatcctgctctgtagctcccacaggagaaaccatcacagaccaaaggccagcgggggccccagcactcaaggactgtttctcccaccaccatctgtggacttttccagctgtttttcttggcccaaggatcacacccatagggatgcagatgggggaaggggaagctgagaaagcagtgaagacagaatgagctggggaagaggcagatggtaggaaatggagacggagaaatggcactaatggcccagccacctgagatgggatacctgggagggacatcttttcaagtagaggctgtgttggggcatggtgagagagggtcttagcaggtaaccttcctttcctctccagactgaggaatcagagttctgattgtggagtgcctctctctaggacggggctgcagcataggagtctcagctgcttacatccaggtccaggattatgtctgctaacagacgctggtgggtaccacctgacgacgaagactgtgtgtctgagaagctcctgaggaagac

SEQ ID NO: 86647 - DNA, 1153 bp, Homo sapiens
cccctggacaagagcattgtcatccgccccttggagccacagccagctcctcacctggcccgggaattcatgatcaaaacccgccgtaggaaggtatgtctcccttgggcctgttgccatccctcaaccccccaggactctcagaagcaggatctctctctctttcttttggccccttttcctaagggacacttttccaatgtagagatatgatctgtatactccttaggcaaccaaacctgggccccagtctcgttgggaaaggagagccttatcctcccatgtgatagtaccctaaaggcagggctcctgaaacaccaccacctacattccagccaccactagcctccccactgaacacaggtcttggatagtctccttgcttagtctgcgaccacctcgggctttcttatatttgccccattccctgcagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagagccccagtgagagaggagcatttggcctcctgcttccttctgtggcctctgccgggctccattcccaaggaaaagagaggagcttgggctcacagaaagagaaggggatgaaaccccaaggggccctatctttgggatttacatggaattttattttctacaagtttgaccttagccatggtttgcaagtgaacagaacattctgacctctgtcttgctctgctcctttcatcctcgtctcccctgccccgtctggtgcttacattctgaatatatgtcatctcccaagaggcttcactgcctctgcttccagctgcagcctccttcctgcctgggtccccagggaagccgcctgccttttaattcagtgttcccatgagcgccaaggccccattattgcccccttgctcccactccatgctgcttctgggtggaacctaagatggcttgggagttgttgggttcctgcga

SEQ ID NO: 86648 - DNA, 1398 bp, Homo sapiens
ctccgccttctgggttcaagtgattcccctgcctcaacctgagtagttgtgattacaggcatgtgccagcgcacgccaccacgcccagctaattttttgtattttagtagagatggggtttcaccatgttggccagggtaggctcgatcttctgaccttgtgatccgcccacctcggcctcccaaaatgccgggattacaggggtgagccaccgcgcctggctgtttgtttttaagaggcagtatgttgctgtatcacccagactggagtgcagtggtgtgagccatagctcactgcagcctcaaattcctgggtttcagtgatcctcctgccttggcctctcaaagtgctgggattacaggtctgaaccaccacgcttggcccctgtggctttcactgatgtcacttcctcagctgtccgtcttgttacccttttcttagtaatgcctcttctgctgttctgttagccgtccttaccacccatttccattctgaccaggaacaagatcaccatgattgctgagcctcttgagaagggcctggcagaggacatagagaatgaggtggtccagattacgtggaacaggtgagaacagggctctgacgccagggtcgaaaggaggcagggatgccacagtttaactgccgggtctctaagagcacacatctttctggggagcatttatgtctttgcctttgctcttgttctgggcacagtgggtaggatgaagtgactgtcttccaggaagggagggtctgtggctccaggaccagcaatcacagagctggctgacagctccattgtctcctcccttccccaggaagaagctgggagagttcttccagaccaagtacgattgggatctgctggctgcccgttccatctgggcttttggccctgatgcgactggccccaacattctggtggatgatactctgccctctgaggtacagcagaactgatgggaactgggtggcggtctcttacctctggagtggaagaaactacaaagtgttcttttcccaaaagtatcttgtgtcctctggtgaaggacagtatccccttacaggcacatctgtcttctccctctaaatgcttcagccgttgccagggcgactgctaaggaggcctcatgtttctctataggtggacaaggctcttcttggttcagtgaaggacagcatcgttcaaggtttccagtggggaaccagggagggccccctctgtgatgaatgtaagtccaccagcactcccccaccccagtcctcgagggtccttgcagccaggcatatgagtgggatgggctcaccatctttaggattcggcaggagaagcagcttggggtacacaggaccatcccaagtcctgggccagcttcttcccttttccttccttat

SEQ ID NO: 86649 - DNA, 1050 bp, Homo sapiens
tcctctactgatgtatctaggaaggaggaaggattggtgtcatagaaaacactgggtttcctgggcagcagaccatgttggggcttcagggcagagcttcactcagatgctgtgggttgagaatgacatgggtgcacgccagtgggtctcagcaccagctctgtcagacccatgggggttgttcagtgaatggtggtagatggctgaatggatgctgagagctacctttgaagactagaattaaggccctagtttgataccccacttactcttggctcaggaatctaatttctttactacagtaagttttcttgggctttttggtgatgatttggacagctcttttaacctgctgttgtacttatcacttgtgctgattaaggcagttggggttttcacagaggtagtgtcaagggagcttctgaattcccttaggtaaatggttgcccttccaacaaaattagacctcgcttcagtaatttattttctgtttcccaggtggctgacccagttgtcacgttttgtgagacggtggtggaaacatcctccctcaagtgctttgctgaaacgcctaataagaagtaagctgggagcacagtgtccctgggactgcagcctcctggacactctctctcctttatcttccacctctacccccaccatgagcactatgcacatagagacctctacagctcagaatagggggtgcttacaatacttgagtttcactccagccctctcagcccttctgcctttgaacacaatgacatgggattattcgccttgggtattcccaagaggagtttcataactgccactttgtctctataaaatgactatcttaaaagtttactccaaatcttactcactttttgtttttttgttttttttttttttgacacaggctggagtgcagcctcaactttctgggcttaagcaatcctcccaagcagctaggactatgggcacacaccaggccatctgttaatttttttattttttgttgtccagactggtcttggacttttgggctcaagtgttcctcccatc

SEQ ID NO: 86650 - DNA, 1053 bp, Homo sapiens
tgatggggggtataggacaaggttgtgtgtgtgtgtgtgtgtgcgtatttgtgttccgcagatgtctttatctagacaaaaatacatttcttaatgagtatactttgaattgattttctcgagaagagaaggaaaagtgagttgttactctgatccttgtacactatgagcctgccagtgtacctttccaggtagcaggccaggagggctaaagggctagcttatgtccatgggtatagggtagagtttgacctaaatcattaagatgggaattaaatcattgacttcacacctagtatcaccatgctgagtggtcctggtgtcttgaggacccactcataggcagatgctcctcactgaaccttcttgaagaggctggaacagatgctaagtagtagctgtttctgataggcaacttcttgtctgctctggccttgattttgtttgtgtgtgcctttgctggcataagagaatccaggctgtgactgcctgttgtgtttcaggtggaggagtctggcgagcatgtgatcctgggcactggggagctctacctggactgtgtgatgcatgatttgcggaagatgtactcagagatagacatcaaggtacagcagtatctgccgggagctgggttcacggtccagacttttcacaagtgaccaaatccttgaattcctgggaagctccaagggaagagagagtacatgtgtttgtgaaaaccatgatctgttgctccttatatgggaaggtttttgagaactggtttgcccccttctgctgtgtcatacgtttaaaatcaaggctcagccgtgcttggtggctcactcccagcactttgggaggccgaggtgggaggattgcttgtagccaggaattcaagaccaacctgagcaacaaagtgagacactgcctctacaaaaattaaaataaaaaaaatagccaggccgggcatggtggtccgttgctgtaattgcagcactttgggagactgaggtgagaggattgcttgagcccagtttgagaccaatctgggcaacatagtgaaacctcgtc

SEQ ID NO: 86651 - DNA, 1087 bp, Homo sapiens
ccagtgtgctcatgggggttccctcttatgtggtttattaatgtgttcagaaaacggggtaacttattgaatagagatgcatgcagtgtttctcaaggggagtcaggttgggaattgttttaagtagatgttagatggggtgcttattttgttccacgtaaatgcgtatagccaataaaagttcatagatcgatgtactttaaactttttgtcagctgagttccaaggaaccatgtaccactgatacctgctgcttgctcttttctggcatcagggtgactccaaatcttctagcagcacattcccaggaagcaggctatcactatctatagtgccagagcttttagagctaacaatcagtccccgcactttgagctttttgaccattgtgaatggctcagtaactcctgctcgtgctccctgggaaggcatgtattaatggctttctcttctccatccacaggctttgtggacatgtgtgtgcagcatatcccttctccaaaggtgggcgccaagcccaagattgagcacacctacaccggtggtgtggactccgacctcggcgaggctatgagtgactgtgaccctgatgtaagggcatgtggctccccggttctctggtctttttttccccttcctgtgtggggatactgatttctggtcacaggagtaatgcccactttcccacccttgcctccccatccccatgagcacagtcaggcctgaatgcaaagcctgatgttgccaccgctagtgctatgaccttgggaacattactcacatttcctgagcctcaaggccttggtctataacacgagcataataaaatgtgagcggttgttatgagatttaaataagattaaggaagtgttacggttgtgttcagcatgttgcctggcagatactaaagattcaacaaatggtagctaatcttgtcagtcctggcttttaaaaacatctttcccagccatttcttaggctgtctagtttcttatcataaatacacagccagttgagaattgagttacatcttaagaggaaatttgggacagtaagtaatcttgccaatagtgcctctctgctatct

SEQ ID NO: 86652 - DNA, 1604 bp, Homo sapiens
ttgagacggagtctcactctgtcgcccagcaggctggagtgcagtggtgcgatcttggctcactgcaagctctgcctcccgggttcacgccattctcctgcctcagcctcccaagtagctgggactacaggtgcctgccaccacgcccagctcatctttttgtatttttagtcgagacagggtttcaccgtgttagccaggatggtctcgatctcctgacctcgtgattcgcccacctcagcctcccaaagtgctggaattacaggcatgagccactgtgcccggccagtggggattagtatttagaaacaaaggtttggatgtgctcattgctactggggtacattgcttctaggccctctcactgagcacagctaggttatatacactcatacatatctataactatttctacacacatatattaaaaatcatgcattaatcctaatacccccaattccatttcagcaccactggctcttcccagccttcttagttccttctttagcactgagaaacctggctcccaacatcattgttcatgggtttattcatttctcaatcctgcaaggtgccctcttaaagttcctgtgtctatcttcgggcaggatgctctctgcttccacccagtaatatttcccgaggtctttttttctccccaggcttcatggtttgaaatagtgccttctttggttctgctttgaactttctgccctccttgttcttcttaccaccttctgagccttgtttttctcaggtgatgctgaacacagagcggctgatcaagcatgcggtgcaggagaggctggcagtcactgtgtgcatcaacaagattgaccggctgatcctggagctgaagctgcctccaactgatgcttattacaagctgcgccacattgtggatgaggtcaatggattaataaggtagaaaacccctgggagtggatttcctgtcctcggaggctctgggttttaaccctgaatacctctgggaacaactgtgatttatttctaagcgtgtgttgatgagtttgttgggcaaaactagaggcacatcctgggactctgcaggggttgacttcatactttaacacatcttcattttactattatgatcagtacttgggctgtattaatttcttctctttttagagataggatctctgttacccaagctagagtgcagtgtcacaatcacagctcactgcagcctcgaacttctgggctcaagcaatcctcccacctcagtctcctgatagctgggaccacaggcatgtgccaccatacctggctatatattttttaaattaattaatttatttttttttgagacggagtctcgctctgtcgcccaggctggagtgcagtggcatgatctcggctcactgcaagctccgcctcccgggttcatgccattctcctgcctcagcctctcaagtagccgggactacaggcacccgtcaccacgcccggctaattttttgtatttttagtagagacagggtttcactgtgttagccaggttggtcttgaccttctgagctcgtgatccgcccacctcggcctcccaaagtgctgggattacaggcgtgaaccaccacccc

SEQ ID NO: 86653 - DNA, 1416 bp, Homo sapiens
aaaaagacaaaatcacaaccaaaaagaaaaacccagccatgtgtggtggctcacgcctgtaatcccagcactttgggaggctgagccggggggatcacatgaggtcaggagttcgagaccagcctgaccaacatgatgaaaccctgtgtctaccgaaaatacaaaattagctgagcatggtggcgcacgtctgcaatccctgctacttgggaggctgaggcaggagaatctcttaaaccctggaggcaaaggaggttgcagtaagctgagatcgcgccattgcactccagcctgggctacaagagcaaaactctgtctccaaaaaagtaaaaataaaaaaatccctccacacacccaggagcatttccagctgggagggcactggtctcattgtctgtaattgctgtggggacaccctgctctctctctctctttaatctcaaagaaacccttgagctgggaggtagtgagggaaagtgattgatggttcgtttgtgggagagcagtctcaactcaggtggtaacaacagttaattttttttcagctgtgctatactgacatcctcttcacagagcaagaggtaagcatgccttggggaatctgattgtcacctacaccagacccaccagtaatagttttgtagggaatgtagaggagcctttatgatagcattttagttcatatcctactcctctctctccacttctcacatcccatctccttcttcccccagttactccagggttataacttgaaaaagaactgggtaggcaagctgtaggttaggaggggaaccctcctgttcttgactagattaaatttggcctaatataggagaagtactaagaggcgatgtctgcatttgtgctataagttacgcagaagctcaacatgatttttttaaaatgacatcatcctttaaaaatccgcaggatgagtccatccatatgatgacctctttctaggagtagcttctctttgaaaatgggttcctatatctttgtgtttctctttttgtctttccttccggatctttctctctaatctctgaccccttctgtttccctcctcttatttctgtctctttttcctaatggaagttttaagtataataagtatggttaactaaaggcacttggaattagtaaagatagataggcaatcaatgttagctgttattattttataatgtatttatgtatttgtttggagttttaaaaaaaatgtttatttctgtcatagcttttatatttcttttttaaaaaaaaactaaaataccccagattgtttctttttactttcaaggtgctcagctattgtttttgtttctaatgtataaagaggatgagattctaggaccctggattctctgataaggcttaatactgttttgtttgcagtaattcattttcatc

SEQ ID NO: 86654 - DNA, 1626 bp, Homo sapiens
aaaccccgtctctgctgaaaatgcaaaaattagctggtcgtggtggcctcggcctcccaaagtgttgggattacaggcgtgagcctctgctcccggcctaatttttgtatttttagtagagacagggttttaccatgttggccaggctggtcttgaactcctgacctcaggtaatccacccacctcggcctcccaaagtgctgggatcacaggcatgagccaccatgcccagcctcttcttccttttttagtcttgctgttttactattgaaatccccgtgatagtccattcacagattgtgttacctcttggataagtttcttgcattcccaaagccagagctatgtaagtatagacattcacatctgcctgagcactctccagttggtctgaaagttgttcctggccaaaaaatacctgaaacacctttacaccactcctcatttggaaacgtttgccaatctctcttttctcttttcctttgtcctttcagtttcttggcggatctgatggataactcagagctcatcagaaatgtgaccctttgtggacatctccaccatggcaaggtaagacggaactttcagctacttggaacaggatttctcttttgtacctgctcatgttttagcccttagagtcacagcggttgaggtttgaggtcacaaggctcaacctcctgactaggggtgctgcatgcctgttacgaagtcatactgtgaaattctggcttttcccaagcagcaggtggagcctgttcctaagccacttgcatgcctgagccttatgtctacatctggacagaagatgggaaattgagccttactctgatttttataagttttcatttcctgagggatgcctgtctaagaaagatttcatcttttatttgaaaataatcctgtggcttcagtgttaattatttgctgtcccataaccctccttgctctcctttttctctccttatccctaaattatgtggtgtattgggagctgggggaagggcacagtaaattttcctctgtggtcggcagatgttaactgtttcttcccttttagacatgttttgtggattgtttaattgaacagactcacccggaaatcagaaagcgctatgaccaagatgtaagtagaacttctgttgagggtttaggatgaaccattcagaacagatagagatgtctctctcctccttccttcacccttcctgttctctataaataatgacgcctccaaagtgcagctttataattgtgatctctattaataggctgtaagaaaataatttcaactttctcgggagcatagagaatattgagctgcagtatttttggatgatccattttgcacttgggatccctcctctgttatgatatatcctgacttttatagtctattctttcctgttatagtattaatagcctgctctataaatatggtacaattgtacctggttttcatggtaaatttaaatgcctgtgaatgaggccaactgtgtctgcaagtctcagtgcaataaatgttcaaaccctgccagattgattgttttaacactttagcattaaggctgacatgtgtctccctttaccacactaagaattctgtgcatttgatataaattatct

SEQ ID NO: 86655 - DNA, 1094 bp, Homo sapiens
agccttattgtccatttaatagttttcataggctggaagcggtggctcatgcctgtaatcccagtactttgggaggccagagcaggaggatcgcttgaacccagcagttcgagaccaacctgggcaacatggtgaaaccccatctctacaaaaaaagtacaaaaattagctgggcatggtggtagatgcctcctggcaactcgggagactgaggcaggaggatcacttgatcacgccatttgtacgcttcagcctgggtaacagtgaaaccctgtctcccaaaaaaaaaagttttcattgatcttttggaaagtgattgcatcttataaatgcaaggaaagatcctgaactgacattgacctcaacctacatccattccccctccctccctcccactgtccctcaaaatgaagcccagactcctctttccacaattcaaggtccttcactgtctcatgccaaacagcatttccaaaactttctcaacatatgagtgatccttgagagtaaaataaattgatgtcatacatcatacattctgaaaggtcagtctaatggaatagtgttccgtatttttatgttttatgcccacctacacatcactaccttttttttttcttctagaacccattattaagccagtgaaaaccaagaaattcactctgatggagcagacattacctgttacggtgtatgagatggagtaagttacaaggtttctcagcttctctgcaggaatgctgtgggttcatgtttttgtagagataagaggtggcttttggctgaaatagctagtaaattgtggccgtacatagctctcaaattctccttcagcttgtgtggctgctgggatatttggggtcaatcttaacttttctcttggtgttcatccaaatgttagctgtttcctcttccagatctttagtttgatgttgaaagccagccttcaagagagatctgggtattgcagttatcactgttggatccaccagagcctgtttggactcaataagactgctgagtattttaggaatatattagctctttattttgtttttgttgttgttattttgagacaaggtctcgttttgttg

SEQ ID NO: 86656 - DNA, 1086 bp, Homo sapiens
ccaaagcagctgcacctttttcccatcagcagtgtgggaggtttcagtttctccacatccttgccagcacctgttattatctatcacaaagttattttccaaaaacaattctgtggatataagtgaaaattttaaaggtatgggcttatcttcagtttttacctctggcttttggtttctgcctttggagaaagttgcttttttccccgtaaagggctgtgctgtgatttgttttctccagtctcaacccacttgtgaccagtggcccacattcagaaaggggcaagtttgaaccaggagcactgtccatggcctcggcttagagtcttctctttgtgaagggtctcaaaggagtggaacctcccccactggcatagaactcagaataagaagctggccagcatgtacagtcagtgctgtcactcacggaggtagtcagatatcaaacaggaaaagcgtgtgcctcttcgattctccctctccctcttgctttcagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacaggtacatcaggaggacatgggctgtgcggagtgaaattgaaacctggaaacttcatagctctcagcaaaccttaaaagttcagtgaatgaattgatcagtttttctttactaccttcaggtactgtttctggtttaagatttagttaatccttttttaatattcagtaaagttcttaactagtttctaagcaaataagagttatttcttatttatctgctatcagtttaggtgcatgaagactgtcgttaagtttatttaccctgtggcctgatatgtttttccatccaaataactccaacccttttaaccagttctcataatatgtattgtccatttctttttctttttttgagacgaagtcttgctctgtcgcccatgctggattacggtggcacaatcttggctcactgcaacctccgcctc

SEQ ID NO: 86657 - DNA, 1026 bp, Homo sapiens
aaataatttaggaaaaagtaagttatttgtactgttcttgccattttttgatactgagttgttttaaaattaaatttagtattaaaaaagtggagggagggggacctcctcttttggctttggagcgccccccacgccccatctctgtacggcggagcttcttccttctgtcttctttcttccttcttgcctattcaactctctgctccttaaaacccaaaacaagaaaagtggagggaagactacataaatagagacaagtaaggcagagacttggggaaagtactgggctttgggaggagcattcagtaggttgatgtcactggagaggaggcatgtgaaaggggtatggccaaccataagactaagactagacaggtggagccaccacatgaaggccttgattaccttgtcagaatctaactcttctctccttgaattttagcatcatggataccgacttatatgatgagtttgggaattatattggaccagagcttgattctgatgaagatgatgatgaattgggtagagagaccaaagatcttgatgaggtaaaacaaatatattgctcttttatctcactcttatttattttatttaagacaagatctcactctcttgccaggttggagtgcagtggcgcaatctcagctcactgcaacctccacctcctgggcttaagtgatcctcccaccttggcctcccaagtagctgggactacaggtatgcaccaccatgcccagctaatttttttttatttttcgtggagatgaaacattgcccaggctggtcttgaactcctgagctcgagcagtccacctgccttggcctcccaaactgctaggattacaggcatgagccaccatgcccagccccctcttttttcttttttttttttttgagacagtctcaccctgttgcccaggcaggagcgcagtggcaccatcttggctcactgcagcctctgcctcccaggtccaagcaattctcaatgcctcagcctcctgagtagctgggattaca

SEQ ID NO: 86658 - DNA, 2842 bp, Homo sapiens
agaaccagtggcagactgacctgcacctgtggggcagaggctggcaggctctgcccacccacgcacccgcccattccatagcccgagaagcagctctcggtaacaagcgcagagctgggcaggtggaagggtgaaattgtttgaactccagttccccgggtgcaccagaaactggcatctggatgtcctcccagagcaggcctgtcactcagctgtcagccaggcagagagaggaatccacctctttgtagaagaaacctcagaggtcatcttgtccaaccaccctcccccatgcccgagctgggggctggagggaggaagtggctggccttgcttccggttccctgctgatcagcctccttccctgtcctccctccccagggcacctgtgcccctgttcaccatgaagggccccaagccaacatcttccctccctgggacctctgcctgcaagaagaagcgcgttgcgaggtgaggtttgggaggtgtcagctgtctgggagaaggagctcgctctcaccagggcagtagacacctgggccgactctgggcccccagtgtctctgtctctacacccccggagcaagcagctgaggtcctgtgagcagggcccgcatctagttctcctattgaggtttccttggcccttgctatcccaggatcaccccagagctgatccatgagggaggctctcagcacccatttatccatgagggagatgttgcacaccattaatccagcaaagggactctccatcctcactgctacttccctcttgtgtccccaaccctacacactgcctctcccacccttagatccagctctggaagctcctgctggtgcccagcagcctttgctctcagggcttagtgtcaagtacttatatgccccacttcaatgcacacccatagtccagagacagggccgtaaccttccaccttccctcctttcctccctcagttcctcagtctcccatggccgcagccgcatcgcccgcctccccagcagcactttgaagaggccagctgggccccttgtactcccaggtgactggcactagggacagggatagcctgggccatggaggccgatgaagacaagaaggaggaggggacggggagctgagacccagaagaaaggagggcctagggtattgccaagcatctcagggatgctgctgatgagacaggtgggaggtgggctggaggacggggacagagcgtcactttccttcctcgctgcactccccgccacccatccaactggcctgcagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacctttgctgtattaacatccctccccagacatccatcctgctactcaccctctgttaatctcctgttacactcagcttcttggcatgtacatattcatttgtgagtgttaatgtgctgctgttttttgttttttggtggtttttgttttttgttttttttgttttgagatggagtcttactctgtcgcccaggctggagtgcagtggtacgatcttggctcactgcaacctccgcctcctgggttcaagtaattctcctgcctcagctttccaagtagctgggattacaggcacccatcaccacacccagctaattttcgtctttttaatagagagggggtttttccatgttggccaggctggtcttgaactcctgacctcaggtgatccgcctgcctcagcttcccaaagtgctgagattacaggcatgagctaccacgcctggcccgtgttgctgttttaaaggtgctgccatgttcccccatcttttttttttttgagatggagtctcgctctgtcgcccaggctggagtgcagtggtggcgatcttggctcactgcaagctccgcctcccaggttcacaccattctcctgcctcagcctcccaagtagctgggactacaggcgcccaccaccacgcctggctaattttttgtatttttagtagagatggggtttcaccgtgttagccaggctggtctcgatctgacctcatgatccacccgcctcggcctcccaaagtgctgggattacaggcgtgagccactgcgcccggcctcccctctcatttatgatgccctctgtgcaggcagacggctcttgggctcttttccccacctgtctctaacacaggccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatccttggtgtgtgtgtctctctgtacacctagataggatagcaacaccttccctttctcaccttgctactcttaagacctcaggaaacttctgagtat

SEQ ID NO: 86659 - DNA, 1007 bp, Homo sapiens
cactgcactccagcctgggcgacagagctagactctgtctcaaaaaaaaaaaaaagaagttcctctgtcttcagagagtctttgtgatagaagcgacacagtccccatccctgggtgggaagccaccagctgagaggggcaagatgttctccaaaaccaagggagacggcaggagggtggcctctcattggccagtggtctagttcagacttgtttttagcagtgggagcatattttcagcaaaacataaacaccaatatatgctttctgccacatctgcttgacccctctcttcctccctccccccagggagccctggctctcctgggaccactgcaagaacaccctaaccctggcaagaaggtcttagtcgtggagtcaggggtcttctgcccctcgctgtggtctcaggcatgatactgaccttctctgctgtgtctccccacttgcgagggtgggtcatggggacgtgggagagacctagtgcagtgcctggccatcggcggtggctgataaaagctgctttgaatgaacaaataaatctctctcctgttccccatctcagctgaagagcaatgtgaccagcctggactgtcacatcagccagtatgctaccatctgccaacagctccaggctgaggtgaggagcccgccttgggggcaggctggagggccgacagccagaggcaggagcttgagggtgtggcgggggctctgtctgcccctcccctcctgtgcttagctggggctctcaggggctgggctgcttctgttccaggtagccgctctgaggaagaagctccaagtgtatgaggggggaggccagcccccaccacaggacctcccaggatctcccaagtcgggaccaccaccagaacagtgagttccactgcccattcccgcccccaccctgcagctcagccaggatggggagccaggccctcttctccagtttctggaggactaggactccttgcttctgctccaatccctagggttaagggttt

SEQ ID NO: 86660 - DNA, 1050 bp, Homo sapiens
ggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtcggctgcccctgccctgggccttgttctcacaaccacccggggggaagtgagcccatggggtggagtgagctggtgtgggacagggtggcaggaaatggagagctggcacccctcaaggagatagatactgctcagtgagatgctgcactagagacacccgcctgttcaccctgctgtggtcatgtaacacagtcctgggaagcgccacttctgtgggtgtctcagatacatcccggcctcagctcccctgtccagccgctagggagaggtttcctgatgggccgctctccctcaggcctcttcctttcttcctttctcaggtgtataatgaacagatccatgacctcctggagcccaaggggccccttgccatccgcgaggaccccgacaagggggtggtggtgcaaggactttctttccaccaggtgtgggattgggctcgggtaggatgatcggccccatgggtccttggggttccctcacaaaactgtttggggatgccctgggtcctgtgatggtggtagcagtggtggtggtagcaagggggtgatgtagattctgaagagcagcccttcctgttaggggaaaagtcctgatccgggaacccacagccccgttcctgggcttctcctctgtagccagcctcagccgagcagctgctggagatactgaccagggggaaccgtaaccgcacgcagcaccccactgatgccaacgcgacttcctcccgctcccatgccatcttccaggtgaggtcatgggtcagagcctgaaaccagtgcccctgatgcccatctccccctcacccctgccatctgccttcagatctttgtgaagcagcaggaccgggttccaggactgacccaggctgtccaggtggccaagatgagcctgattgacct

SEQ ID NO: 86661 - DNA, 1854 bp, Homo sapiens
aaaatacaaaaattacctggccgtaatggtgggcgcctgtaatcccagctactggggaggctgaggcagaagaattccttgaacctgggaggccgaggttgcagtgagccaagatcgtgccactgcactctagtctgggcgacagagcgagactctgtctcaaaaaaaaaaaaaaaagaaaaagaaaattaggtacagtccatatatttgaaagtgtagaatacagaacgctaattccataaaaggaattataattattatacaaacataagggactattacaatgatgtgatcattgtagcataatatataatatcactataaggcagtatagcccgatgtgtagtcagactgcctggattggaatggggctccatcactcactagcattgagaccttgggcaaattgcttaaccctctctgtctcaatttcttcattgaaaaatgagtataataatagtatccatcttgtgagattgcaatggggataaaaggagatgatatgcataaggtgctttgaacagttcctgatgcagtgagcacttagctaatatgcttactatggcaatctgattgctgggacaggaatagaattacatacatgtaaaaggattatggttggttgatatctttttcttgttttatatggggacgaagttaagaagtttagggatgaggggacaggagtttcaaatcagctcagttctgtctcattccccaaggaaaaccttagctgtttgctagagtgtcaggtagaaaccccacttttctttgctgaatgaccttggcatttgtgacccaccagtggaagctagtctttacctggaaggcatccatctattcataacgcccaggaacagcccctgttcctcacccctgtcaatatatccccagagttgggctgaacttttccaggctgcattccaaaattccatccctacccttggtacgctgcattccaaaaattccatccctacctttggtacgctgtttcgaaagagaaatgaaaaaccagggagagaggtctggggatgatataagagtgaatgagtaaatatatgtttggaattattaccaggtcaacattaggaaatctgttgagtcaccctctacattaatagattaaaggagaaatatgtgtgatcacttcaacaagtgccaaaaagcatttgataaaattcaacacccattcctaccttcctaatgggcagtggaggtggggagctaaacatagaagagctaaaaatagaaagtaactctcattatttgcaaacgatatcatcatttaattgaaagacttaagataatcaatgacaatctattagaaccaataagggagttcagcaatgtggccagatacaagatctgcatgcagaaatcagtagctttcctatcttctggaaagaaggagtttgaaaatgtgattttaaaaggagtgggtgggcgcagtggctcacgcctgtaatcccaacactttgggaggccaaggcgggtggatcgcttgaggtcaggagttggagaccccacctctactaaaaatacaaaaattagctgggcgtggtggcacacgcctgtaatcccagctgctcaggaggctgaggcaagagaacctgggaggcggaggttgcagtgagccaagatcgtgccactgcactccagcctgggcgatagcgagactcagtctaaaaaaaaaataaaaataaaataaggagcctattcataatatagcaaagatcatgtaataactagtaataaacctatcaagaaatatataatacccatgtgaagaaaattataaaattttactaaagactgtaaaggtgtgaataaatggaaagagatatcagttcctag

SEQ ID NO: 86662 - DNA, 1064 bp, Homo sapiens
ggcgggcgcctgtagtcccagctacttgggaggctgaggcaggagaatggcatgaacccaggaggcggagcttgcagtgagccgagatggcgccactgcactccagcctggtcgacagagcgagactctccctcaaaaaaaaaacaaaaaaaacacaatttcttcctctgcatgaccacaacatgtaggaagaaccagtggatcgggggtgctgttcttttgtgggtaccaaggtgagggggagatgggagctacccaagcccaattgcagggcagaacagcctaaggatggggtagtgcccctggtgacagaaggtcaagttctagccttgctacttcacatttgggagacaagttcctgtgcctcctgttccttttgtacagtagggatatgacaattgttgtgaaagttaaacaccatttgtaaagcacttagcatagtgtctaattcatagtaagcactaagtaaatgttagctgtaataataattatttttagatttttggattcagactctgctcttctctggcccttatttattcataggacaaattcagcatctgctgcatgctgggccgggtgcccaggcacctggggtacacagactatgtcagaagaaggtcctcctcttggagtttaaggacaaaaaaacaagtgtattagggttgtgaaggagagatgaagggggctacagcatcgcctgtaaaaataggacgtccaggggctgggcttcttcccctaccccctcacccctactacgttcctcagcttccagagtctgcaggtagattccctcaagtcctctgaaattcttctccagggacttgtgaggagcttgggctcactggacctgtctctactagggtgggcagagcaggctctccccaaaacaacagaatcttggcttcccagccccagcctggcagagcactagcctctgggttttaatgagctgccctgggttagaaacaggacgtgactgtggctggctgagaatcctgaagatcttattaaagaatcatctcccttgtactttgggctgaaatgctctttccaaccaagga

SEQ ID NO: 86663 - DNA, 1751 bp, Homo sapiens
ctcttctctattccttgtatgtctctctttcccacgtgtgtctatcagacatccccgtgtctctcctctttgtccttggttcctgaccaaatgggaggccccagtatccagcaaaggctcattctgcagacagccccatgattccccctattaatcaccaataagggatgcagcaatgtcaccttcatcaatggaatgtcttcctttcccaaagaagtttgggctgacacagagctgaggtttcaggggattggcagcttgcctggatagggaggcagtcattgggccacaggttggccctagaccctgcaccacctcaggaagtcccagcaggtccccagagatgaggcaacaagaggccccggagatgctatgtgcttagaatggggaacttgcttcagtcactgggaggtaaaaccatctcaaaagctccttttccctccagcaggggcagggtgttgacagagtctgatgaaggggtgctcactggagatgggaccacaggctagtaggaaaaaaggaggtggctttaactaggggtttcaaaggcccagcactttaatagttattcagaccagccccctcaaaagaaaaacaggagaggctgggcctggtggctcacgtctgtaatcccagcactttgggaggctgaggcagatggatcaactgaggtcaggggtttgagatcatcctggccaacacagcgaaacaccatctctattaaaaatacaaacattaggccaggcacggtggctcacgcctgtaatcccagcactttgggaggccgaggcaagtggatcatgaggtcaggagatcaagaccatcctggctaacacggtgaaaccccatctctactaaaaatacaaaaaattagctgggcgtggtggcaggcacctgtagtcccagctacttgggaggctaaggcgggagaatggcgtgaacccgggaggcggagcttgcagtgagctgagatcgcgccactgcactacagcctgggtgacagagcgagactccgtctcaaaaaaaaaaaaaaatacaaacattagctgggcgtgatggtgcatacctgtaatcccagttagtcaggaggctgaggcaagagaataacttgaacccaggaggcagaggttgcaatgaggtgagatctcgccactgtactctagcctgggcaacagagtgagactctgtctcaaaaaaaaaagaaaagaaaagaaaagataaaaacgaaaagaaaagaaaaccaggagaaatagtggggcccgtagccccctctcccatgtcctttatgacttcttccaaattgcccaagagactcatttgatctcactagccatcccacttgttagttttgagcccctactaggagccagatttgaggctttgtaggagttcagtccacttgccctccaagacctcatggcctatgcagggggaacattcataacatacaaccacacgccccagcgaatactgtgttaaaggtgggctgggagcccagctgatgactttggtccccaaatgtgttggctgggagggagtgcttcagtagggcctaccctggtgcagaccaacctgatgcagggggagaagatggtgaaccttggtctgcaaagtgaggagataccacaagggagaatataaaaggtcaagtgtaggggaaagccagctcagaggtggacaaggacatttaaataagcagagaaaaaaatggcaggaccagacaatgtatgggaacaaaagagagaagcttg

SEQ ID NO: 86664 - DNA, 1020 bp, Homo sapiens
atagctcctacttgtggacccatgcacattcacaattccttagtcacaaagtctacacaaacatatgtatgccaccccatcacactctgcctggcacctgcacaaactcagacacttacacgggaagagaaatgcagccatcactctactccccaacccccactgccactgatcaggaagagccagcttactggccagaccatgcataattcagaggtttggcccaaaatagttctatcaggcccagattctccagtgggggctaggggaggagcaggagcagcaaagggagtggggagagacatctcaacttggagaagaccctagagtctgcctcctgccctaggtgcctgggcagagcctgggggccaggggaacttcagcgcagcctgaagcactcacttcccaagttccctctcccccccacacatccccaaatcctcccaccctggggagacagggtcacccgcaggcagctgggagtgccaacacctggccattcacacctgctggggcctggagtcctcacctgtgtgtgtcaggctccccagcacctccccagggcccaggctgagagggacactgctgagttctcaggcatctttgtcccaggtctcctgtcttcacttcaccaatcaatcagttgataagtccacaaatatttactgagcacaagcccgggcaaagctgggtcctaggacttcagagggcacctggctgtgcatggagaggctcagaacttgctgaggaggcaggaaatccacagaaaggacaaagactgggtcagagagggacaggccatggagctagggatgcaggcggggaaaagcttccagctgaaagcctgacttgagctgggcctgcccaggtgaaggcctggattcagagagatggaaaggcaggtgggagggacagggtcggctggatgggggcagagggtccgaggctatctggatgttagtaagaagattggctgatggaactggagtcatgtgaggaagtcatggggcaggactggca

SEQ ID NO: 86665 - DNA, 1028 bp, Homo sapiens
cttcccaccttatgactggggaatgtcaggtctagtagcaaagcaaagagaccccagatggcaaaaaaaaaaaaaaaaaaaagagctgtggccaaagttccccccttgtttgtattaaggggcttccgtagcccatagagctctgggttcctcacagtgagtggagtggggtgtgaggcagccagtgagcttccaagcctccctccctggctgtgggaccctaagtagcccagagcagggtagggttggagggaagatccagtccccatgctctctgtttcaggctgggcctggcagggctgcctatccctgtaacttggggtgagagggaggcaggacctacagtgcccttttgccctatccttagcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccccacacacacacacacacacacacacacacacacacacacacacacacacacacggactctccgaatcagggctgggcctctgtgccaggccatcccgtctttggagtgtatcctatttgagatcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctggg

SEQ ID NO: 86666 - DNA, 1035 bp, Homo sapiens
tggctctttggggagaacctatcttttgggtgttttgtttgtttgtttgtttgtttctgagaaataacaacttgagatttaagatcaaggtgaactaaacccttagtgcctgccctgatcacctccttgcctcacacggcctgaggcctctgcttcagcccgcacagtagagcctccctctccctgtgctgtggtggttctcattcgtggaatcctcaccttcaccttctcattttcaagtatcaaaagacctgccccccacttttcaaggccagcacaagtgccagcccttctacaaggtcttccctgatcagctatccagaaataattttctgcagccttctgttctgcacggcattggaaccggccagtgtgcagggtatgtgtgtccttggaaggcctgcccctctgctgggcgctctggacggtggggcccagcatatcatcagtcctcagtgtgcgcttgcagaattgaacttgggggatttccaacctctccccaggataccgctacgtgattctggatatccccctgctgtttgagaccaagaagttgctcaagtacatgaagcacaccgtggtagtatactggtgagtgtgtagcatgccctggctggaagggaggaccatgggggtatctgggaaacagcccacatcattttgcactttgccctttccccacggggcggccaagaggcatgggggtttgggcagcagtgctcagggtctgtagaaaccaacctttgtgcctgacgcggatagtcctgggggcaggtgtgggaagggacagcccgcgggcttctctagtgtttggggagcgctcccccgctgaccattgcaggcacttcagcccagatgcctggcctcgccctgggccactgttactcagtggctccttcttcctcctgtagcacctttattactttgcacagtttacctctcagtgggaggtggtcaggacaggtgttgatattcctattactgaagataaaattaaagagggggcagttacagaatgtgtccagggtcaccctt

SEQ ID NO: 86667 - DNA, 1106 bp, Homo sapiens
tcagtgatccaggtgttccagcagctgggctgtgcggtgattgacgtggacgtgatggcccggcacggtgagttggaggggcaggttggggggccgtgcacagcagctccccacgcttccggccttctgccatgcctcctttttttataagtctcagaggaggggaaggctcctgttgaccctggtctgacttctgtctctgccccgtgcttgccttctctgctcttctattttctgtttttagaaaccccccagctgtaccccattaccagcacaagggatcctgtacactctgctcttttccttcactgctttctctaccctcattttgcttttgctccacctgaaagaagcacccgagttcccccatcattttgcccctggtcactgaggtcctctgactggccctgaggcttcagggagtgacccagcttcttcctcctgccacagtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggtaagtgccagggcctggggcggggggcggggcctccttccagggccagggcccttctcctctgcagaaagtttggccagggtaggggagctggttatcccagctgatgagttcatactgcttactggcatcccctccacacagagccccgtaccagccccagaggaaagaagcacgttccctcagctcttaaggaggctgacagtttaatgagaagagacacatgaggctttcgagccatgagcccaggaagtaagttggtttttctagtagggatgggagtaataagagctggtgaataatggagccatagatctgagttcaaatcccaaccctgactttctagctgtgtgacttcattgagtgatctcgccctcagctcattttttcatttgtgcagtggggataataatccaacatgaggctgggcacagtggctcatgcctgtaatc

SEQ ID NO: 86668 - DNA, 1098 bp, Homo sapiens
cctggcctcaagtgatccgcccaccttggccttacagccactgcgcctggccccaggggagcatttattcaccactcccaggagagctctgaaccactgaaggggaggaagaaatcaccagtgtgactctcagcctccctggggagctgcaccgttcttggcactgaaactccagcccctctcactcacaagtgtggggactgaggctcagaggagggaaggcacccggggctcagctgtttcttgtatggagtccttaccaccctgggccaggctggagagaagacttcctgcagtcacatgggtagttttatcacagaattcagagaccaggacccaggactttccacttccagtccacagcctttcattttagccatggttctgggcctagctgattcagattcagtgggctggggtagatggagcctgggtgtctgtaccttttgtaagtttcgcagtaaattcagattatagccaggtttagcacttgctgtgaggaatgtactgcctctgtgtaagcggcagtggaatgtgggaagccagatcggattctggagaatgatgacttgaccagagcagaaagagggtcatgaacacaggtgatcaaaggtggtcgtttgttcatgtgggcctgacagggagctgctggcaggtctaggtgtgacttggaggccgctgggtacctaagcctctatttcctccttgctgagctttgggagcaccgtgggctgcaacttcctccctggcagatcccagtagatctgtgcgcagccaagtgagtgggaaggcactcatacagcaggcccagggccagcaccacctgaccattcctgcttacctgtcagcgctctgttctcagatgttttcatctggtactatctagctctccagttttcccaaggggcaagacttgtgttttcctctggttacccaagaggtccctggcaccgttcctgcagagcacagagatgctcagtggatggtcagtgaaggaatgagctacagaggggcttgttggacaggaacagctgttatttgtcaaggcccttttaagttggggacccggagcctccctgggcgtgtgctcctttgtcc

SEQ ID NO: 86669 - DNA, 1018 bp, Homo sapiens
acatggattctttataagttctcctcatttcctggttgtgagatactatcccttatgaaaacttaggaggagagaaaagtctttctgaaaataaattccataaagctagccttacttgtttttgtttttttcttcagcttctccaagagtcgttctttccctatttatttgatggcttatagctgcagctagctcttggaaataagaaatctttttagttcctttttaatttctcccttcaacttttggtttttcaaaactagatcaaagcagaatggaaagagaaacctcatcactgatatcaaataagtgttctaattttgtttcccaattaaatggcaattaaaaagaaactaatcaagagctgcttcaaagagaagagactggaaagcagaagaaatggaaagtaaatgagagcctatttcagggactcgctgctcatggcacagcagttttgctgatttttcacattgttcaactaatatgctcacgctaaaattccccagctttactaagttggcagttaaccctttccctatagagcccatagatttatgagccatacatttagtaacttcaggaggatgcttctttaactctttctcttcagctttttatctgaaatctctacccttcaggcctctcttccaattcctcaaagaagatgtccttgtgattgttacatttaagggacaaaaatatggtgttctctattgagagcgccaaaaatactaaaccggaattcctccataggctcagtatttgcctcaaaaatgtcccagcactttgagaggctgaagtgcgcagatcacttgaggtcaggagttcgagaccagccgggccaacatggcaaaaccccatctctactaaaaatacaaaaattagctgggcgtggtggcacacacctgtagtcccagctacatgggaggctgagacaagagaatcacttgaacccgggaggcagaggttgcagtgagcccagatggcgccattgcacttcagtctgggcgacagagag

SEQ ID NO: 86670 - DNA, 1109 bp, Homo sapiens
agctgggactacaggcgcccgccaccgtgcccggctaatttttttgtatttttagtagagatggggtttcaacatgttagccaggatggtcttgatctcctgacctcatgatctgcccgcctcggcctcccaaagtgctgagattacaggtgtgagccaccgcgcattgctgccttttcctttttttgagacgaggtctgtctctgtcatacaggctggagtgcaatgacgtgatctcaactcactgcaacctccacctcccgggttcaagcagttctcctgcctcgtcctcctgagtagctgggactacaggcatgtgccaccaggccccagctaatgtttatatttttagtagaaacagggttttgccatgttggccagtctggccttaaactcctgacctcaagtgatccacctgcctcggcctcccaaagtgttgggattacaggtgtgagctaccacgcctggctgatttgggcatttctcatgactgaccattttggacacagattgtggcaatgttaatgtgcctttttcctcatccctcactcccttttcatactgtcttgtgctccagatccagctggggaaaatcatgaaacctaatacatttgggaggtggaggaaggaagggcaaagcattccagaaagcccatcactgccttttggctgtcatccttttacattcagagttcaaggaagtattgtggtatgaatgccttgttaacaattatcattcgtctttggtgccattaccctggcaatataaagaaaataagcaacataaaagcaagaacggaaaaggccctttcacacaaataggacatcccttgcccagcactccctccctgaaagccgagggggcgcgagtcaggaggagtgctggtgtcctccaaatgccctttctggacctgggttcttcagcctgcttctgaagccaacaggcttgattaaggaaggtctggctccacagaaagctctttgtcaggggtagcacaaaacagattttttttaaaccctgcattagtatttactttttgttacagtggtttgagtccagccaatgacactggagccaaaaagaagaaaaagaaacaaaaaaagaagaa

SEQ ID NO: 86671 - DNA, 1040 bp, Homo sapiens
cacgattgagcctggcgcctagaagccatcatctggttcagaaatgggcccagtacattgttgttgctgttgacacaaaagcagccttgttgtgactccttacaaacccatccagactgatgggcctgggccagggccctgacagcactctttacaccaaccaggaggcaggaagccaaattactaaagataaatgtttgtcattcagtgacccaagggagatttaaatggatttccaaaacacgaaccaccttggatcccagtgattgtcctgaggttttgccatgaattggccctcagttaggggctaagggtagctggaaagacggtttgcagttgccaagcacagaatgttcttcagatagagggctcctagggacaggaggaatttgctctggttgagttttgaactgagccctttactgccccgagggggcaaagggtgaggctcacagctgtgctcttctttcaggcgaagtggtgaacacccatggccccgtggagcctgacaaggacaatatccgccaggagccctacaccctgccccagggcttcacctgggatgctttggacctgggcgatcgtggtgtggtgagtgggccctcagaaggttacacctgcgggtaggagccactttcacagtaagccctgcagtctcacctagactacgtttactcgagccctagagagctgagccaaggaggtctgaacagactcccgtctgtaacttcctggggcatggccaagactccacataaatagctcttagcttttctggcaggttggaagttaacctctgtaggtccccgatgtggatacctgtttttcatttattcttttttgttcattcatttcctcattttctttctagtctgtctcctgactggagcagctggggctgctaaatgaggccctgtcctcccctttccaccccggccacccagagccccttgttttgacctgagggatttatttcccttataaagaatgatgaaaatgtcgccgggcgtggtggctcacacctgtaatcccaccgtttt

SEQ ID NO: 86672 - DNA, 1024 bp, Homo sapiens
tacctgaaagggaaggaagaatttgtaccagaaagagggagacaggacaccagagctccagggttgccacagtcagctctcaaccatgggacccactggcctccgaaccaaagatgccagtaccttggttcaagctgtcaaagtgaacacagaaattggatcaggcatgaaatcctcagtatgataaccttgggttggatgagtaactaggccaaatgggatgagcagccagaaatggtgatggctcgattctgtgtgtccaggagggcttggccctaaagagaatccagctattaaccctcagggaggtggtagcaccaggtccgaaccaaatttggctgtggagcccaagcggcttgtccagcctgccggcaagcagcacaaccaccccagcctctcttttccagggctctccggccacccggctggctcccccagtggcactgtggggttcgagtggtctcaagtcggaaattggttgggttcattagcgccatcccagcaaacatccatatctatgacacgtaagcacctgcacctacccccaccccccacaacaccgccatcctgcttggtctgggagagagtagaaaaaggctgcacaatgtgccccatgaaaggaagagggaaggtctcaggaagggaggatgcccaggtgcggggactgcagattcatcctaggaaccacctgttctgctcagagtcccagccagctcccttgtttgtggcccaggttggaaggagcccaccctgaggcctggtgtgcctgctcagcagaggcttgtttttgtttttgtttattattttttacattttatagaggcaaggtcttgctatgttgcccacgctagtctcaaactcctgagctcaagtgatccactcacctctgcctcccaagagtgttgggaatatagacgtgagccattgtgcctggccagaggcttttcttagtctcactctgttgcccgggctggagtgcagtggtgcgatcttggttcactgcaagctccacctccagggttca

SEQ ID NO: 86673 - DNA, 1112 bp, Homo sapiens
agagcgagtgtgacccagattcagatagtccttggggcctgtgatctctgctcttcattttccctggaagtgttgaaaccatctgcctgccacagtcttcagggcttattaccagctgtgttcttgagggaatcagaacccttgaaaccctagaattgccttgacctgccccgtgggttccctgtgctgcttccctgcatgctaaaggtgggattccccagccaactcctagggactcatcagggagatgctggtggtaccttcaaataaaggtgtttgcttgggtcccaccttcctttggaaatagattctgttgaagtgaggcaggctccttgcctggtggagtgtggtggggagtcccagtactgagtgcaggtggcagctaaaagtacacccgtgctgcagacctggtccttctaggtgtggctgcacgtgcttgatgggatcaccattcccttccctgttaaaaaccttgtcacctggatttttccccctcttagagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtaaaactgtcttcctgtaaggccccaaaaatgcgggtgtctgcactgtagttgaggagcatgtgccactgtgagtcacagctccgcccttagcatcccacctctggcgtatctggtaaggcgggcacttggtgcctgcaggagccagatggggagcatggagagggcgggagggttgtagggatggcagattggcaagtccctgccttgtctggagggctcttggtgtctgctggctgctgccatttggagatggtggggggcggtactggtggtttgtttttgtttttagggatgagcccaaatctggatttttatgggaaatgtcctaaagttttaaatggttggctcaaattgttttgaatattgtgtgcaccaaatagagcaagtcagctatgtgatctaagggcaacctctgccttagaaagttgtttaaaacaa

SEQ ID NO: 86674 - DNA, 1260 bp, Homo sapiens
gatcagctcatctcactccatctcttctgtcttgcctccagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggaggtgagtcagggagtggtgttccaggtctctaacacgttcccagagaggcacccccctgagtggccgggttcccagggctcgagtgttggcaccttagacttccttgaccatccgtgtttggtcctccctaaaaacagggagttggtgcttgaatttgctgaaaagatacctctggatctggcttgagcccttctccccctctgccccactttgataacacaaaatagagagaactgagccccgcttaatccttcaggaaagcctgcaattccctgcctgtcccagcttaacccagtgctgaccagacataggagacacagtctggggggatgtgagctgcaagaagaggtccctggcggtgcccatgctgggaaagaggtctggcaggttcagcccacgatcacggctctgtcctcaagtgccctgagccaatgtccctcctcctccccacatgtcctgttgcagtttccagccatttatctagaggggcagagctgcctgaaggtggagtgagagaaacattttgttcccgggccgcagtgccactgtgcatgcttgacattgcctctttattgccttcccttcagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatggtgaggagcagacgggggggtctctggagatgtgcagggaagaggcagtggagccatggtgagcacagctcccgggacgcagcctcccatgggctggaggctctgagccctcctcatctgttctgcttaggcagggttcccgcagtttttaggcagaaactcaaaacttggagggaacaaggagcatccgaagtgaaggcattgaactcctcctgattcatttcagtgagtttcgttctcacaggaggcgccaccaaggagcctgaatagccaggccttccctgggaggacag

SEQ ID NO: 86675 - DNA, 2186 bp, Homo sapiens
gccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatccagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctg

SEQ ID NO: 86676 - DNA, 1025 bp, Homo sapiens
ttccaggttcccccaaggtaggaaagacttgggcactttgtcctttgatatcctcaaaggtctggacagggtgagccactctggggcttgaggcactgtgcaactgttgtctgtggggctgcaaagcaagcccctgcctctccgactcctcccacctgtggaatgcagtgcgcatcttgctaagaacagcagcttctttggtctcagtttcttggagtcaaggagcaaacgtcagtcacgattgctggggcctgcaatttgcagcgcaggaacaatgggaaaagggagggccctgcaggcccctgatgaaaatccaccttagtggagttgctggctctagcagcagtctgcagagcgggcagcattcccacgggtggcacggcccccatcccaagcatacgatgtcttctggttttggaaactctgcagaattagcctctgacaaaccacaccaaaacccacagcctgcaacaagcccctgctggcctgtagaaagtggcttcggtgagtggcacagggctgagcctggcctcctggctaaggcttcattcctgtatgagcggagaggtgacggcagcaaggaaacccgcacaccacacgtcatgctacctccttcccaccacttgcttctctctagagcaaaaattacatccaagcctggaagtacaatttcacagcccaattttgcccggtcacttggctgaacaccactccagaatgcctacatcgacagccatgtgaccagaggcttgattacgttttgggaaactggcagcactgacaaccatcactaccacaaaaatccacaaaacagcatcagcgaaaatcagactcagacaatggagatgggaaaccacttctgttgccaagtccagatctgcctctaatcacttcttgctaccacttgcaggctgtatcttggaaaggggcacaacaagaaatggctaatgggttggaaggcacaggccaggggctggtggctgaaggggtctgggtattggccccacgccactcctgcctagcca

SEQ ID NO: 86677 - DNA, 1075 bp, Homo sapiens
accgtcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaacaaaaccttctgtcctggtattcctggtcagcaggtggcagtggaagaaatggagtgctggagcctaggctggagccaggacgacagggcttggacacaaagtccctcaagcccacagcaccaggccagcttccaaaggccttcctttaaggctgcccttcttccagggcaaacttggtgttgtcagaccct

SEQ ID NO: 86678 - DNA, 1134 bp, Homo sapiens
gcagctcattcagacctatgagctcaacgagacaggtggggggggtggcacggccaggtcgtggcacctgaaagggctgtgttcccagctaagcgggttctgctgcgggctggcgcgggcatcatctcgggcaggttacctcacctcctccagactcagcttccacatgtgtaaaatggcacaacagtttgtcttcctcccagggtctggtcgaaggttaagtggcatgacttacatggagtctagtcagtagattgtctagtcattattcctaagctgagtgggccttgggggcattggaagctggacatgggggatccctatgtggcctgatgccctctcctgccacccctgcagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttaggtactgtagcagggggtgaatgtttccgggagccccacctggggagagacatgggctggcttcctggggccttcctggcccagcctgcctgctgccctgctctgtggcactctggcaacaccttgcccgtccacccatctgtccacacacagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacggtgagcccctgggatgcccagccccagccccacagccttcccaatgacctccgtccgcactcacatgccagctgccctccgtccttccagaggaaacccttgcccagagaatcattcattcaccaagtgctgctgggataagtggccaatggggtggcataaagctgaatgagatgccaccctcatatttgggaaatatgttccctctctcatatttgggaaatgtcctaaaaatcacagagtttccagaagaaaacctttgggggagggaaggacat

SEQ ID NO: 86679 - DNA, 1186 bp, Homo sapiens
gtgcctggcctgggtggtgggtaagctgggtggccctccagtctaagcaggggcatgccaggtgggactagggggctggctctgccaggccctgtggtccccctcacatctttccctgtcccctaccctgacttccgcacccaaccaggtttcatgcctgttctggccccagagaaaagggtgctgccacccccacttgctgtgtcccacccggggccaagggaagcaccgcctgcctttcctgactttgttgattctccaaggaatgttatggactctggcaccgagcccccgccaggctccagccctgggtgtggcagccagctgggtcacgggggacatgcttggtgcctgaggtgtggaggctgcctgctggctaaaggattagggtgggagggtctttgggacccctcgccattgtgtgtcctctcctagagcctcacagccccggccacctggaaacgctctttctctactccctgctcggccttggccacagctgctggctgtagcagttccctgcatgactcgcattcctgtggagccctgtgtgcacctcccgagtgcgagccgcctatttccccctggctggcccaccttccaccctctccacccatgaaccctgtacgcacacacacactcacacgcacacactcacacacattcactcacactcatacacacacactgtctcacgcacacacacactccccacctatgcatacaccccacacacaccctgccctgcctgcatgccacccctccgggacacgcctggacagaactcccaccctccctgccagctgccctggcgcctgtctccactgcacagcctctatatccatccctgcctgggggcgacctgcactatcttcagcacacagggcttgtcctctctgagctcagtggtgcacctgtgaaaagggtgggatttggggccccttccagctctgacatgaggtagtttctggtccctggtcttggctacccttacagaactgctcaggccccagaccatccacgccccaaaccgcccgggctgcaggtggaagttgagaaactgggcctgccctttcctcagcacgcctgacccctctctgaggctgagataagcgggcagcttgggaaggtgtctgagccccagctgacaacactgaattgggcgggaggtgccgctgtcctggtc

SEQ ID NO: 86680 - DNA, 1721 bp, Homo sapiens
ttttttgtatttttagtagagacggggtttcaccatcttggccacgctggtcttgaactcctgacctcgtgaccacctgcctcggcctcccaaagtgctgggatgacaggcgtgagccatcccacccggtctgccacagtcattcttttttatgctcagacagtcacaactttggccattcaagaccctttcataccggatcttatgttcttataacacgacctgatgaatctttaaaagcgaccttgctttcctggtacaaggcgccccacattcactcccaccttccctgccccaggcctggaaccagccacttctccaaggagccttggctcctttttagtggagaatgatacttggaaactaaaatctaggtacccagggtcctcatttgacatatgtggcacatccttaacaacacaggtcttcaggtcataccaagggtcattgctttgtggcccagagaagatggcatggaagccgctccctctacccgcagccccgccagcctctcttgatactgggattgccctggggaggaagatgtgggagggagttggcattcaacctgtcaggaccacctgggggccacttcctttctagtggtgcagacttaggggcagggtctttccaatcttccactgaattggaagcaggttcctagggaggctgtgctgaggcctggactggcctctgactccctccctcttggctgcagaggccgcagcccaggcccagtgctcggccatggccccttgggctcccggggcccgcgctgctcttcttcctcctgtggcccttcgtcgtccagtggctcttccgaatgtttcggacccaaaagaggtgactgtcagtggaggggtctctgcagccaactgagactatcttgctgtgccctgagccttcctagggtttagaagaacagcattcaaaattccccgtcctgtcagtgtttgccttcgcacctcctcccctaaagcagcgcggggggcaaataagaccccacccctccctgcagcttcacagggacgcttccttccctccccgcaaccaccccaggctcccctgggaggctgcagttgtggtacacgtccccggtgctgggttggccgtgactcgggggcggggcgatcgggtctcagcccctgccttccccagtctctgggtcacccgaattttcccacccctgcttctccccgaggaggttgagctcttgagcaagttgggacttgggccggggcctggaagaatgattggctgggaggccgcgggagggaggccaggaggcccggaccagttgggaggagtgagcaggccccgggggagggggatgagcgcagtttgctcgctttcctcccctgccggccccctccgcccccacacacactcgggacgtcttcattgaagattcacttacaaaggaatgtttcactaaataaaagaaaaccagaatcttctgctgtctggtcccctacggagggagcggggagcggggcccggcgcgagcgaggcacaagtccctttcctgctccccacccaatgcccccctgatggccctgaaagaagccagcggttggtgtttctgaatggggaatattttccctcctccccgggcaagcgaagggaaaacaggcctctgtgtggaggggagagggaggggaaccaagggtggcccgggctgggagcggggcgcccttgggaaggcggggccaatgcggggg

SEQ ID NO: 86681 - DNA, 1051 bp, Homo sapiens
ctcagagagaaattctctagacccaagcccccagccctccataaacagggactgagaggacccagagaaccctccataccagtcactgaggcctaaaatcttggcgccctttccacttctccttcgccacacacccagtgaccctttcttcttattgcttccttaatagcatccctgacattccagcacgtttgcactgtgtaccttttacgcacagagccatgtgacctcaccacagcctggcaagttagacacgataggaatgagtgtctccattttacagataaggcatctctaagacactggaaaataagtgacttgtccaaggtcacatgacaaccatggggcagttctggctagagcgctggtctttgtgaccccccccgtgccatttttctttctgtcacaaacacaaaacccattttttcttaaaatcggggaatactctggatttcgttctttttattcccaacaacttcaaccttattcagcccctatatcacttggcaaacaggagggtacaaagaggggtgggatgccattcttgccttcaagttgctcctggactgtggagaggccatcagaccacagccagcctaaatggcaagtgagggaaatcctggtgggagctgatgagccgagtgcatgggagctgggaattatggacaagtgtcaggagcaagtgacttcctggctggctctgaaggatgaagagctttcaggcaaagtggcacgaagaggggcattttaggaagcccaagcatcatgtgccaggaaagggctagtctgggacttcggtggctctgggcagtgtgagatatcgggggtgggggccagtggtgatgggcatggccaatgtagatgcctctaaggggagccgcaagcacgcgggcctctgggcacagctatatgttctgaaaatgaacaccttcatttgttttctctgggcttccaagaattcgggtccacctgaaaagttcgccactccgtgtggcttcatcccttaggaggcttcctgagagcaagaactgcccctcagagcactcctgga

SEQ ID NO: 86682 - DNA, 1716 bp, Homo sapiens
acgggcggggcgaaaaagcttctatataaaaggggcgcagaggactgggagacagcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctggg

SEQ ID NO: 86683 - DNA, 1040 bp, Homo sapiens
agcaaaattcagacatacttgcatagcttaaggtaaattgatgtatgagagttatttgtaattagatatttgtgtatatatatatttttgagacagtttcgctcttcttgcctaggctggagtgcaatggcgcgatctcctctcactgcaacctccacctcccgggttcaaacgattctgctgcctcagcctcccgagtagctgggattacaggcatgtgccaccacacccggctaatttttgtatttttagtagagacggggcttctgtatgttggtcaggctggtctcttaactcctgacctcaggtgatctgcccacctcagcctcccaaagtgctgggattacaggcatgagccactgtgcccagcctagatatctgtatatttgaagactgggctgaatttgtcttctaaaacatactttttctgatgataaatgcatttatagtctttccaagattcattttctaaatatcatttttctaatactaggggaaataagattttcatagctgaatccctctttaagaagagggtctgggctgggcgcagtggctcatgcctgtaatcccagcactttgggaggccgaggcgggcggatcacctgaggtcgtgagttcgagagcaccctgaccaacatggagaaactacgtctctactaaaaatacaaaattagctgggggtggtggcacatgcctgtaatcccagctactagggaggctgaggcaggagaatcgcttgaacctgggaggcagaggttgcggtgagccaagattgcaccattgcactccagcctgggcaacaagagcgaaactccgtctcaaaaaaaaaaaaaaataaagaaaaagggtctaatatcagagataatcactgctgcatcttacagttcagtcaaaatgaggcttcagctctgcactgtaaagccagagggcactgttgctgcctttccaagcagctgtttttctggggctgctgcatgacgtcatagcagaagaaaaaaacacgaagaaaactatttcaaaataaatgtttaatataa

SEQ ID NO: 86684 - DNA, 1109 bp, Homo sapiens
tgagccgagatcgtgccactgcactccagcctgggtgacagagcaagattctgtctcaaaaaaaaaaaaagaaaaaatgggaataaaaccagcttattagtggcctcctggttatctaaggaaaacacaggactgtaggactgaaaattaggaactccgagctctgtttctgtgtgtgctgcccttaacttggttgacttggccagaggccaaatactgataatgaggccaaactggtcattttgctgcttagtctattgttcatctactgttcaaccagactttcaacttccttttcagctctcccctctcagatgagttgcattatgcttttatgacaaattctacaaactctatattcatttgaaaatggtatcagcactgtctccctcataaatacctagaggagtaactagtcttaagtcgctatgtaaacacttactccttgtaactttgttatatgagaacttcacaaggaatgcttcaaagatcattggggcagttggaaagcctgccttaccaaagtgtggccttagttgtccatagcatcacaaaagagccatccaagtaggctgaatgaggatcagtctctcagggtgcccactggttgtggctgtgaagtcctggacactcattttgcctgatggccaaatcctagggagcagtgactatgtgtgagtaggattcgttgacagaggtaggaggttttttttttgtttttttttcctgctgcctgtataattgcagaaaaggagtgattctttacagtaattccccctcttcgggatgaagatgcttgcttctgtttggtttccacagttaaatcaattttttttccttttcttttgagatggaatcttgctctgtcgcccaggctggagtgcagtggcgcgatttcgcccactgcaacctccacctcccaggtttaagcgattctcctgcctcagcctcccgcgtagctaggattacaggcactcaccaccatgcctggctaatttttgcattttatttttttctggaacggagtttcacctggttgccaaggctggagcgcgatggtgtgatcttggctcaccacaacctctgcctcctgggttcaagcgattctc

SEQ ID NO: 86685 - DNA, 1032 bp, Homo sapiens
cgcgcccggaccaccccccacggggtgctctcactgcgcagcgagtccctccgctgcctcctcccagcccaaaatggcggcgatggccgccgagcttctcgtcgccttcctcaaaggccaaggatccctccgcgcctgctgccccgcccaccttagccggatctattttctgccccgtaaagattaacgccatcaatgaactctttaattgagttcggagaaggcgggtccagttgtgcctcctcacagctaatcgttgccaaaaaagcgagaatattggcagaaggcttgaccaatcaaagaaggcagtgatgcgcgcgcggtctgcccccgcgcaagggtagatgggttttggagtctcgggtgtggctgttgacgttacaggcccttggatcgcttttcaggccagaagaactacaatccccagcaggcaccgcgcgtccaggctctctcttcccccccatcttagtggcctgagcggcttgaccagagctgctgcaactgcagcaagaggtagggctcaggcgttgggaattgcaccgacaggcagtcgcacagaaaggcacacagatgtagtggtgtgcatagcccttgacagcgaataggtcagttccacctttgcaaaacctctttccatgactgtctcccttcttccaagaaatccatccttatcctagttgggtttccctcccagctgcatgtagtgcaaagacctctttccccttttctcctgtttccctttctgagaggaaggagggaggcaggccaggaccttagaggaaaagtcctcagcactaggctggcccaggtcccagctgtgcttctggcctttggagcccagcttggggagaaggttgggggtgcagggctgcatcaagattggggccactggagacagtggggaaggactcgtgagcttgctccatgttctcccgtggcagcagcagccccgctgcactcccagcctccccaggcagtcctcctttgcccctttggtggttggggaaacaaaacttacacctggcttcctgg

SEQ ID NO: 86686 - DNA, 1043 bp, Homo sapiens
tgccctgggtgtgcactttagatattcctctgtacatcctgtgtgtgcttacatggacacattctgtgtacttatactgtgtgtatacacatgtgcagcccatatgtccatacataggtgtgtgtgtatactatgtgtgtactttgtccacttatggatgtgtgtgtgtaccattgagtccatatctaggagagagagagaatgtgtgtgtgtgtgtgtccatgtatggatgtgtggatattctatgtctgtatttagagtgcaggtatatggatgttcatgtgctgtgtgtgtgtgtgcgcacacacactctgcctctttgtgtgtgtgcatgtgtataccttgtgtgcccatgtatcgggggtgtgtgtaccctgcttgtctatgtatgggggagcacatgtagcctgtgagttcttattctgctgggcaggtgtgtggaggtggtgggggaggctgagcatgaaaggccacttgtgccagttggaggagggtgggcgctgctgcctgctgcctcaggacttggtgggcctgtgggaggccgggctccacccaccagccttccctgttctcggtccccagtttaagaggcgagttcaggagtccacgcaggtgctacgggagctggagacctccctgaggaccaaccacattgggtgagtgagggctcagatcttcctctctgggcctaggaaggctctgcttccaggcagctcctggagcttccccttcctactccccctgccccctgcacaaggctgtgcttgtggaccacctcctggaggtgtccaggacagcttcccctccccttcctgcccatgctctgactggcaccttgaggcatggctgggctgtgggacccacctgagtctcccagaatcctttggtatcattgggtctttgggggttgaaagggcaccccaggggtccttgctgtccctgttctgtgcccatgtggggcaggacctcctttctggctggagctcagggagccctgtgcccacaggtgggtgcaggagttcctcaatgaagagaaccgtggc

SEQ ID NO: 86687 - DNA, 1288 bp, Homo sapiens
aaaaataaaaaataaataaagagaggccaggcgtggtggctcatatctgtaatcccagcactttgggaggccaaggtgggcagatcacctgaggtcaggagtttgagaccagcctggccaatatggcgaaaccccgtctctactgaaaaaaatacaaaaaaaatcagttgagtgtggtggcaggtgcctgtaatcccagctacatgggaagctgagtcaggagaatcacttgaacccgggaggcagagactgcggtgagctgagatggcgccactgcgctccagcctgggtgacagagggaaactccatcttgaaaaaaaaaatagaaacaaggccaggttttggtggccacagaagttgcggttggatacaaagaacttcctaaactcgagggcagttaaagatccacgtggcgtgggtgcctgaagtcctggggggcccttcctggagacactgacctctcctctctccccagtctggcttcagccttgtcatgaaccacccagcctgtgtcaatgagattgctctgagcctcaacaacaagaaccccaggtgaggtccaggccccaaacctttctccgtatctagagtcttctcctacttagccccttgcttactctgtcctccaggtctcagaggctcattctgcacccactatgctcctcctagccaggcctgtgcccacccttgccgcgggtcctgcctgttctcaagggacaacctgccccttctctctccagaaccaaggctctggtgctggagctgctggcggccgtgtgcttggtgcggggaggacatgacatcatccttgcagcctttgacaacttcaaggaggtaccggagtccctcacccaaacatgcatttccccctatggtgttgcttggagtcttgttgttggcagttgtggcctttgctggaggcagctggggacattgggtgggcatttggggaacgcccaaaagttgaagttgagccacatcactggctcagcaatctgggatggggaagttctgaatggaaggtacagggtcaggtaagggcaccacctgggtgggggtagggacaactacagggacctgctgaacctctgactcagccttgccagatccaaactagccttggttcatacctccaggagttgcggactctggctaacaggcttgcaagaagtagatgtgtggggctgcataagatgcataagacaagatatcttcattcattcattcctttaatgaatatttattgagtgcctactatgtgtcaggaacagggcacttgggcacatca

SEQ ID NO: 86688 - DNA, 1093 bp, Homo sapiens
ggcgacagagcaagactccatctcaaaaaaaaaaaaaaaaaaaaagatttaaaccaatttctcatattcaactgttaattaaattgaccaacatattgtttgagttcctgtgcctaccattgtttctttttcctatttacttttttctttgcaaagtacatccttcagtggttctttcagtgaaggcagtgccaccttacctagaactcctgtttgtgtatgtgtgtattagatgtgcatttgtttgattgtttcaagaaaatgaaacgacctgttaaaaccatcaagttaagtcataacacataacataacaggatttagtggcgtaactgaactaaaagtctgacaaattgatggctgattcagccctgacttgacaagacccctcatcagtaagggatcttcgtctgcttcctgtctacctgggctaaggaattattaccaacagtagatgggcagatgctaggggtagtaatatccacatgggtagtaatactgctcagttcctggatgttctagatgcctctgccaaccagattttattctaggaaggaactagagatccttgggtcctaagagaatgggccaagagtgtcctggcttgagccctaactccatgttggatgctctaactgtataaattgagcctcatttattcctgtaggtaatgtacctctctaagccttaatttcttcatctgtaaaattggagataatattgccaaccttgcagggttggtgtggaatgcattaacaaggcagatagagttcctggcacagtgccccatacacagaagacatttatggacggtagtggctattacattccctggcacttgggagacactcattgaatgtttatagggtggatgcagaagcctaccataaaaggcttcattgagtagataggccttaaaggataggtgagatctgggcagacattgataagggaggaaggcaagcagccactccctatgggaggaacagggtgggcagaagaagagaatcagaggcttgcccagtgctgccctgctcgggcaagtgaaggaatcagtctggaacaaactgggggaagggctgtaggaagggcagaa

SEQ ID NO: 86689 - DNA, 1031 bp, Homo sapiens
agcactttctctggaaggtgagtcacccatgcaggggtgtaggtgacaggcgatttattccccagcacagttgcagagaaagtcctgagcagaccttcgtgaggagccctctgccacaaatcagcctcatcccagccccagggctatggaggcagggggcaggaggtaaacaggaggcttctggggccagtgggctgacagcggaggggggatcgtggacggggcacagagcccagatcagcagtgtcactgactcctaagtccagccaccctgagggtggaaaatggcctgcttccagtgacagtcagcaaagaagcaggaggggagctttggccctggggagctgggaaatcccttggcagagagcagagagacaagccctattttggtgtgaaaaaccttttaggaacgcttttccacctgcctccttttcagccacctgagttggagtctctgcagagctccagcgattgtaaaggctagattaaaccctggatttcagaaagctttaggaatcccaagcctgccaccatctcagttgtctacacttctaggaccaggatttgtaccaagaaagaagcagcagggggtactcctgagccatccctccctcccaggttctggttactacagcttctcctgacgctctttctgctaaagccactatcaggtgtccattaacgcagagattttcttcagacactgttctggactagtgcagttggtgttgaacttgaccgattatggtcagggacatctataagcaatgtccaggaccaactacaaggagggcttgactttaatgaagctgcagctcttgcaaataatctcgttccctgtctctggcagactaccaacccagcccctgtacccataccccatcagtctggaccaaccagtagtcacctcctgctggcatggctaaataaccttaacctcactgtccagaaagagctgttaggattatagcctggacatgatcattcacattttttgcagtgagaaaatgcagaagagaaaatggtggccc

SEQ ID NO: 86690 - DNA, 1046 bp, Homo sapiens
tgaagtatgagatttttttgttctgggcttatgactgcctgaatgacaatgcagaaaaagtcatttttcttcagtggccggtgtgctctttgtattctagtttaaaggagcctcttcccttcttgcttttctacatgtcttaatccctcagctccctgatagaaatcccttgaaattatgtggcatcaagaataattttatggccagtctttgtattttcacaccatactcatgtgaagaagggcagggacaaagatcagaaaagtgaagcctcataaggagaaacagacaggattgctcagaatctaaacccccttttcttgatatctaggtcactgctttttctactaccttgctcatgaaacgataaggattttcttcccccaaacatgtcaattttgaacataacgaaaccagggtagcagctttatttatttattgtaccaatcaattattaattgatattgatttttaattaataaaaggccaaaagatgaatagcctgctgcctggacaggtgtgcttgtgcccattttccagatgtagaaacaaaggcagagagcccgtgatttgtccagagcaacagaacaagtccttggtgtctccgtgtcacatgtggtggctgaggctgtcaggtcagagagacctgggtcaggtcgaggtctgccacggcctgcctgtgtgcccgcaagcaaatcacttcacttctctaatcatcaggtgcctcatctgtgaatgggatcagaaatacttcatggggctgttttgagtagaaaatgagaggagatatgtaaagtgctgagcccagtgcccagcacagaacatagaggctgtaactgttgttgttgttgttgttgttcttgttggtggtgtttggtggtggtagtaatagtagtagtagtagtagtagtaatagtagcagtagtagttgccaattactgcattgtgactaaacctgttttctgtaagatgatgtcaagaagggtcagactgcctgacaggccagagtcattttctcagtaggacctttagggggacagtccttc

SEQ ID NO: 86691 - DNA, 1034 bp, Homo sapiens
tcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccc

SEQ ID NO: 86692 - DNA, 1124 bp, Homo sapiens
ccgagatggctctgagtacctgatccagcacgactcggaggccatcatcagcacctggcataaggccattgctcagggcatccaggagctggtaagcagagcccagggcctctaggggcagtggggagggggtggccattatgagtggggccctctgctcaggctcagggagctctaaggtaccagtgggtaatgcaaatgcagtccccactaatggctaggatggcagggtaggcggctgaagaaactgccttctgtaagtctgtgaatccagccctggggttggccctgcaggaagactctccaggtgagggtagggcacattctaaaggaagttcccatttcacgggaggcagaaggccaaataaatactctgcaagccaaccaatggcaggctgaaactagcagataaaattttaaaggattgatttcaatagtcgaccatttttttaaggctgaaaacaccaattgcataagtagagctaggacaggggccctctgacaactactgacctggaaatgacctggggctttttgacccttaattccctatgagccaacattgagtgaagcttttggctgtattaatagaggtaggaatccagagccagagaggtgatattggtgcagttgttggcagtgctccggccacagctggaggtgcaggctcagaactgggagccacgtattgaggaatgctgacccagttagaggagctgaggaaaatagagaaagaaggcaccaggtgggtaggagtccccaggataggaaggggtgtgggagaacaggatgactgtctctgcaccttaagggctccatgcagctaagggaggtgaatgttctcaggctcactggtggaggtaaggagagttaacctggttaagggaagagaggactcttcgctgagggtctccaggccatgcctgttgggagtgcatttcgggtcccttgccccatcctggaaggacccgcagctggctcaaggccccgcctctctgaggctatgggaatccagtccgcagagctgcccccagaggagagcgagagcagcagagtggacttcgggtcgagcgagcgcttgggaagctggcaggagaaagaggaggacgcgcgaccgaatgcag

SEQ ID NO: 86693 - DNA, 1053 bp, Homo sapiens
cgtgtgagttttgaatgattttgcagtaaagacctgatctttctcatcactggtctggcttctgaattctaacactgccacggccaggggggagaccaccagccatctgttaccatctgtcagggtcccctaccctcatgttagtccctggcacgggggaaggcttgggaggtccgtggcaaacacttgtaggcagagggcttgcatgccaggagtgggcagggagaagagagtaagaaaaccaccttgccaagcccagcagtcaggctcttcctggggtaggatctcagggtctctggggaggtgtacccacacttgtataacaactcaagctgatcccacgccggtggcttcttttcctgtgacttaaatgtcaaaacacagacccttgacactggatcatgtgaaacctcaggatacaggggacatttctcagaggagaaataaaggagagatggggctcaggaaagaagggttatttaagtggatcccccgattcagggctcatggttttagggctcaaaatgacttttacttggctgctgaccttcctcagaagttccaggagaagcccaggggacccctccaaggggaggcccacaccactgtccattttaagaacaggagcaggaaacagacttaattctcagggaaatcaggttgcagtaaaatgggatggaaacagacaacattcaggtctgagatttcctgtccttaaaggcccctttcagattacaaggtggcaccctctgccaatctaggtgccccagcttcccccaagggcttcacctccctccaggacagtagatggtaggcccggagaagagaagagaaactgggagagggaggcccagaggagggccacagcacgtgacctggtgctgccctgccggtgggttcaggccctctccagcctcagcaaagcgcccctgaggccacttgtttccccttctcccctcccttttttttttttttttttttggatacagtctcactccaatgcccaggctggagtgcagtggcgtgatcttggctcactgcaacctccacttc

SEQ ID NO: 86694 - DNA, 1029 bp, Homo sapiens
acctgaggtcgggagttgagaccagcctgaccaacgtggagaaaccctgtctctactaaaaaatacaaaaattagctgggcgtggtggcgcatgtttgtaatccagctaatccggaggctgaggtaggaggatctcttgaacctgggaggcggatattgtggtgagctgagattgcgccattgcactccagcctgggcaacaagagcgaaaccccacctcaaaaaaaaaaaaaagaaaagtacaatcgttttctaggcatatctgagatcaggaaatcctcagctcgctctccctctcaaagattgctggcctaggaaagacagggaaactcaagatagaaagtagggggcccacgggtttggggccttattgttcgccgttgctgttctggctgacccactggtgctgaggcctggctgacccactggtgctgaggcctggctggcactggcaggatgtcagcccaggagtggggcttctttctgtctcctccattcccgcaggataggaacagtcgctggggagcacaaagcccctgcccatctgcagtgtttggcagtgttcagcgcacattcctgtgtgttatttcactggagcctcacccaaggcctggggccaagtcatgggaagagctgagttaggactggagaacagcagcttgacccaagtcaccaggagtttgccattgggctgtccctgggctggggggctggtacctcagggccccaggctttgggaaaagaagaggttgtccattgctgggggaggtgagagatgctggtggagctgggagacaagaggtcagaggccccctcagcccccaaatacaggggcaggtctcctgagggccagtttagtcccccaaccctcaaggggacaacagggccacaccaggcactcacacagcagctgatagcagctcacatttactggggatgtgccacctgccaggccctatgccaggagctctcctggaatacctcttttaatctgaattcaaaataatcccatgaaaaagaagctccagt

SEQ ID NO: 86695 - DNA, 1524 bp, Homo sapiens
gggagaggcggggattccggatgtgtggaaggcagagccaatgggatttgctgatgtaggctgcgaaagaaagaaaacctggggtaacaccaagatttttagcccaggcatctggaaggatgaattttgctatttggtgagatgaggaccattcaggaggaagcaggctggcagcaggaattcatcctggacatgtcagctgagatcctagtggacatgtatggcacaggtggatatatgaatgtggatttcaagaacaaggtccaggctggcgataaaaattgggagctaaagcctgagagcaggtagagtggtgagaaagtggcatctacagagaggagacaaggacccaggactgacatctgggcactctaacgtgagaggccacagggaggaccgagccagagagatagaagggtgggggcgagggctgaggagtggccttggggtttggcaacgaggagggcattgaccatctcagaaacagtgtcagtagaatggggggagagaagcctacttggagcaggttcgagaaggaatgggagcagggaaactagagaccaagaggttttttgttttgttgagacggagtctcactcctctgtcacccaggctgaagtgcagtggagtgacctcagctcactgcaatcccctgccttcccggttcaagccattctcctgcctcagcctccctagtagctgggattacaggtgctcaccacacctggctaatttttgtatttttagtagagacggggtttcaccgtgttcaccaagctggtctcaaactcctgacctcaagtgatccacccacctcagcctcccgaagtgctgggattacaggcatgagccaccgcttccggccaagatgaacagttttgatgcctcttcaaacaggttttctgtaaaggggcctgagaaatatggtggtcattagggaagtgcatggagacgagaggtgtttctaaagatgggagaaatgacagcgtgcatgtgtgccgatgggagtcaccccatagagaaggaagaaagcagtgacagaggagaggactgctccttgtccttgagtagttggccaagggagagacctcctgcacaaatggagggtttggcctcacgcagaaagaagcacacttggttcatccctggcagcaggagggaaggcgtgggtgtagggaacagggcgtgtggaggggatcttttgggtgctcttattttctcagtgaaatacaggacgcaagagcagcagtggacggtgagaatggggatgttcccatccagctttcagggtcccatgtgatagtgccccgtggctggcctgtgttctggggacagtcactggccacatgcactgcagggcatcaggcagcagaggctgccttgggcaggacagagacaggcccgccaactaatgtgcccctttttgcctctgcctccaggactgtccaacccattccggggtctcatgaagctgggcaccgtggagcggcggggggcaatgggcatctggaaggagctcttctg

SEQ ID NO: 86696 - DNA, 1024 bp, Homo sapiens
gcctggccaacatggtgaaaccccgcctctactaaaaatacaaaaattagctgggcatggtggtgggcgcctgtaatcccagctactcaggagactggggcaggagaatcgcttgaacccaggagtcagaggttgcagtgagccgaggttgcgcgattgcactccagcctgggcaacagagcgagactccgtctcaaaacaaaaaaactttaaaacaaacaactgttgtcttctttcccaacagaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggtaggttaccaggagggtcccgggtgggtcccatctgcagggaccaggcctttcagaaggcagctgtgaagttctgttttccattgctaaaggggtagtgtgttcccacaagtgttataaaacctcattccagaatgccatcataatcatgttcattcagggaagcatttcaggaaaagtagtatattgtctcaaaactgcctacagaggacaaaaatactgtttcaccagtcaaataggaaaatattttccctgaaaactatgcaatttatgattatagaaaactcttgattccacctgtagctcagagcacatccggccccatgaagccccaggtgttttaaatggtccttccaaacgtgtttaccctcagtagttggtttatgtaacagctctgggtggcttgatcaaatctgctatttgttttgtttgtttgtttgttttgagatggagtctccctttgttgcccaggctggagtgcagtggcatgatctctgctcactgcaacc

SEQ ID NO: 86697 - DNA, 1025 bp, Homo sapiens
ctgtggtcctcatctttctgtacttctatcagttagccacgtgctttttatttgatgttattttgggggagatgttggggtcgctgtcaagttttatagtgtagagacccattcagtctttcttttaaaaacatttatttttaattcattgaacccaaagcacctactataagccaagcaccatgttaggtcctaggggtagagtgatacaacaggacagacaaaggccctttggggacagacattaaattagacaaatgattatccacatcataattacacttgtgctaagcactgggaaggagaggtgcagggagtaggggcctctcaagggtgatgcatgtctgggatctgggggttgtgagttcgtttcagtttaactcccaaaaggcagtgtgagttctaggacttgctcttaatcactgcccccatggaccacctgcccatggtatgtggttccccttccacagttatgagtacaggcagttcctttgcctggcataatgaggactggctggacaaagtctcatccttctgaaagtgtcccagagaccttcgtctcactcctcagccacactcctcttggggattcagctgttgtatatggtgtcatgagccctttagtaacgcaaggtggcatttctctgtcttgggtcgctggtggcagttgcagctctggtatagatccttcgtcgatgatggtttctctccactgttaaagggcggggtgctggccagacatggaccctgagtgagcaggttgtcggaaggtggtgggaaaaaaggagagaagggggccgggtgcagtggctcacgcctgtaatcccagcactttgggaggctgaggcaggtggatcacctgaagtcgggagtttgagaccagcctgaccaatatggtgaaaccccgtctgtactaaaaatacaaaaattagccgggcatgatggcgtgagcctgttatcccagctactcaggaggctgaggtaggagaatcacttgaaactgggaggcaaatgttgcagtgagc

SEQ ID NO: 86698 - DNA, 1398 bp, Homo sapiens
caccatggaaagagcaccagcgttgggtggtgttacggactgggcttggagccgacctagtttcgagtcctgttccaccacttacaagcccaggaaggtcaggcacattgtttgttagtcaaacaatataggagattgtctcgtagtcccagaaatggcttctgagcatattaggtggagttttcaaatgttaaatggaggaatttagatagaatacattggggaggaacagtgtctgcctcctgtgaccactgggaccatggcatgacaggcctgcagtgtgacccaggcacagggcatgacctaggttcactcacctgtcttagcccttcctgtgtgtctgcctcctctgcagaccagccagccatcccttgtcatatgtctcgcctttatctcatgtgtcttgtgatggaaaattccagcttaaggtcactgaatcagtgaccatcctctctgtgcaggaagtgttgtcccggctattatggggaaactggagggtcaagggtcaggatgtatagacaaatgccggacagtggtgtgagtaactggcaaatgtaagacatacagatgcacaaacacacagccagcaccagcattcatagagctgggccttgaagttagtccttgagcatccacagagaccagcatttcttgaagtgtatatttcaagggtaaaatgttctcaccgacatttagagttcatcaaagttgttacattatttaaatatttgtaactttaaattagacataaattccttgtgcttatcattacacatataaaatcaaaacatccacaaatcaaacataaagaaaagcataaaagacacaacattcaaaatgaaatttattaatataaagcggttctgtttggcagaaaccaaattgcagttggcctagtgaattgactgtcctaaatagcttcttccgtgtagattggatctgtattataatcatcactgagtggcataggtatagtctggagggtttaagtacttagatttaagtacttagaatggtccctggcacagaggcatcaatagtgctcaattgatggtattgttgtattttattttattcaatattttatttattttttgaaacggagtctcgctctgtcccccaggctggagtgcagtggcatgatctcggctcactgcaacctccgcctcctgggttcatgcgattctcctgcctcagcctcccgagtagctgggattataggggcctgccaccacacccagctaatttttgtacttgttgtagagaaagggtttcactatgttggccaggtgaactcctgacctcaggtgatccgcctggctcagcctctcaaagtgctgggattacaggcatgagccaccatgcccagcctgggtagacatgtttttaattctctta

SEQ ID NO: 86699 - DNA, 1049 bp, Homo sapiens
catgtttttattgttctaaagcagtgtgggtgtttattgtttgtttgtttttgcctcttggcttattgattctctacagaagcttgtccatgtaaaaaaggtgggaagccccacccttgtcctagatggatttacccaagctcccatcactgcagctatgatggggccaatatttaaacacaagattatatggctctaagttcacttaagtttggtctaaaaaacaaaaagtatctatactaaaggacatatgaaacaaacaataacagtaattatctctgggtagtgtgtgtgattttccttttcttctctatgctttatctttctttgctgtagttaacaatgtgctaattttgcagaaggaatctacagacacacacatagatgtgtgtgcatgtggttgcacacgtatttggcaccagctaaaggattacactctagggactctccataggattttccgctaaaggcctgtgttctgtgtggtgctgcctaggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaagtgagatttagctggagaggttttgctttgcggaggagcagcagactatgggacacttggcttttcctccccagctgttcaggaagccaacagaggtgccctgtgttctagcatagagagagggtgaggtaggggttgaaagtgtcttctagaaaggcttatctctagaccaagcttcccagccagtgtgccagcagatcttgagaccctcagcactcaggcaagagcctgtggctgctttgagactggtcacaaaaagcaggtgagactggccacctttagcaggaacagccttttttgccaca

SEQ ID NO: 86700 - DNA, 1080 bp, Homo sapiens
ctgtgttgatcaggctggtctccaactcccgacctcaggtgatccacccacctcggcctcccaaagtgctgggattacgggcgtgagccgccgcacctggctgattgcagttttaaagagccccaaagaacactgtctctgcttgccacttatagtcgtattcctttgaaaagtgaatgctgtttaccttcaatgtcctcccattaatatgcagtatatttaagttgttttcagccttattggcagcttggcttaatgacaggagctccacagttgccccagcacttaagagttgtataccccaacttcccacagtgtgtgaagtggaggtacttaccccgtgccttgtttttattttattaatcaattcattcaacagcttattttttgagcaccagtgtgtgacaaacactgttccaggtactagaaatacaatggtgaatgggtcaggcaacggtcctgttttcattcattcagagtttggtccttgttagaatcctctgggatatgggacaagaatacaggaaagctgggtgatactggatggaaggaaggagggaggaaagaaagatagctagtgttcactgactccacaattctgccctcatccactagccctgagtctgggaatcacaagctaaaagtttctcacccttcatctggtatttaattgcttcaaagctccaacccccaccactccacccatcacagaaatccagctttcctcaggtggacagaggtgcagtttcctcagtcagcactcacatgcctgaaagatcagctgcctttctgaatcagaggataactttgtcattcttttccaattgaaaaaacatgactcatcaattggtacagcagttggatggcttaaagccaggctgtggctctgaacagccagttacacaattcaggcagtggagagaaggccgtggggagtggctgaggagtccctcaagagaagaggttgctgttcactgatggtggagtgttttgagagtggtggaaccaggttatccctttcttcttttaacgtaagtctcatccaagtcattctctttttttgcttccttgatctctgga

SEQ ID NO: 86701 - DNA, 1028 bp, Homo sapiens
acccccatcccccgtctagctccccaagatctgctcatcccaaacattctacctccgccctctcatctaagacccacccccaaagtaggtgccctgttgagctcaccgctttcttctggataactccgatctcagccttattccaagtcttaactgtgtcttctcgtccttagtctcctagccactgtataccttcctttgcgtctcctgccgtactgaggacagcccatccctaagtctttgccaaactgtcccgaactcttgctgcctcctttcctaccaccctcacccaatcttgttaaaaatgacatctccatgtcctttcacccccgctgacccaccgcaactcttcaccccaactctgcgtccattgcttccctcgacccaactcccattcaacctgagaacttagtgcagagtcgcctgccaactccaccagctgcccctcaacagccaaatgtaggtgctcactcagacccgcagttacagactgagcagcatgattggcgggtgcaggggctcaggtggtaaataagggtggaggagcagtgggctctccccaactcttgggtggggccggggtttttcctggcatctggtctcctgcacctgtcctcagggattgtgtttttggcattcatattaaatgacttgtgctggctgctggaatggtaggtatcattcaaatatctggaaggtgagagacggccactcactcagctcacttagcacagaatgatggaagctgtcacttccttctggttggtgttctcgccctggagagcttctgggaagttctgtgtggtgttggctgtggtcacagaatattgttcgtgttccttttcttggcacttgtaagggcctctccctgccagagctgatggcagatcagtcctgatgctgaattcaggggatatgatgggtgccagaggcaacgttacctgttgtgaagagtataggtgagtaggtcctggggaggctgaggcctaggtgggtacagaggctcttgaatcgctttcttttctttt

SEQ ID NO: 86702 - DNA, 1034 bp, Homo sapiens
ttgttttttgttttttccgagacaggttctcactctgtcacctaagctggagtgcagtggcaccatctcagctcactgcaactgctgcctcccgggttcaagcaattcttttacctcagcccccccagtagctgggatcacaggtacgcgtcaccacgcctggctaatttttgtatttttagtagagatggggttttgccaagttggcctggctggtttcgaacccctgacctcaagtcatctgcccaccttggcttcctgaagtgctgggattacaggcctgagccaccacacctggctgacagattgttgttatcattaatgtcacatgaactactgccaaaggcgtctccccttcttgtgcttggagggtgtgttggatgccacctgtgcccctccctggagatgcttttggccccacagcttcctccagccaatgtagcagtgactgggtctgtgcaggttttggtcaccttcactcaggtgtgatggggtggtgcctttctttggcctgccccaggtatcttttactttttgggatgtatttgatgctatagtatggaatgctgcagagacttccggcaccaaccccctggagttggactttatttcacaggttgagggcaccatcctccacaagaatccccaacttcagccaccagctggcaacaggtttgggggtcctcagcccaccctcacttctggccagatggctacaaatttggcgatttccactaccccctcaggtttgatcacttgtcagaatgattcacagaattcagggacatgctatgcttacaactacagttttattaattgatcaataaagcaaaaggatataaatgaaccagtcaaagggaaagacacatagatctgggaggacaccaaacgcaaagctttcattgttctctccccgtggagtcaggggctgttacctttccagcacatcgatgcgtgacaatgtatagagtattgccaaccagggacgtgctcctgagcttcagtatttgtcatttttattggggcttccttgc

SEQ ID NO: 86703 - DNA, 1034 bp, Homo sapiens; identical to SEQ ID NO: 86702

SEQ ID NO: 86704 - DNA, 1034 bp, Homo sapiens; identical to SEQ ID NO: 86702

SEQ ID NO: 86705 - DNA, 1034 bp, Homo sapiens; identical to SEQ ID NO: 86702

SEQ ID NO: 86706 - DNA, 1120 bp, Homo sapiens
attttttttgaaacagcctcccactctgtcgcccaagctggagtgcagtggtgcgatctcagctcactgcaacctccgtctctcgggctcaagcaatcctcccacctcagccccctgagtagctgagactatgggtgtgcaccaccacacctggctaatttttgtattttttgtggagacagggtcttgccatgttgcccaggctggtctgtaactcctgagctcaagggatccacccacctcagccttccaaaatgctgggattacaggcatgagccactgcgctaccgagaaatcgtcattctttaccaccactgctgcagctagcagctcactcttcagtgctttaagcaaatgatcctcaggaaagaaaaggtatttgcttattgcaggtgcaaagaggctcagattggaacttttccctgaaactatattgtagcccagagttcctgatgtaagacgctttatttaaagacatccgtgagctttttcactggcatatcaatacttcataacactaggaaggtatccagccttttccttatgctagttccttcccttatttgccagatggggaccctgtggggaggtgacccagtgtgaggccgaagctctttcccagagccccacaggccagtggagggtcgtgtttgtgctctgggcatcaccgtcttgggtctcggtcccctgcgactgcagctgctacatccctccctgctctgagataaatgttcttcccatgaagcagacggttcacttttgggatggcgctgtctccaggtttggctgtctcagtccagatgatgtttggttagtttccattcccagaaccacaagcctttgagttctgaaagtttgtgacagaatcaagaggctaatttgggagatgtgagattcccagcccacctggtattgccctcgagttagtggtaaattttgctatggaaaatatctcttgtcaagaccaagctccggcgcattgcctccctcttttggatggccatggcatctcatgaaccacttggaaatgtgttttatgttgttctccaaatattaataaaaatatcccggagaggaggttcactaagtagcctagagctcgtttgtccagacaattgtt

SEQ ID NO: 86707 - DNA, 1154 bp, Homo sapiens
gtttccctggagatatcttgtccaagtatgaacagcagtgctggccacaaactcatcagcattattattattattattatcattatcattattattattattattattgagacagagtttcactctgtcacccaggctggagtgcagtggcacaatctcagctcactgcaacctctgcctcctgggttcaagcgattctcgtgcctcagctgcccgagtagctgggattacaggcgtgcaccaccacatctggctaatttttgtatgagtagtagagacggggatgcactatgttggccaggctggccttgaactcctgacctcaagcgatctgcccgccttggcctcccaaagtgctgagattacaggcgtgaatcactgcgcctggccacttttaaaacatttctatcaccctgaaaagaaaccctgtaccctttagcagtcactcctcatttcccctgtcctccgcagcactgggcaaccactaaccactgacctacttcctgtctctagatctggtggagatgctttttaaacttttttttactaccctgtggtccctgaggagcattacactgagaagttttctcctattttgtctttcattctccacatcctcttttgttctagtgcatggcatgggaagccctctctaggaggatgctgtggccacacaagtgctggacgaaccgctggagtaggtgacttccaaggtgtcctgatgtagtagctattagacaagctcctgcatttggccagtaattagcatgctgctgcacattgccactaggtggtgctgctgctccattcccaagtaacccacatgcatccctggctggggtcagccttggggtttcccaagtgtagaggaatccatctctgtgcctgtggtaatggctggacaccaggagagacccagaaaacagggatatcctagaagagaaaggcaaaataagcactcagagcagaggacatttgagtgtcaataatgaaggtggcagcagtaatcatggctatcatttactaaaaatagtggatattggccagacatggtggctcacacctgtaatcccagcattttgggagaccaaggtgggtggatcacttgaggtcagcagttcgagaccagcccggccaacatggtgaaactatct

SEQ ID NO: 86708 - DNA, 1030 bp, Homo sapiens
ttataagcctatctgattgcagatcaacctcagacatacccatctgtagtttctggaatccaccttctctctctcacaaacctgggcgacatttgctcatctctaatttttctccacccttctcagcttcctgacttctcaatatttacagtaggagtttgcaatcacacagtaaaggtcttggatatatttagttggagttaagagcgttgggctcccataaagcagtagggctctccttgagtttagtttatatatatttagttggagttaagagtgttgggctcccataaagcggaagggttctccttgagtgctgcatcatctgtcttagatcccgatttccccataatcatgtttattatcctttccaggttgaagattattctctcttctaaagaaaatagaagaatattaggagaaaagacacttgaaaatgttcactcttttattcacattacatcatctgtcttgaataatgggtctatctctttcctgttgctctggccctgaaaaaaaaattagctttttaaggctgcttttgttacgtgtgcattttcttgtaatcccgtcattctgggatttaataataatagtattaataccacctaccatttgttggttacttactgtgttttaggcactgtgctaaacgccttccatgtattcatctcattagtaaacatttctgaaactattcttacaatttgtcttttagtttttcttgttcttgtcctcttaaaatctgagcttagccatgagctctcagtgaagctgcttgtatttctttaaaaaccctctttgcttcctccaagtggagtgggttgtacttctgaggtcaggacaaactgggcaccggaggagttcagccttccgaggctgcaggaggggtgggtcccctgaggcgagcaagatgatgtaaggccttgacttggggtaacagacagccacagatgggaagagagaagccaacatttaaccacggaaggatgtgaagggcggagaggtgggttgagcactgggccccggg

SEQ ID NO: 86709 - DNA, 1059 bp, Homo sapiens
tccagcagggccactgcaagagtggggaatgcagaccacctccagtttcggggtgggctgggtacccaaaggaagatggagactcaagccccaggatgtcgtttccctcacaaggtccatccccatgctacctggacagtagtcaagacccttctacggatgatcccattcaaagcacctgtttggcacccctgatgaacctggcacttgtggggaacatgaggaaggtcagacatgacccttgtcagcctgtatggcgctcctagtctagggggctggggaaacaggcacccagagaaattacagggtgctgtggagtgtgctacacatgaaggtaaaataaccgggcagcacggagggaaaagttagctcagctcattcgggaagctggaagccacccatggaccttagagtgaaacaccagccacccatgggccttagcatgaaacaccaggctgtgtgacttctgaggacctcagtttccttattagtaccatatggcagtaactatttatggagttgggagagtcacatgaagtcatgtccacacagtgcatccatggattggaccttcaagcggaatttgccttgtggaaagatctagaaggacaccaaaagcagcaagggcaacatggatagaggcatggctcggcagggcactttgtgccgactcagcgatgggtccatgctgtgacttggagagactcacttttgatggtccagcagcgttcaggttcaatgactcagtaattcttgattcaatgatgtggtcatttgaagatttgtgggtaccggcgattaagtaagcagagtgtttataaatctaggctgctgataatcataataataatcgctgctaaaaaatgattgagagcttactatgtgccaggctgcgcacagcatttatggattaactcacggaatcattaggtcacgctaatggaagggacttgggtaatccctttgccaaggagccacctgtcacctttagtttcagtttattcctccccctcccattcttactcaggcctccccacccttacctccccataagtcatg

SEQ ID NO: 86710 - DNA, 1001 bp, Homo sapiens
actgtcttttccccctgtttggtttcagtctccattcctgactatggatttctgtgtgtctcaatgttctcaaaagagaaagcatttctaatgcccttgaatcagcctatggatgggagagtcacttgctcacctctcatccatctcctgtagcctagaggggacaaagtcgcatggtacatgacgggagggcttccctcttcagtgccagcagaaaggagtatggatctaggaaggcagttgggcagggaaggccaaatggctaggactcaggcacaagtcctaagaccatcctgcagaccagggctcccagtgtggattcagggagaaaaataaaagggctgtttccacagtgaccctgcctgaactttaggctgtatcttatttttttaaatttctttttctcttttcccccctcattcttgctgtcatcttataagctttatctttgtggtctcttcactccagcccgactcacccactcaccagtgcctacttctgctcatgtcctctccctggccaactcatttccattgattcaaatcctatccatccttccaagctcagctctgccccatctcctgccggggtactgccttgatcactccagcccttccatctcccctcctctcttcctctcattcttatgtctcttcctggttattttcagcttccctgacccttcatgtaaactgtctggtgatagatggcctttgtagggtcgtcttgtattgccacttatttctggtaatttttcatgccttgctttccaattggtcaacaggacaaacatcacacaccccctcaggtctttcctgggcacataaagatccttgtagacatgcacagccatttgcctttggggcaagaaggctttaaccaccatcaggtcaaatctgagagatgaggaaacagaagtctagagaagaggagtattttgccccaaatcacatagtcaaggtcagcgtggaattcaggtctcttggctctttacccaggca

SEQ ID NO: 86711 - DNA, 1030 bp, Homo sapiens
attataatatatattatatattatatattatatatatttttatatatataatatgtataatatataatatatataaaaacatatataatatatattatatattatatatatattatatatattatatatattaaatatattttatatatattatatatatatacacatatatatatataaatgaggccaggctcggtggctcacacttgtaatcccagcactgtgggaggatcacttgaagccaggagtctgagactagcctgggcaacaaaacaagatcctgtctctacaaaaggaaactgtaaaaattagctgggcatgatggcatgtgtctgtagccctagctacttgggaggccgaagcaggaggatcgcttgagcccaggagttcaaggctacagtgagctatgattgtcccatagcactccagcctgggtaacacagcaaggccctgtctctaaactttttttttttaattctatttatatttacatgtatttaaatgtgaatattcactacctatttgttgcatgcctgcattttttatactgggcttgccaaaaacccgaacagctttctactttgacaatgtatcagaatttaaatcagcaatatgttaataagccaagcaaaggttatatatgcaaataaaactgttgtctataacctcctgttacactggggcacagcaaaagtcatggtgtagtcgcatgtgaacctgtccctttcatagctgctcattgccaggaaacatcaggaatagccatttggaagagtcatcagccctcccaccatccgttttctgtcttgtcttttccctatgagcaggggaaattccacgctggccccaatccccagtgcagcggctcagcctctgcctctgctgctggtccccatgaggccagcttagaaacggaggattttgcagaacatccctaaatccgcttgaataatgaagtgatcattcataaactcacctgaaccttattaaaacctatttaatatttttcctggataatcctatagggata

SEQ ID NO: 86712 - DNA, 1088 bp, Homo sapiens
taatccaaaggtggatgcttggggagacacttgggccagtttttcaccccaagacacaagatccaaatgaacgtgcagagcctgaagaagtactgagaaaggaaccttgaaactccatggggaggatggaaagatagaggggcagatactgccaactagtgactcaaaagccactattaacgttcttcccccttggtttattctgctaaagaggttggacggcaaaatgctcaatgtcccagccttgctcgcagcaaggggtggccgtaagacccagctctggccaatgagacataagcagaagattgccacttgcaagaaaactcctgctttcctaaggggacacatttagtttcagggcccttttggccactttactttgcaacttgttcctgcttcaaaggcagatgtgatgcctggaagtgcagcagccactttgtaaccatgaggcaacaatccaaccactaaagatgacagaaaataaagacaggagagcatcaatgacccttgaggtgctggccaagtctagacatctgattatgtgagaaaagtaaacctcttcatgtaaatgccacagttagttggggtttctgtttcttacagccaaatgcagtcttgactgacacagatgggaagcaagagaagatggtcaaaatcaggactgaggagcatgtcagaaagtatgcgaggtgctaataacctagatgccgagtgtctggaaaggacaggttaggagaagggctggaacaaacaccgtggccaaagtccagaggcccaggccacacccagagcccccaaaatgaaggatactaaaccaagatcagatgtccactgacctgccccttccctcagccaaatggctgctctgggacctactggcccctgaagaaagagagaggagggggcttttgaagggggtgtgggaggacaatcgtatggagcggggctttgtggagctgtgcgcgggactgtccaagggtggctgcctccagagcacacacgggatgaaggtgcccacactcagcaccagcaagcaaggcatcgacgcaaggctcagctcccaccacgctgtcctgcaaagcaccgaa

SEQ ID NO: 86713 - DNA, 1803 bp, Homo sapiens
ctcttaaacatgatctgaggctcccatgcactctgacctgtgcccacatggggcccacgggaaacacgctggcaagcaaactgtgggtgtgcagacggttctcagggctgcagcacctgtcctttgctctgcccccaaagcaaggccagcccatcttccatcctctagtgttccttggtggggccctgaccacagtccaccaggtccctaaccagaggggacacacaccaggtgtcctcaatgtattgccttgaaacagttgtgctgggactgtgatggggggtggccatgtagccacccccaccacccccaagccactctctccaaggaaatcctcctaaagatccctttacatcctccatgtggtggggaggttctagagttgggtgcatgtgtcttcagctactgacaatgcagaccttagttggcacctcgctctggcctatcctgtttgctgttcttggcgctccagtgaaactccccatgggccatccagttggggtgcagtgtggccacccccttgcaggttcctgccttgctggagagcacagggccctcctggctcttgtaaaacactccccatggtacagagaggccagcagtgatgtgaggcccaacctccctccatggtgttcccaagcagctccctttctggggtcaaggggtggcaaagacagtgcagcgtccaatttctgactcaagccgggcctggctatcgcagctctgcactgtgtgtgacagcaaggcaactcacccagtgccgtggcagtgaccgtgtccgaggaagcctcctcacaccctctgtctcaaggactctggcatttagctggacttgctgtagctctgagcctttctgccattgccatcaccttgtcagaaactcaggccgaatctgcactcagagttgtgcccaggcagttgagccaacacttgctcagcgatattgtcacatgacaaggcactgtcaccactgggcatcgtgggtagcgcagtgtcggctggatggacccggagggtgtctgtgtcatgctagtgctagtgatgggagccccgtgagcccattgcccgccctcccatgccctcagcagctgcctggggacagccaatggcctgggtgtttctgaggctaccacatggcttccaggaaactcgagaacctttctctcccttgcctacactcttcacacaggcctgtgctggccagcggtggggatccggcattcctatcttaggtgcagagagtgactgactcattgcaggcctgggagataagactgatggcccagccagcaagatgtatggatttctcagaggcagtggcctctgtcattgtcctcaggaaatgctggtgattctggtggcctgaggtcaatgcatgtcaacgtggccaacttgccttataaactttttttctggacaattgcgtgcactgtcctgtaacagtgtcctgttgtttatgatgcagaaataggtgtttttaaagcctattgattttggtactattaatgtggtcaggaactttctcagtctttcttgtttggggtgagctgtggcttcctaaacaggaacccaagacacccccaaaagctgctcaccagcactgccagcctccctcttaccaagtagcacccgttcaggacattctgcgaaaggcatttgcccagaagttgggaggaaggaaatgtaacattttggggcacctaccatatgccaggcaccaggctaaacgtgttcacacaaattctcttactaaccctcaccatccttctacaagacaaactagtatcttcatcttggggttca

SEQ ID NO: 86714 - DNA, 1057 bp, Homo sapiens
ggcaggacaatcgctcgaacccaggaggtggacgttgcagtgagccgagatcgcatcattgcactccagcctgggcaacaaaagcaaaactccgtctcaaaaaaaaaaaagaaactcaaatatgtgtgacaggcgattctcactgcaggctgccctgtggctgatccaggagcaaggccttaaccatgtcatccccaagcgattgcttgtaaactttcttctgtgcagccttcaacccttattatgattttcttctcaggaaccaaactgctgtattcaagaaaggcagctttgtgtaatcatttatcataaatatcttaagaaaaatcctagagattcctaattttaggaaatgggagacctatggtactgatataatgtgggctgggcttgttttctgtcatttgctagataaatgaacttgagagcctactgtaaaatgtggaagcttctagattgcagaagggctggaaagacactgttcttttctcccgagtgatgggatctgtccagtatttagagctgcctctgaggccatctgattctaggagactctgcctcgttgaggatattttgaggcctaactacacattcctgcccccagagaggtcacagcctatagcaggctgatgtttctcatgtcacatggcacagaaaggcacattttcgttctcaggctaacaaagagcttcaaaaactattagaagggacagtggctataagagaagaacctcagtcaatgtgtgaaattaactaggaacctggctcctgtttcttttaggtcatgtttttcagcttaggtaaaactagaggctttgataaagcatgacctctagaaatcattgcttttcataaatggaagtgggtttgagttttttctactgattgttagtgcaggtgatgtctacatgcccccagaacatattccatgcaacaaaaaaagcccaggtcaccgtctttgctgggaacttgacttttgtgctcactgaattttaagctttctgacagcagcctggaatcatggagggataaagtacctattagtaagatggaaaaa

SEQ ID NO: 86715 - DNA, 2248 bp, Homo sapiens
caaaatcccccacgggcaggacgaactgtgggtgtcagtcaccatctatcctgcatcctggttccagggccccccccagccccgcctccatagggacaggcgtgcagacacccgtccctggctgcttcctcttgtggaatgggttcaaaagtaagcagtgttgtttacactgacaaactgaaaaaaaaagaaaaagagataacattggaggcttggcacagtggctcatgcctgtaatcccagcactttgggaggctaaggtgggaggatgtccccagcccaagagttctagaccagcctgggcaacatagcaagaccccatctcaaaaaaaaaatttaattggccaggcagaggtgggaggatcacttgaacccaaagggtggaggctgcagtgagccgtgatggcaccactgcactccagccagggcaacagagggagaccctgtctctaaaacaaacaaacaaacaaacaaacaaaagagttaacattggccagattaggattcaccagatagtgttaatattagtttgatttgagactttaatcagaaagcacatgtgtggtgggggtgggtgtaacctaagtcaggtagaatctttccaacttggggggggcacactcctgattgtagccatatgagtctgtcagtgtggtggaagaggccatgggttaatgggcaggtaaaaaagcaccttgcctggaattgagtagaaagtaaggcccttcagaccccgtgacacacttggggacattttcttgagtaacatcctaagattcatgtaccttgatgatctccatcaacttactcatgtgaagcacctttaaaccagtcgtctccaaattcaggggcacagtaacatccaacaggctggagaaagaacgtactagaacttccattcctttttcatgtcctcttctaaaagctttgtcagggccaggcgcggtggctcacgcctgtaatcccagcactttgggaggccgagacgggtggatcacgaggtcaggagatcgagaccatcctggctaacacagtgaaaccccatctctactaaaaatacaaaaaaacgagccgggcgtggtggtgggcgcctgtagtcccagctactcgggaggctgaggcaggagaatggcgtgaacccaggaggcagagcttgcagtgagccgagattgcaccactgcagtccagcctgggcgacagagcgagactccgtctcaaaaaagaaaaagaaaaagaaaaagaactgtgattggggaggacggtcactttcctgttcttactgatcagaagggatattaagggtacctgattcaaacagcctggagatcactgctttcaaccattacctgccttatttatttttagttactgtccttttttcagtttgtttccctcctccatgtgctgacttttattttgattttatttatgtttatgtttaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaaggtaaggaaaccacctttgaaaagaaccaggctgctctgctgtggtttgcaaatgtggggtttgtttatttgttttttagcctcaaagacctttcttcaaatgagttctggcatagaagcaccgtgtaaaatagttagaattctgggcaaaggggaaaagagagctgggggccatccctctcagcaccccacaggctctcatagcagcagctcctaagacacctggtgggaccttggtttcgaaatcgctactctaaggctgggcacggtggctcacacctgtaatcccagctctttaggaggccgaggagggtggatcacctgagatcaggagttcgagaccagcctggctaacatggcaaaaccctgtctctactaaaaatacaaaaattagccgggcgtggtggtatgcgtggtggtaatcgcagctactcgggaggctgaggcacaaggattgcttgaaccccagaggcagaggttgtagttagctccagcttgggcgacagagcaagaccctgtcgcaaaaattgtttaaaaaacaaacccaaaattgctactctcattgggttcctttgcccattcctgattttggcaagagaaatgcttcc

SEQ ID NO: 86716 - DNA, 1097 bp, Homo sapiens
gatgtgaagacgtgaagcagcacagagcctggaagcccaggatggacagaaacctacctgagcagtggggctttgaaagccttggggcggggggtgcaatattcaagatggccacaagatggcaatagaatgctgtaactttcttggttctgggccgcagcctgggtggctgcttccttccctgtgtgtattgatttgtttctcttttttgagacagagtcttgctgggttgcccaggctggagtgcagtggtgcgatcatagctcactgcagccttgaagtcctgagctcaagagatccttccacctcagcctcctgagtagttgggaccacaggcttgcaccacagtgcccaactaatttcttatattttttgtagagatggggtttcactgtgtcgcccaggatggtcttgaactcctgggctcaagtgatcctcctgcctcagcctcgcaaattgctgggattacaggtgtgagccaccatgcccgaccttctctttttaagggcgtgtgtgtgtgtgtgtgtgtgtgggcgcactctcgtcttcaccttcccccagccttgctctgtctctacccagtcacctctgcccatctctccgatctgtttctctctccttttacccctctttcctccctcctcatacaccactgaccattatagagaactgagtattctaaaaatacattttatttatttattttgagacagagtctcactctgtcacccaggctggagtgcagtggtgcaatctcggctcactgcaacctccgcctcccaggttgaagcaactctcctgcctcagcctccctagtagctgggattacaagcacacaccaccatgcctagcaaatttttatatttttagtagaggaggggtgtcaccatgtttgccaagctggtctcaaactcctggcctcaggtgatctgcctaccttggtctcccaaagtgctgggattacaggtgtgagccaccacgcctgcccttaaaaatacattatatttaatagcaaagccccagttgtcactttaaaaagcatctatgtagaacatttatgtggaataaatacagtgaatttgtacgtggaatcgttt

SEQ ID NO: 86717 - DNA, 1053 bp, Homo sapiens
cataaatgttctacatagatgctttttaaagtgacaactggggctttgctattaaatataatgtatttttaagggcaggcgtggtggctcacacctgtaatcccagcactttgggagaccaaggtaggcagatcacctgaggccaggagtttgagaccagcttggcaaacatggtgacacccctcctctactaaaaatataaaaatttgctaggcatggtggtgtgtgcttgtaatcccagctactagggaggctgaggcaggagagttgcttcaacctgggaggcggaggttgcagtgagccgagattgcaccactgcactccagcctgggtgacagagtgagactctgtctcaaaataaataaataaaatgtatttttagaatactcagttctctataatggtcagtggtgtatgaggagggaggaaagaggggtaaaaggagagagaaacagatcggagagatgggcagaggtgactgggtagagacagagcaaggctgggggaaggtgaagacgagagtgcgcccacacacacacacacacacacacgcccttaaaaagagaaggtcgggcatggtggctcacacctgtaatcccagcaatttgcgaggctgaggcaggaggatcacttgagcccaggagttcaagaccatcctgggcgacacagtgaaaccccatctctacaaaaaatataagaaattagttgggcactgtggtgcaagcctgtggtcccaactactcaggaggctgaggtggaaggatctcttgagctcaggacttcaaggctgcagtgagctatgatcgcaccactgcactccagcctgggcaacccagcaagactctgtctcaaaaaagagaaacaaatcaatacacacagggaaggaagcagccacccaggctgcggcccagaaccaagaaagttacagcattctattgccatcttgtggccatcttgaatattgcaccccccgccccaaggctttcaaagccccactgctcaggtaggtttctgtccatcctgggcttccaggctctgtgctgcttcacgtct

SEQ ID NO: 86718 - DNA, 1097 bp, Homo sapiens
atccacaggtgattctgatgcccggcaggcttgagaacagccgcagggagttctctgggaatgtgccggtgggtctagccaggtgtgagtggagatgccggggaacttcctattactcactcgtcagtgtggccgaacacatttttcacttgacctcaggctggtgaacgctcccctctggggttcaggcctcacgatgccatccttttgtgaagtgaggacctgcaatcccagcttcgtaaagcccgctggaaatcactcacacttctgggatgccttcagagcagccctctatcccttcagctcccctgggatgtgactcaacctcccgtcactccccagactgcctctgccaagtccgaaagtggaggcatccttgcgagcaagtaggcgggtccagggtggcgcatgtcactcatcgaaagtggaggcgtccttgcgagcaagcaggcgggtccagggtggcgtgtcactcatccttttttctggctaccaaaggtgcagataattaataagaagctggatcttagcaacgtccagtccaagtgtggctcaaaggataatatcaaacacgtcccgggaggcggcagtgtgagtaccttcacacgtcccatgcgccgtgctgtggcttgaattattaggaagtggtgtgagtgcgtacacttgcgagacactgcatagaataaatccttcttgggctctcaggatctggctgcgacctctgggtgaatgtagcccggctccccacattcccccacacggtccactgttcccagaagccccttcctcatattctaggagggggtgtcccagcatttctgggtcccccagcctgcgcaggctgtgtggacagaatagggcagatgacggaccctctctccggaccctgcctgggaagctgagaatacccatcaaagtctccttccactcatgcccagccctgtccccaggagccccatagcccattggaagttgggctgaaggtggtggcacctgagactgggctgccgcctcctcccccgacacctgggcaggttgacgttgagtggctccactgtggacaggtgacccgtttgttctgatgagcggacaccaag

SEQ ID NO: 86719 - DNA, 2180 bp, Homo sapiens
aaatagatttggcttcctctaaatgtccccggggactccgtgcatcttctgtggagtgtctccgtgagattcgggactcagatcctcaagtgcaactgacccacccgataagctgaggcttcatcatcccctggccggtctatgtcgactgggcacccgaggctcctctcccaccagctctcttggtcagctgaaagcaaactgttaacaccctggggagctggacgtatgagacccttggggtgggaggcgttgatttttgagagcaatcacctggccctggctggcagtaccgggacactgctgtggctccggggtgggctgtctccagaaaatgcctggcctgaggcagccacccgcatccagcccagagggtttattcttgcaatgtgctgctgcttcctgccctgagcacctggatcccggcttctgccctgaggccccttgagtcccacaggtagcaagcgcttgccctgcggctgctgcatggggctaactaacgcttcctcaccagtgtctgctaagtgtctcctctgtctcccacgccctgctctcctgtccccccagtttgtctgctgtgaggggacagaagaggtgtgtgccgcccccacccctgcccgggcccttgttcctgggattgctgttttcagctgtttgagctttgatcctggttctctggcttcctcaaagtgagctcggccagaggaggaaggccatgtgctttctggttgaagtcaagtctggtgccctggtggaggctgtgctgctgaggcggagctggggagagagtgcacacgggctgcgtggccaacccctctgggtagctgatgcccaaagacgctgcagtgcccaggacatctgggacctccctggggcccgcccgtgtgtcccgcgctgtgttcatctgcgggctagcctgtgacccgcgctgtgctcgtctgcgggctagcctgtgtcccgcgctctgcttgtctgcggtctagcctgtgacctggcagagagccaccagatgtcccgggctgagcactgccctctgagcaccttcacaggaagcccttctcctggtgagaagagatgccagcccctggcatctgggggcactggatccctggcctgagccctagcctctccccagcctgggggccccttcccagcaggctggccctgctccttctctacctgggacccttctgcctcctggctggaccctggaagctctgcagggcctgctgtccccctccctgccctccaggtatcctgaccaccggccctggctcccactgccatccactcctctcctttctggccgttccctggtccctgtcccagcccccctccccctctcacgagttacctcacccaggccagagggaagagggaaggaggccctggtcataccagcacgtcctcccacctccctcggccctggtccaccccctcagtgctggcctcagagcacagctctctccaagccaggccgcgcgccatccatcctccctgtcccccaacgtccttgccacagatcatgtccgccctgacacacatgggtctcagccatctctgccccagttaactccccatccataaagagcacatgccagctgacaccaaaataattcgggatggttccagtttagacctaagtggaaggagaaaccaccacctgccctgcaccttgttttttggtgaccttgataaaccatcttcagccatgaagccagctgtctcccaggaagctccagggcggtgcttcctcgggagctgactgataggtgggaggtggctgcccccttgcaccctcaggtgaccccacacaaggccactgctggaggccctggggactccaggaatgtcaatcagtgacctgccccccaggccccacacagccatggctgcatagaggcctgcctccaagggacctgtctgtctgccactgtggagtccctacagcgtgccccccacaggggagctggttctttgactgagatcagctggcagctcagggtcatcattcccagagggagcggtgccctggaggccacaggcctcctcatgtgtgtctgcgtccgctcgagcttactgagacactaaatctgttggtttctgctgtgccacctacccaccctgttggtgttgctttgttcctattgctaaagacaggaatgtccaggacactgagt

SEQ ID NO: 86720 - DNA, 1041 bp, Homo sapiens
accacgcccggcctgaaagggttcttatttagtgtgcattttgacattcaatttaattccaaggtcttgtggggtcatggtttacaggatgttgatatagaaaagacttcacttaatgggccgggcgcagtggctcatgcctgtaatcccagcactttgggaggccgaggcaggcagatcaggaggtcaggagattgagaccatcctggctaacacagtgaaaccccatctctactgaaaatacaaaaaattagctgggcgtggtggcaggcacctgtagtcccagccactcggttggctgaggcaggagaatggcatgaacccgggaggcggagcttgcagtgagcagagaccatgccactgcactccagcctgggcgacagagcaagactctgtctcaagaaaaaaaaaaaaaaaacagactttacttactggaagccaaccaatgtatatttagagtaatttttcctgggctgagctgtcatttacttttgcagtatctcaagaagaagagtttacagtgtaaatatttgatgcacactttgattatatagatgaagcaaactattttcaagagctttgcaaggacttacttgtatccaaacaccattctaaaggagtcttacctacttctaaaggctggtctctacttggaaccacttgcttggccctggttcaagtcctgctgcaaacctggaagtcctgtcattgtcttcttccctccagagcagtggcacccaatctaatttttgctgtgccccagcagcccctggcactttgccctgtagactgcagacctcatgtaatgtatgttaagtccacagaaccacagaagatgatggcaagatgctcttgtgtgtgttgtgttctaggaggtggccaggtggaagtaaaatctgagaagcttgacttcaaggacagagtccagtcgaagattgggtccctggacaatatcacccacgtccctggcggaggaaataaaaaggtaaagggggtagggtgggttggatgctgcccttgggtatatgggcattaatcaag

SEQ ID NO: 86721 - DNA, 1525 bp, Homo sapiens
tgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaataaggtctccattcatggattccaaggacaagaaagtcatatagaatgtctattttttaagttctttcccacgcacccttagataatttagctcagaacaggaaatgatagtattaataaaagctggacatcaggattaacagctctctctggggccctgaaggtgagagttctcagacttgctcatttgcagttgcttctttgtgatgctggcaaaccatcctagtcccattcaaagggcaatacaaagccttgtggctgacctcacgatgcagcactcagtttgcaagaccggcaccagtgtatgcaaacctgagaaggttggggatgaggatatgggatctttcatccctggaaatttagtccagaggcctggggctggagcagaacaccaagccaatcagcttaatgaatggcttagattcctgctaggtttgcagagctgccttctttcctttggtaccttattatagattgaggagtat

SEQ ID NO: 86722 - DNA, 3898 bp, Homo sapiens
cacagtctctcagcctcagccttaccctaggccgcttctctcatttctggccttcttgggcatttgagtaggtggccaatttcacaggccttgacagggtagggagactgagctgtgatagggcagagcctacccggcagagagcagtgtcacccacaggtgcaggattctcatccttgcatggacactttgaccctgcccccagttttagcctgcttgccatctcatgattgtctgttcttggttttgcagctggcgggaggttgatcttcagtctctgaaggggagtcctgatgaggagaatgaagaggtaatggcctggttcttctgttagaagaacacgtgtgtacacatgcacacatacatatgagtgcacacaccctaaatggcctgaagacttgtgggtgtgaagtgcaagctccttgtattcctgtcgtgaccgggaagaacctagaatggggtgggactggttcttaactcctggagaaaagaggggatcgatgaagctgctctattgcagattgaggacctatccgacgcagccttcgccgccctgcatgccaaatgtgaggagatggagagggcacggtggctgtggaccacgagtgtgccaccccagcggcggggcagcaggtgatggggcaggcttgggtccccagggcctgtggagagagggtggacagggagtttgggccctacttgagtccatggaattgctactgcctcttggttgctcatcatactcatctactggcagtggcaaatagctcagaatttccttggtgtttgttggaactagtggagatacatggaactagtggagatataaggagccaagtgctagatccttgctgagaagtcactatgtaattctgaattcccatgatctgtggcatttggaagacagttggggggtcatggtgattcaacccggggagcttggaaggcctcgctacaagttaaccttcctttggacagtggctttgtgatgccacttgaagaaactgcccccccttaacgtccatcactaccctgtctccatttattgttaacagtggcagaaaccctcgggattctcaagtagaaagttttgggagctcttacttttacttttttttctttgactacagttttcaaagtctacacgaatctccctaacctcctgaattcactaggcactttgctatggactcacctggcattgttcagccatgcttttttcttgggatggtaaatgttgtatacctacccctccagagaatagtgggaagaaatgggagttgctggatcctaaggaaaatctgttggtgtttgtttgcctcaactcctccagtggggatgcttttttcatgccctctacccccataagtaaacatttcccaggcactcagatttgcattccttggtgtgcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacaggtaagggacgcagcctttgggtggggttggcatggttgggggatggaaccaggaaggggcagcatctgctgaagagggacctagccatcccctcccccttttgaagggacaaagggctgcacttaaattgatctcctcaacgttcagtggaactgtattgatcactgctaaatgatcaatacagttgtctgggtataccctaggaggggtgttcccagactgtcgcaggaacactagatagactggtcctaggctccaggccacaaggtttgtggcagggccttggagcaggaagcaggctggctgggactgggtcctcaaagagcaacttgtctgcctacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaatgctgtgtaccaggcctttcttgacttactgaactgtgtatgcatggtagtgttggcagtttcggagctggctctctgccgccgttctttggggtactctg

SEQ ID NO: 86723 - DNA, 1049 bp, Homo sapiens
atctggcagtggcagaggtctctgggtatgagatcactaatcctcagctacagaactcaggcaagatccccaaaagtctgtttaaccattttggttaaccagatatcctaaatttctgaggtcaatggcagtcatctgatttgatagagaaagaaattgaagtgaaaagggcattgtggtcatctgaagttataaatgacagtgactgaaactctggcccaggaagtgctgacttttaacattctctgagaatgtcctaagatgataggatgaataaagggtatctcaccgtccaggaacagaggatagaggggttagttataggggacttcttactcctccaaccccttccctgtggactgaccacacttggtggtttaggtataaatgcagcctcttaggtgttttccagctgttttgttgccatggcagcgtgtttgttatgccactgtttccttctggcctctcacagctcagttgctagtctctgtttcaggatagggtattaactatctgggcagcagcagctagtagacttcttcctccatccaagagactaagccatttagttccctagtctcccagctactgtagatgcttacctctgcctctgatattcgatccttggaagtcttatttttccaagagtttggtcttctcaactatttcctatagaagcaaatttcctttcaccaggaatgtgaggtatagtcaggttctcctctttagtttccctccattcatctcctttgatacagctagaaagctctcagctctttccccaagaatcatcaaaagaggggaaatcacataaagactgggcagatggtgggtgcagatttagctgaagagttcagatctttgagaaggaggtgcattcatgacaaccaaggttagatgatgtattgagatgggcctatcctttgggcctctttcagcataagctttcaagcattgcttttaggggaggggccactatgagtcttaagtcataaacggggataaaggaaggaaataaagattgtaaaaggagaggaggttaatagagg

SEQ ID NO: 86724 - DNA, 2411 bp, Homo sapiens
tgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaaggtagggccaggcccatggcacctctacctgcaactgcacctgctcagggctttctggggcagcctaggcttctcttaattacccccagctttgtccttcactttctaggaaagcagagtagagggacgctactgcttctaaatggaggtcacttcttaactgctacagcaacctctgccctgcccctacttcccacagctagtgtgcttcacctttttatcctctaggcatagaaaacatttttgcctttagtatgtattgctgccattccaagcttgtgttagaagtaacgctggttaagatagccatgtatttctctcttttctgttgacttctgcagtgttgaagcatcacacagacatgagcagttcgagctacttggcagccacccaccatcctccacacagtcccttggtgcgacagctctccacctcctcagattcccctgcacccgccagctctagctcacaggttacagccagcacatcggtaagtacctgtgtggggttggccggacaccccctctgcaggtcacagctcactcaagtggctccagaggacagtgtgagggtgggttataaagcccagggcatttataggatctcagctcatcatgacatatgtatgtatgtctgtaccatttttaagtcaaagtcatggtacttgaccttctgttgtttttcttgagttgtttttcatagcagagatggatttatgctgagccatccatagaaagcttgatgcagggacaaactcttaaggtgatctgtgactattcaagatctgttggactaagtttcacacaggactcaacagttccgtggccctaatcctgttggcccaagaagtgaacaagagaggaggggtgggtagaggggagattcccatgggcgttggaagcagtgtttgatttccttggttttactctctgggtgagtggaggtgaagtactaagaataaacactaggcgtgagggtaccagaagagaagggaagggagaaggcagagtccatgctttttaggtatacagagcagaattacagatccagcaggcccccatggcaggacatttggcatgcacacaccagattttacgataccacactccatctggaagcagtttgcacagctattccagacacatttcctttaatttcattctaatattttaattcctcaagtgtgccctcttggaacatacatacctgtagctgctatggacctactcaaagggtcctttttgtataataattacaatgtaatgtaatggtaaatgtaaaagtctgcaactgtaatgtttattgaacacttactacataccagtgatcagtgatttacatgtgttacatgttataatgccttttgagatgtaggttggtactgtggatttcattttatatgcatgaaaactgtcaaggcaacttgtgagggttataattatgattcaaactcaggcagcctgactgtagagccagctcttttaccattacactacacaggctaagcctgggtgagggtattgcagaggcaacttaggaagttccttcagagcctagatcaggaaacttccaagctcataaaatggactcactaggctcctgtgatcaggtaggaattcacattgttctctctttgctgttacaaatcaatcttttccaaatggtctctttgctcttcgactttctttacccccgtaacccacaaattttatctaaataggtgtgtagtgtccctcacatactcagttatccagcagcaaagggtttcagataaccaaagtatttataaaaaagagtctaaactaattctgatagaaaatctgaactcagagattcaggacttggtgagcacttcaatatttctgtgtctggagaatgttaacttaggcctggatcacttgaaatttttaccatttattgagtaaaaattttgtgtatagcactatgctaacccctgaggctctctcattgccaagttttttcaaagactctggatttatgtaaaagaagataggccaggcacagtggcgctcacctataatcccagcacttggggaggcggctgaggcgggtggatcacttgaggtcaggagttcgagaccatcctggccaataaggtgaaaccctatccctactaaaaatacaaaaattaactgggcgtggtggcatgtgcctatagttccagctactctgaggcaggagaatcacttgaactgggaagcggag

SEQ ID NO: 86725 - DNA, 1058 bp, Homo sapiens
aagaagaggtgtgaaaagaagagaagaggtgtggttggtaattgaaggctcctaggtggataaatttgctgaagaaagcaagtaatgtcccacctgggaatcaagaaccaactgttcgtcttagcggaccatcaaggtcgtgaaagcatgcagagtttataaagtgttctcagaaagcacagttttagtatctttttaaactgtcagaagtttgatacctaggtaagcacttagagcttcaagtagttagatttcatcaatgaaaaggaagcaagtttccttacccactttgaaggtcagtgtgttagacaaatggaaatcttttaacaaactaatcaaacatccttttagtagtgtcacacaagtatctagaaaggtcttcgcaataacaaatggggagctaacttctcaataacaaatggggataacaaatgggtagctggctttttatcagatgctgaattgtcagttttgtttggcttttttcacaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatggtaagaaagaccacagactagaaagtctaatgaaagaaacttgagagacttctaggtgaaagaaaatcagccaaggtgcagttacaactcagatactttcaaggtacaactttcgtcaaccaagtcttctcttagaattttgcaaaaagactgtaacagatccaccaaaccagaaggtgccactaaaaggttgcaacttaatatgagatttccttctaactcttcaagtagctaggagggatctgggctcagttgcctctagccacagtaatctggtccaaaatacgcttagtatatctttaaaaatgttttgtctgggccaggcgtggtgggtcacgcctgtaatcccagcactttgggaggctgaggtggacggatcacctgaggtcaggagt

SEQ ID NO: 86726 - DNA, 1585 bp, Homo sapiens
ctgacctcaagtgatccacccgcctcggcctcccaaagtgctgggattacaggcgtgagccaccacacccagcccaattactgtgtttttaaagggctatcagcttagttgaattatggctggaatatatcttaaaattgagatgcacgtttagtgcagtaactcttttgcccttaaaaaggctggccaggcacagtggctcatgcctgtaatcccagcactttgggaggccaaggtggggcagatcatgaggtcaggagatcaagaccaccctggccaacatgatgaaaccccatctctactaaaaatacaaaaattagctgggcgtggtggcacgtgcctgtaatcccagctactcgagaggctggggcaggagaatcgcttgaaccaagaagtcagaggttgcagtgagctgagatctcgccacagcactccagcctggtgagagagtgagagtccatctaaaaaaaaaaaaaaaaaaaaaaagctgttgttatatcacttgtacttcttaaaatcaatgactaaaacaaagtgttcagtaagttaaactcgttgggaataaagagaaatgagatctatcagtaaataaataggaagccttgaatgcccaaactgatgatttgggtttcagtctataagttttaaatttttgagcagagaagtgttgtaagctattttgggggaggtaaatctgctgtaacatgttttttttttttttttgtttgtttgttttttttttttttttttgagtcggagtcttgatctgtcacccaggctggagtgcaatggcacaatctcagctcactgcagcctccgcctcccgggttcaagcaattttcctgcctcagcctcctgagtagctgggatcacaggcacccacgacgacgcctggctaatatttgtatttttagtagagacaaggtttcaccatgttggccaggctggtctcgaactcctgacttcagctgatccatccgccttggcctcccaaagtgctgggattacaggcgtgagccaccgcgcccggccaatctgtaactattatgtttgggatggattggcacaagagactggaggtggaaagacagactaacagtagtaatcctggaggagataatagtctaaggcctctacaactctgaatgtggaatattttaaatgtaatctaaggaataaccactagggtgtggtaagtgaatatcagagtaaggctcatggagaacatggagtacttcctaaatcataattttattataaaatgacggaattactagttgtaattactgaatagcctatattgctatttattgtgtgtttcatcactttaggggtctagtatggtggatgttagtaattatctaagtgaatgaagaagcactccagtggaaagttcttatatgccattatgttcttttcctggcccagtgcctaagtgaagtaggtgtttataacttaacctaaacgtactaagatttcagatcaataaagttattaaaataaaattggtaccagccaattttcaaataaggttgctttttattttttaagtaaaattatgtttataattaaaccataagacaaa

SEQ ID NO: 86727 - DNA, 1620 bp, Homo sapiens
ctgctttgagctgtatttgtgccactgtacttaagcttgggtgacagagtgagaccctgcctgagaaaaaaaggaatcttcactaaagtttttaaattgatattactaaaaaaaagtttgtcttcacaaaggaaatggagattaattcacaactgtagggaattttagattgctgactcttcaaatagcagttgcctttattccaaaactaatgagataataatattccagtaaaattggtactgtgcaggaattaagagcattatctttgaagatgataaccttgggtttgaatcatggtactaccacttagtagtttggtaatttggtgcatgttaaccaccctgacttccactcctctccaaagcctcagagatctcatagggttgtttgagggttcaatgaaatatatgtaacatgcttattgggatgtctggttgataagttcctcgtacaaagtggctgttattgttaccacttttgttgttgttcattcattctttcaacaaatatttattggcttcctgcaacgagctaaatctgtctagtcactgggtatacaacactaaacaaaacagacaaaagtgcttaccctatgaaatattctagttgttaagagaaagaaaataataaatgaactctgcagtgtgtcctatagcattaaatcttggagagaggctaggcacagtggctcatacctgtaatcctggcactttgggaggctgaggaaggaggatcacttgcgttcaggagtttgagaccagtctgggcaacatagtgagaccccatatctttaaaaaaaaaaaaagcctgctgtgggcgagcgtgtgtagtccatttgctcaggaggctgaggcgggaggatcatttgagcccaccaggttgacactgcagtgaaccatggttgtgccactgcactccagcctggatgacagagtgattgagactctgtcttttaaaaaaacaaaaaaacaaacaaaaaaaacacacgtatacatatgtaactaacctgcacgttgtgcacatgtaccctaaaacttaaagtataataataataaaaaattaattaattaaaaaaaatcctggagagagaaatgcaatagaggagggaatagagagtgctggagagctcagataaagaagaggtatatggattagccctttgatgtattccagagcttaggtattcctcctcattcctgtgaaagatgaggaaaggattgggaagggagtgacgaataaagtagaagaaaaaccaagagagtgtggtatgtgaaaggcaaggggagaaagtgttttggagagggaggaggaggagggattgtctgtgtcagttgttacagacaggatcagtaagatgaaggctgagaattgagaccattgaatttagtggggtggggttgttgcagacattggtgagcagttttggtagagggagaaaggtgaattaaagcatggttggagtggtttcaggagacaaggccacagaaggaattgagggaaccattgtagataacattttcaaagaatgttgctgtaaaagagagcagagaatgggaatttttcttaagagagccactagcaacatatttgctaatgacaaataagggagatgagaga

SEQ ID NO: 86728 - DNA, 1750 bp, Homo sapiens
atacctgaccactgattctcttattttctttttcttcagtcattcaagttgtgtttttcaaattgatcatcagaagttttaggtgctttgtgcaaatgaagtggtggtgcttttcaggcaggggtgcgcttgggtacatgttaatttcttttttcctttttcttaatcagattgagtctgtttctcagccattggaaaaccatggtgcccgtattattggtcatatttcagagtcactgtctaccaaatcatgtggagcactcagacctgtcaatggagttattaacacgtaagttttagctcttctacttcctacacttagtagacttgtaaaggtgttttggagctcttagttctctttagccaggactgaccctggtttaaagaagcggaagccttatcacttagtaacatttttaatcttcactgtataatgaagcagtgcattttaattaattgtatattttccttttacctactaaaatggagtgggcatggagtaaaataaaagacactacagttactgtgaattattattgttttaatcttgcaggaattcctcagaagtgcttatattaacctcctctgcttaggacagattagatctccaagggctatgtttgtaaatctgtatttatgaagattcaagggagaaaacaaaagattcagggagattctgtacaagtgaatgatgtgtacaacacccttaaaattcgggtttcatagaactgattctaaggaagcccattaacatttgcaaaattcatcattttctaaccaactgtagttctctagactttatttactcgtgtgtttgatgtagaggagaactcaatcactagaacttgagtttatttattgacttttatctttcagacatgatgtagttaatgtgcaccaagaaccttacacataagcacacacaggtagattaacagacatcaagaggagacctgcttctgctctagaatgcttctttgtgtctgaacattagcaaatagaggttgaactagtataagaggctttgtttctttgtgttttcttgttgtttatttattttgtttctttgtgtgttctgagaatactcttccttccccttgtatagtcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggtcggtacagatgagagttggtcattgtcaagcagtgagccagatgctcagatagagttagtctcttgccaactttggtgttttctaaacttggctaaccaccaaggtcttctggggagctttataaaatactaggttcctgggccctgtttgctctggagttggatgttggaatcttgttttcagaaaacacaaagctcctcggtgactctgcagctagttttgaaaaccactgtcttgagctttttaatagaaatgggagagactgaaagtttaagtactgcccttaacactttgaaggagaatagtgtgccctctcaccttcactgttatcactgaaaatggcagtatagaatcctttgccctaaaaaagaatcttggccatgtgcagtggctcatgcctgtaatcccaacacttcgggaggccaaggcgggaggattgcttgagc

SEQ ID NO: 86729 - DNA, 1013 bp, Homo sapiens
aaagctatacattcttctttatatccttttctcactcaacgtcctgtaggttagcaatttcagtacgttttggcttatctttcctgtatttttttgcaccgatgagcagacacatgtatatattttttaaaatctccttcttggataaatattttttaaaatactagatttgacgttaaggagggttttgtttagcgaaaaacattgcttctatggcaattaacaagtaacacattatttgtgtgttagtttctgtttgtaaaatgatcctgctcctttaccctttccttgctcatcctactttacagaagtgatgagaaaaacaagtgtactattaagtgaagagctaatgctttctcagaagaaaggcatgctaaaaatgtaagctattgctgtttctttttacacagtccaagatacatcttcattccattggtgtaagtaggaatactcttcctttctttgaagttttgcagtctctagggacagtgagtagttcattggcctgacaagggttttgggatagaaggtaaagggacagatattggccaagaaatatttgacccacagtgttagaaaacactgacaagttaggtcttttataataaattgggctatggataaataagttgaacaataagaatttaagatgcatttttgcatttgctatatttctttaaattctagatagttattttcaagtgttggtaaacataaatcttaggcttaggaaccattggattagtaacagcattatgctaatcaaaactttaaaaaaatgagttcaaaattgttataatgtaattttatagattttcttttatcctcaacctgcagaagccggaaagtgaggcacatagccccacataggcagaaattaaagcctaggcaataacttagtgaaaatggaattttcagaacattccacttcttgtttagtacaattttatggccatggtgctagctaatggaaatggctagtatactatttataggccagcaatattttggtg

SEQ ID NO: 86730 - DNA, 1020 bp, Homo sapiens
aatccttccttgtctttttccagcttctgatattgtgctagtccttggtgttcttggcctgtagctacatcactgcagttgctgcctccatcttcatatgaccatctttctctttgcatctgtgtagatttccatgtcaggaggacaccagtcatattgaatttagagcccacactaaatggctcttcataacttgattacatctgcaaagaccctttttctaaacaaggtcatattcacaggttctgggtgaacataaatttggaagagacaatattcaacttgctctaacaagccatggaattttcccccaatgatatattcacatgcatttagtctttatgtaacactataattaatagaagtttttgagcacttgtgatatgtcaggcactgtgctaagcattttactctcattcacgattttcaagataaacaatggaagatcagagcagtcaagtagtttgttcatggttacacatccaagtgagtgcagagctattgctcaagttagtaatcactttaagtgcttgggttttttttttagttactgaaatggaagaaagtttttcctatgtgttttggttaagtgggttggtgttcatattttccatgctgcaccaagatttcccagcacttcctgggttgcacaggtcttttttttttttttgagatgaacctaggtgataggctgaatcttggtgataggctgttgagttataatttgtcttcgggtgggagattggagggatggtggggcttttctttttaaggatttactttgttgcttattaacattaattttatttaagtggcgtattaccaaaaaaaaaaaaagtatttgtgactactgctaggtgattctaggatccagacaccagtttctgttctgtcagaaggtaggtattaccttccaagctgtgaagtgagtagagtcccttttgggaataatattgctctctggagaaagaatataacttctaggaactcctctgtactacttctgcatgctgttgtact

SEQ ID NO: 86731 - DNA, 2200 bp, Homo sapiens
ggcgcatgcctgtaatcccagctgctcgggaggctgaggcaggagaatcgcttgaacctgggaggcgaaggttggtggtgagccaagattgcgccattgcactccagcctgggcaaccagagtgaaagaaactccatctcaaaaaaaaaaaaaaaaaaaaagaaaaaaaagccaggtatgtagtatgctcctgatcctagctgcttgggagactgaggtgggaggatagcttaagcaaaggaactctaggttacagtgagctgtgattgcaccaccacaatccagcctcaatgatagagtgtgagaccctgcctctcaggaaaaaaaaaaaaaaaatacagtatcatgatggttgggtatgcacattttacacctcgctaagtattttcaaattatttttcaaaaatggtggttccaattttaactgttaccagcaatatattaattgctcttttccatttctcaccacctgttggctttatgagactgtgcgttttcccatccagatttcaaacagcatcttaatgttttacctaatatttatattttaaccaaattttaacgagatgacacatttttatatatttattatttgccttttatgtgaatttcctatttctgttaagattgtctttttttcttttatcctatttctgagagttctgttacatattctgatgtttaatcgtcagttatatgtgttagatatcttccaccaaaatgtagttggccttttaactttattagattttctattgtatgttgaaaagtaggtgaaatctttgtgtattatctaagaaatgctccctgctctaagtcccgaagatattcttttaagtttggctgttcatatttagcaatttgaaatgccaaaattttgtaattatatcatgaagaagggaactaattttactttttcctttaaagaactggccagtttagtactatttattgagtagtttgatcgtttctgcactgatctgattttttaaaaatttcccgttatcttttatgtatctagttctacgttttgaggctctctatagttttgcagcaaatctggctgtctggtaatgtgtatttgcatcatgccttcttgcaaatttcttgctgttggtcctttattccatgtgaacttttagatctgtttctcagctttcattaaaaatactgtaggcaatttgattggaatttctttgaatttatagatgttcatgagaatcgccatcctaaaaaaatgtgtcctaccatttgtatagatcttcatgctttcaggcgttattttctctgtaaagatatttaatatatcattagttttgttggtgttatgaatggtacttaatgatattttctactttattagtttttaaatattctttactgaacacttttgctgaattctttattagttttaataattcttagtgtcagttggatttcctgtatagattattcttaatgtatgttttattttggcatggacaataattttattgtcccagagaaattaaagggatttcagagaaactgtgtgccacaggatcaggatgctagaacgcagttccacttaatttgggaaatacctatttggaagtttatatccatgtgcatcctgatgagcgggaggtgtcttgtctctctcttgggtttttcttgacactagagttagtctctgcaagggcctttaaaagttaaattccactccccaccccccaatctggtatagatattactgctactcttggatttcactcagtttatttccttttaggagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggtaagggataagtatctgatgtttttaaatgctgccgaaaactatcaatatcgcttttctcacatcccctcccacctcgtaacccccataaccctcttcttaactattgcaaagtaaatggtttaatgacctgatatagtggtttaatttaagaacctgatgtggctgcgcgtggtggctcactcttgtgatcccagcactttgggaggccaaggcaggaggatcatttgagctcaggagttcgagaccagcctgggcaacatagtgagaccttgtctttacaaaaa

SEQ ID NO: 86732 - DNA, 1085 bp, Homo sapiens
ggcacgatctcgactcactgtaacctctgcctcccgggttcaagcgattctcctgcctcagcctcctgagtagctgggattacaggcgcgtgctactaagcccggctaatttttttttgtatttttagtagagacggggtttcactatgttagtcaggctgatctcagactccttatcttgtgatctgcctgcctcggcctcccaaagtgctgggattacaggcctgagccaccgtgcccagctgactaaattgttattcttatctaatacatacattttaggttgcagttaggattacatcattgtatggctatcacaactttgtgaagcagatgttgttcttatttgcagaggtcaatttatatgtttaggatcacataaagtaagtaaaagtgagaacttgtctcctgatcttccctctgtttcacactgcttttgagctaggtagtgagtacttgtgagtggttttttgtttttgtttttttcatgtgactcagcaatttcaagatttctcattcctgccccacagtgaccctaactcttaccctgaaaactgttaatctggcaattgtacgctctgggatgatctcagttttatttgaatcttttggtttttaaaagttatctaaataacctggagatttcagaacttagatgtctcaggatttcctgcacacttggaagtagcacataatcctttgtcaatttatctaccagtgtgaatgtagcactgtgtagctcactgtgaacagtcattttactttagttggctaatagaacctttgtttcattaaaaggaaagaatcgagatgggactgaaatcagaatcaaagttgaaattaccaccattcgggtttttctggcatgtttgttgccttaatgagatttaaaaaaatttatgttaatacatcagggaagagaagcataatccaccagccctgttctactggattgacatacaaatttcccatcttagaatagaattaggtgacttaattagaggcactaggcctggtagtcaacatgtggtgttccatgtggttcaatgtctagcttttggtgctacttatctaataaatacaaa

SEQ ID NO: 86733 - DNA, 1933 bp, Homo sapiens
ttacatggctccatgaaagagggatgtgatgtttcagtgttcagttttggtagctattaattatcccttgtagccttccacttagaagtgatactttcagattgaacattgtttcttaagttttttcctttccacccctctctcttcttcttcagaaataaagctctgcatgtgtgttggtgtgttttaagtataatttttaatctgtttgtggaaccacagaaatggatccaagaggtaggtaaggtcttaaattgaatttgatgttaaataagctggcctttgacccataggcaatgagtgaggagcaccgttgggtgtaagactagaagcagaaatactaggcattttagaggccaggtgaagggtgaataaggacatttaggtcaattgaaataaaaagaaaaagacagatgtgaaatgtagaaggacttaattatggtaggaacttagtgatttggagcctggcagcctgagcaggaaggtgaaaacattgacagtaggcaagtttagaggaagagctagttttagatgaaagattggaatttgtacaagttgaattttagatgaagtgtagtggttaaaattcaggactctgggccgggtgtggtggctcacgcctgtatccccagcgctttgggaggccgaggtgggcagctctcttgaggtcaggagtttgagagcagcctggccaacatggtgaaacctcgtctttactaaaaatacaaaaattagctggacgtggtggcgtgcacctgtaattccagctacccgggaggctgaggtacgagatcagttgaacctgggaagcggaggttgcagtgaaccaagattgcgcctgggcaactgagcgagactccccatctcaaaaaaaaaaaaaagaaaaagaaaattgaggactctggagccagattacccgtatacagatgtagattttacctgtgcttgcttctctgacaaatgacctaaccccttgacaaatgacctctttttctccatctgtagtatggggatagtaggcaccgtttcatagagttgttataatgatgaaatgatgaaaagtcatgtaatgttgtagcacaatgcccggaacaaaggaagcattcagcaaaagctgctatgtataggatccagctggagaaagcaaattcagtagaaaatattaaggctggtgatacacatttgttagtcataaaatattggagctacgtgggatcttttaccacaatttttgtttacccctgttattttatccatgaagtgtagaagaggtcattaaaccttgagaaatggataaggcccatgagaaagaatgtagaatagaaaatttggactagcaacttaatctaggattattcttaaatttagtgtagggcaatggttttccacctctgatagagggaagcagtgcactgactattggttgtttatccgtcggcttttctactcttccttgcctccctcccccattaatggaatctccaatattgtttaagtatcctgtaattgtgtaattcaaaggatgctaggcctctctctggcttcagcaaggaaagttcatcaaaatgtggtctctagaccatcaaagtgtagtctttggaccatcacctagaaatctgctagaaatgtaaattctgggaccccatttcagatgtcctgagtcggaaactctgggggtggggcccaccaatcagcgtttagcaagccctgcatgcttaaagtttgatctctagtgtagggcttccaactgagataactttagaagataaagcatctaatgtaaatgaaccaagctttcagattagggatgattttgaactgtgtatcatgtgccacatctgaagggattggctactgtttagctaatagtcattaagaggcttgcagacccagtgctggcagatcttgtgtttgtgtgcaatagattttaaaa

SEQ ID NO: 86734 - DNA, 1775 bp, Homo sapiens
ctctggaatgtgaatttcctcctgttaggggctttgccttgttcactgctgtaacaaaggtaccttgaaacatatgaggcatccaaaaaatgcttgaatcgagtgaataaaattgtaactgacaagtatggtaaggcacaaggttctgtgagagggcctatcattgaactctcctttggtctctgccagtgtggctagagccacagagaaagcagaggctttgagtctatttactagagatagtgatgatatagtgggggccaagatcaagcagaatcttttgtgggacatgttaagaattagggaagcgaccaggcacagtggttcacgcttgtaaccccagcactttggaaagcccaggcaggagcatcacttgagcccaggagtttgagatccacctgggcaatatagcgagactttgtttgtaccaaaaaaaaaaattagggaaggggtgtttgggtatcttcgtagttattgtgatgttctattttaaattcatacatacatgagggtgaagtattaagttgctctcaagtcttattaggtgctgccactggtaactggtgtaggaaatgctttatcacattgaagaatttacagagaattgtgttctattcagtcatcagcatttaactttttttttttttgagacagggtctggctctgttgcccaggctggagtgcattggtgcaatctcggctcactgcacccttgctgtcctgggctcaagcagtcctcccacctcagcctcccaagtagctgggactacaggagtgtgccaccaccatgcctggtattttttggtatttttttatagaggcaaaattttaccatgttgcccaggctggtctcagactcttgtgctgaaaagcaatctgtccgccttggcctcccaaagtgttgggattgcaggtgtgagccaccacgcccataaaactgtttaaaactgtttctttttttgttgttgccggagcgggatctggtaaaaaccagaaaacctgccagattctaaaggagttgtaacattgctttaaaactgtttctaacttgatgttgttttgaagatgatgaatgtaggttttccagctcattttttattgttctttttttccctttcagtttgatttataagtgaaatttaatacccccattattgggaaaggaagatcctgaagagaacacagaattcaattccttttcagaaaattttgctgcttcaagctgtgcttgggcttcttatccttactgtaattgtgaggggtgaaaatagtcctttgaactttttatgaggaaagtggtgatgttctgtaaaggacatttatttaaatatgattgttattggcttccataatcccccatgtcatctgaccttggattagacccagtctgccagtctgatgagagagccagttgtaaattacctgttgaatttcctgtggatcccctctgttgttctttattagctccataatccagctggatgttactggttacagtttggctaatgatcatgaccaatttttgaagaaaggattccttattggcgggcaaatttttgttgagtggtacagccagaaacattttcacattattctttcctactttaggagctaaacttgcgggctgtttatgtatttgtttttagggtaatcaaattttttctttataacatttgtcacagtgacatttcttatgcacacataaagagtaaccagatattacactgtatgttttggaggaaactgttctggaagacctaggcctaaaactcact

SEQ ID NO: 86735 - DNA, 1032 bp, Homo sapiens
tattcccattcacccattgatttgaacaaccatttttattcattgtagaagggacttaaataaatgtaaaaaccaggcaaaatttcttctcttttataatacatccttgatcatagatagaattttgtcacttctctgatatttaaaaataagacgggtggcagtttgagtatctataatgaggtgaagatcagcttgtgcttgaaaaccaggacagagggtttcaaagtgtaattgaaaaagactgtggcagtcttcttcatgtgctgggagaatgggaacatttgtcagtttactaaggttttgctttcctcttgtgctttatagaatttcttaaagaaatgtgtttattttacagtgaggactggtaatttcattcctctgtacccctgtaagtggtacagtgaaccacagatgtgttcaaagttagctgttgatatgtgatgagggaggggaaagaggagggacaaactgggatgttattttctatcttctatgtctagatttccttggctggagatgtatttagctgtgcagcagtgactgctgttctgtagagttctaaggcagcattacagggagaagccgtcttgaactgactctctaggtttgttgctattgtagtgttcggttaaaaaattcaagcccttgggaaggaatgtggtggggttaatcaaggtttcttgtttttgttttcgttctatcctttcctgaactgtttgtatgtatgaaacagccttttacaattccaaagcaggtccttttatctgtgctccaaaatgcccactgtgacccccacgtgttaacatgaaggctcaagtttgttgacttctgaaagtgttgtttctttaaaagacttttatttaaatcctctactttaaactttattgctgtaaattggtgattctcaacttgggctgcacattcagatcacgtgggaaacacttaaagggaaaatcccaggacccacccccgattaaattttgatttaatttatctggtgtgggtctccagcattcatgttttaaaagc

SEQ ID NO: 86736 - DNA, 1244 bp, Homo sapiens
tttagaaataaccttggacttccatctttttagaaatagctggaaggttagcactcagtatgttgtattacttctctgtgaaaggatctacagtagactgaacttgtctatgttatgagactgctcatgtctttattctttatattcataatgctgaacacaagatactcgtgttttttttttttttttttgacagaatagggatcttgcagttaacttagctgttcttaaatttctgtttataaaagccataatgcataataatttactgtagtcgttattcctagttttcccaggtaggcagtggtaacatctgtttcacaagataaggaagcagaaatttaacaacaatggcagaatcaggatgtcaatcttgtccttttttccttttcccactttgccatgctgccctctgggtaataagatggagactaatttttgaaggcttaatttgttgagccagtgtcattagtttttaggtaacattttaatacagaataagtgtgtcttggtcttattaacagtgctatgttatgtaaaggaatttagttgtaggaatattttctttgaaacaataatacctgtttttttatctcttgattgtaaagtgctgtgggaaatacagagatgacttgtaaataaattctgcccacaggcttaggggatctaagatataattcactgtggtaaaagatacaaagcaatcattgtcagaaaagatacagattaagtgccatagaagttctgctgaagaagaatttctgggtaaagggaaggagacttcttagaggatagatggattttagttctaggtggtagtgtgggaagcaagggagatgtaggtgtttagagggaaagaagaaaggacattctgtatacaaattgagcaaaggtttggaattagagcagtataagcagccacaatcatggaatacaatttggaatctagtatgagaaaaaggaaatgaccaaggttaatgaagattatactcatggaggaagcctttgagtatcaggccaaggaatgttaagttctattttttttttttttttggtaaggaaagtgacttttattttttatttatttatttatttttgagatggagtctcgcactgttgcccaggctggggtgcagtggtgcgatctcagctcactgcaagctccacctcctgggttcacaccattctcctgcctcagcctcccgagtagctgggattacaggcgcccgccaccacacccggct

SEQ ID NO: 86737 - DNA, 1210 bp, Homo sapiens
gttgaatacttcattgattcatttagttgcctttcatagaattttactccaataacaaaaagatctggggtttttctaaaattttcttcaggtcttgagagtttttagctgaattgctacaactattctttctctagatttccaactgggcgaaaatgtttttctttttaaattggcactctcccagcatatttttccagcaagtattctttgggcacaccctgtgcgtagtgaatttttcaagatccttattcaaaaggctgggaggacaggccagtcttttctttgtaagatgaaaacagaatgaagcttgcttaagactcattttgcttctgcccaactgtatatgaaattgatctcatgcaaatacactcaagcattaccagaagtaatttgacttgatagtgtaagtagaaaagctaatttagtatttgcaggcggtttgcttagtgcaacaggtgacctctcaattgagaattcttaatttgttctcaatgataacttgatagtaagcaggtctcaggtccaagagttgagaaatgtgaggtgactttgaaattttcaaggtaattgtacattcaagacattgacatgatatgtatatatttggttttacattttattaggtgctgaggttgtcatttccataatgtccaaagcaatgttagattatttaagcttccatggtttactgatggtattactagatgagataaatgcctttaatttcatccttgaatggtaagattggctgactaatttagggaaggataaggtacagaattgctcttgggtgtttcctagcaggctggccttccaagagcaatagcttaatgtttgttcctttaataagtagtacttaaacagtgatcaggggagttaccataattggtaatctgaatggaaactaaaatgtgtcatcattgaggatagtcagaagtgtccttgtggcagtcctagaaaaggggttccagaattttccgagcagagaaaaatataaacattttcaaggttctaattatttggagactagcctttcaggatcatttatcaccaagattaaccttgccaccaaagggcaaggaaacacttctctggtggttagatcaggaatgatgaaaacacttaagaagaattgaaaacttggttcctgtcttcaatgagtaatttatgtgactgatttttttttttttttttggagatagagtct

SEQ ID NO: 86738 - DNA, 1092 bp, Homo sapiens
ggcacatagctttgctgtttgctgtaactcctttagacagctctctgaccacacagtacgtgggtggacaccagcattgaccaggagggatggtgggaagtttaaatagttttcctttactgtaataaacactctagagaagtgaactattaaaggtttttccccatcaaatggctaaattaaacatttttgacattcgaaagggatgatttatatcttatgtggaaaagccccaaacaactatttccccagttgctggaaaaggagctcttttgagttatgaaggtattttatgttctttctccattattcttaacttgtgcttacaggtgaattgtaagcatgtgctttgtgtttagtattttcctcaagaaaactcttgctggtaaatctagttaccatagaacttgaaaggatattgaaagaatagttgaggactatcctgattggttttcatctacttagtctgtatttgtgtcatttcagtgtctgagtaggtggtttgtgattaacatttcacatgttatttttattgatttggcaagtaccagaaaacttgaaggatgaactagaggttatttttcttagcatttgtggtattagtactaaaaggggagtaagagagtagaaagaattctggacaactgttaagaattgttacattttgtctacctaggctcgagttcctcacttttaaaattaggactgtactttttggaagaatattgcttgttgttttgtggtgggaccaggctgtgatgggaaaggctgttgtcataggcataggcaggccttttgctttgctgaggtatagtgagcagcccggtgaccctccatgtagcctgcattgcatgcagtttccacagggtccatagagttagtgcaaagctccagcaggcctactcacctgcttttctcatgaggcaacctgggaccagtgtgtccctgtagtaactgtaattttttgttgtgttcacttattgcagtgaaaaaaaaatctgagcgtaaggttctgagtggacctggaaaggggtgggtgttgtagtgagagactgaagacaaaggcctgtaacagatgggtatctttttagc

SEQ ID NO: 86739 - DNA, 1336 bp, Homo sapiens
tcatttcataaagtggtgggttgggaggaacatcagccaggatacccaagtcttctcagctaaacccttcttctgctaaaaactagctataggactaatgtaaccatttttctaattaaagtgagggagctgaccctacgtgacctttaggtctcaaactactttgaaatgtgactgtttatctttaaataacatgaatgaaactattctcatcaccatttttttgcattgggggaagctgaggcaaagaacccagcaaagcactggtataagttgaaacaaaacaggtttcttgacttgtgacttaaagctttggttcttctaatgccttcattcatttctttggttgatttacttttcatagtccattaaagtgattatcttatttcttgatgtatgggatagaaatgtgggaataatttcattgtattcttacagaatttacttcagagctgagtaaactttcatttgttgaacacctttgatttaatgccccttggcttttctcctaatctgcacatgacgtcaagtggcagaagtaggaacttgtgtttttttcttctattctcttctcatttttttcctgagaagaaacgtaggtagtgaaaatcattcttagtgcttgttgtgggattctgaagaaaggaacttaggcatcaggaatttgggtgttacccatttaccgtagatatagttgctatagtgttttctgccaccttgtgattgttgtttttgttctctgaagtgaacgtactcttttatggtagtgttaaagtcatataataagtacttatggagtaagtaaatgtgtaagacacaagagataacagatgaataagctaagtttgtatcctcaagaagtttaaagagtgaagggagtgaagaacttagtaagacaaagatgaatgtttagaacagtgcctggcacttagtgatgttagaaatgaaccttgaaggttggcaaagattttgatagacagttttcttttgattgtgacctactgagaggtcagtataggcagaaagcacagggcacacagagaagacaagttgaaaggtatagggctttggtggcaccatgggaatgggatatgttgaagacatagtattataggtacagatggtaaatgtaatgtgagaagaaaaagagataattccagaaatgatgtagaggtaaattgaatgggacttaataactgtgatgtgtgggggcaatgacgggagggatcatcataggtgattgaagttttaagcctggctgactacagcaatagatggttaccagaagcatttcagtactcagtttgcaaaataatcttaagagctcatgagagtc

SEQ ID NO: 86740 - DNA, 1029 bp, Homo sapiens
tataaacttctatatagtaactacttgttaaaataatattttttttccagaaattctcttaattgtgctcttaaatcagcagtgttctgggtacctggaccacattatgtaggtctctctctcctaagtttttttttttttcctttctttttttctctctgtccccgaaattttttttttcttttttttctcccaaccgttactctaggcttatcttgaagttcagtataaaaataacctcataaaacatttcattgtgattactgaaatattgttgaggatattctctgtattctgcaatgccttctttataaagacctcagggagaaagatgtgcagccaagaataattgtatgtttgtctaagcttttagtctgtttttattacctgggtgctgtaattgttcactaggtttcttttttcctattgacatctggaaatttagagctaagcttgtacctttttaatagcttcattttgtttccctattttcatgtttttatttctggttgaatttatgctaacctgtgttttgtctaatagtctcctgaagtctgtttcagatcagggttgggtaaaaatagactatggatgcagttcagtgacactaaagcgcttatttgaattttggatggtcttgattgcagtgagttttctcaccctcaggaattttttttttttttggagaccgaatgttgctcttgttgcccaggctggagtgcagtggcgcgatcttggctcactgcaacctctggctcccgggttcaagtgattctgctgcctcagccttctgagtagctggaattacaggtgcctgtcaccacgcccggctaatttttgtacttttagtagaggcagggttttgccatgttgctcaggctggtctcgaactcctgacctcaggtgatctacccgccttggcctcccacagtgctgggattacaggtgtaagtcactgtgcccagccctttttttttttttttgagacagagtctcactctgtcgcccaggctagagttacagtggcat

SEQ ID NO: 86741 - DNA, 3629 bp, Homo sapiens
agaccacactttaaagaacaactggcttagttctttacgtatgtttcctttggctcccagaccacatagatcaagggggatcaaacagaggcaaatgactgagatttttagcttggttactaaataaaagcagtgtcattacttaaggtaatgaaacaggatgcggaatagtgtgctggaaggagaaagtgaattctgagcttcagggggcttgaggaacatagaggttataggaatcttgattagtgcagctcagaagtttttcttatggttaagaaacctcaccatactagtggttgttgagagagaagagggcagaagggaccttgtgcagcaccagcatttaagggtccaggaggaagagaagaggatgatagtacaaggacatcaggaaagaattagaagaaggtcggtattgtccagtgcttcagagaagtcagatagaatggggactgaggtttgaccattggatttgataataagattactggtcacctttgccagagcagtagggggtgaaatccagattatggaagagtgaagagtgcagagacagttatttatactattcttagagaagttttggggtaaagggaaagagagatatttgggcaattaagtatgagagagaggctgtactgagggcagaagatacttgagtaaattcctaggctgagaggaagaagccagtagagaagatattgatgaccactttgatctgaaagaaaagaaaactgatgaaacaagttggtattacagatgtggtacagttagctttgtagtataatctatacttctagagaagtgagaagctgatgaaaactggattccctggccagaaaaatgcacagacctgtgatatttggcatactttttttagtgaacacgggaattccttactaatttttttctgtttaattattgcttagtttgatgtgtcttgctttaaatccatttatttcaacaagcttaaagagatttttttttaatggagatgatttaattttaacaatctgtgattttctctgaatcgaacttgtgttttggcacctttcaatctgtggtaacaaatgacaagaagggtgcaattcttccttcccttgtgcagggattttgcctccccctttctcccagatgaaagatatttgggtctctagaataactgtggtacagttagctccagagtgttttctttctggaggcagtttagacaacagcctcaagtagtgcttttgttaaaaatatacatgtttttaaaagtgcttgtatttctaatattcttttctcctttctcttctagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgtgagtagacctcatgcatgatagcattcttgagaaatgttggcacaaggaagaatgaatgaatcgccattatggagagaatgtgattctttgtacataggtgtctaggttctgtttgttttttccctgatgttgggtagatgagtgcatatacatgctagtgaagaaggggaagatacttttgctgtagggttgtattgttgtagtctaaatggtggtaatttccttttgaagtctaagaaaaataactaggagacatcttatgtgtaaaattgtactagtacctctttaagagtgaatttagatttcttttgaaactatatataggacatgataagttaatggcctgattgttgagattttgttgtttccagtaagcagggacaaatgctgagttgacctagttacctttgtaggaaattacagttgcttttgattgaactttcagcagagagcacacccagtcttcaattttaacacttgagattttcttacattttaaggactgacaattagaaaatgcttcagaatatttaatacatcgcctccaagcacagtctagtttcacaacctgactctcttcctattaaaaaaaaaaaaaagcccattttaagcagatttgttaagctgagttaaatgtattgatgtatttggaataaattcttactgggttgttttttttgttgttttttgttttgttttgttttgagacagttccgctctgtcgcccaggctggagtgcaggagtgcagtagtgcgatctcagctcactgaagcctctggctcctgggttcaggtgattctcgggcctcagcctccctaagtagctgggattacaggtacccgccaccaagtcaggctaatttttttcttttttcttttcttaagtagagactgagtttcaccgtgtcgaccaggctggcctcaaactcctgacctcgtgatccgccc

SEQ ID NO: 86742 - DNA, 1021 bp, Homo sapiens
tatctagcccaaccttttatagctaaatgaccttgaataggtagccttttcttttatctgtacaagcttactgcagaatctcaatttgtgtgagtgacagcaggtgtagcagctccatctgtatttgtcagattatagtttactaactgaatgaactaaaaattgggatatttggggcttgaatttttattctgaatgtacagtctgactttatccccaccggtaaattagaaattataatctcagccctaattctactgcccaggttgttatgaggattaatcagttaattatagcttttaaggctttgtattctttggagaaagatgatttatcagataggctgttgtgctgtttgtgtagaactgcttcctttttttgtttttcgtttttttttcctttagccctgagcttctctaagaactgcttaaatttgacagtctttccctgctttacattgtcaaagattgaagctttttgaattttgtaggggtcaagtgggataggaatcattgttttgctctgtatattaaatttaagaatgttactatgggccgggcgtggtggctcatgcctgtaatcccagcactttgggaggccaaggtgggcagatcacgaggtcaggagatggagaccatcctggctaacatggtgaaaccctgtctctactaaaaatacaaaaaactagctgggcgtggtggcggacgcctgtagttccagctactggggaggctgaggcaggagaatggcgtgaacccgggaggtggagcttgcagtgagcttagatcacgccactgctctccagcctgggtgacagagcgagactccatctcttaaaaaaaaaaaaagaatgttactgtgattttgttttacttagttattggctctttaagaatttccattgttttctttttgtttctctccattttattatagaagtaatacatgtttatggtggagactttacataagccaagaaacaaaagacaaaagaatcttaaccaatgactttttaaagcaa

SEQ ID NO: 86743 - DNA, 1028 bp, Homo sapiens
aggcatgagtcactgcgcccggcccaaattgttcatttcttttaaccttcagaatgtcgccttttcccacacagcgttgccttttcttatgccatttcctctcactagaatgccacattaccattctcttgtcctagccttttgcataatgacattttagctaattttcaagtctcagctaaaattgcggcaacttcatggacacttccctaatcatccttcctgctgtttctttccgtcctttgtgtagagaaatgaggtaatggtgaaggaagaggttagtagaagccacattatgggcaaacttttcttccccatctgatttttgcttttgctttcagtgcaagtgtggttgtaatacttgttggccacctggatgacctattccttcccctttgttctctgcagctaaatatttttgcaaggtggatgcttccaggttattcttgtgtatctggagtcttgtcttggaaattgactgggaataaatgaggttttcatttgtgggtgtggagttagttctgacttacagtatttgaagcagctggatacgttttgcttttgaaagagtatatatatgtgtgtgtataatctttaggatatggttctctgttgggaggtgtgatgttgaaccccccagctcccatatttgacatgtctggagacatttttgattgtcataattttcagaagggcactactagcatctagtgggtggaaaacagagatgttgctaaacatgctactgccaggatagccccctgtgatagattactcatcgtgagatgtcagttagtggttaggttgagaaactctatcctagaagtatatttttgcttcccaagtgccacttgtgttaggtagaagtttgtccttggaccgatggtgcaatttagaataatagaattaacataggaagggaccctagaggtcacatatttgaactttatcccaacttgtatttctcacaatgatgtttctgcttgatattaatagatgtaatggaaaaaggtgcttgttaaaaaagt

SEQ ID NO: 86744 - DNA, 2029 bp, Homo sapiens
cttccccattgtattccacaacaaatctacttttgttcatatgtaaaataaatactttgcagtgcattccataatgtagcttgcagtacttcatcacaaatcactgttcttttcctctctttctcttgagaagctgtacatataccacctgattcatgcaagttgttttgtggatcatgccccacgtctttcccattattttgattgtgtcaattttttgattcgtgtttcctcctttttctcttcttagtaaaatcttacacttgagggcaacccccacgaggcctttttgacttctctagtccagtcatttagggcttacagcacttactatgtaccaagctctcgataaagttagcacgctaaagaagggtgctgttaaggaattttgcttgtcttggaaatagaattagttaacaattagggaaaattcagataatttgaactgaatgacagtgactttaagtgcattatacaattcaagcaggaagaaagtgatatgaattggaagagtctaagaagtttttgtggagatgctatgtattgaaaaattagtaagtttggggacaaaaaaaaaaagtagaagaaggaccttccaggtagaggtagcaacataggcaaagatacggagttgggaatctgtggggagttctgggtccgtatcaattgatgtgcttgccctgacgttaagtttcatcttgaagaatttgaactcattaaaaaggtgtgaggggctgggtgtggtggctcatgcctgtaattccagcactttgggaggccgaggcgggtcgatcacctgaggtcaggagttcgaaaccagcctggccaacgtggtgaaaccccatctctactaaaattacaaaaaaattagctggctgtggtggcaggcaccggtaatcccagctgctcgggaggttgtggtaggagaatcgtttgaacctgggaggcggaggttgcagtgagcggagatcgcgccatcgcactccagcctgggggacaagagcgagactttgtctcaaaaaaaaaaaaagtgtgaggaacttgttcagagtaggaaagtgagatgataaaaaggtaaaggatagtttggggcactgaggcactagtcaggaagctgttgtgataatctagacaggagctgatgaggacctgggctagactgatagtgttagaagtatagagaggacataccaaacctgaaaagcttcgtgagaaaagaaggatttcgtcacaaaggagatgaaattatgaaggaaaagagagctttctttccattctttataagccatcatgtttttgtttgtcatatatttggcctttttgttagactggccccttcacatttctggatttaagctttggtagagactttgactattattttctggttgaagttctcattgcatcctatctggattattgtggtagcttttttattggtctttgccatctatagatgcctttttacttactttcaatccatcctacccaactgatctctctaaagcacagtctgatgtttcactcccatttaaaaagtgtttaatgatactctgctgtcattattttatatatacatatacatatatatgtgtgtgtatatatatatgtatatactttttatttttcagagactcgatctcgctatgttgaccaggctggtctcaaactcctggcctcaagcaatccttttgccttggcctcccagagtgctgggattacatgtctgagccgctgcacctggcctctgctgtctttgtttgtttgtttttgtttttgagacagagcctctctttgtcgccctggctgaaatgcagtggctcaatcttagctcattgcagcctctgcctcctgggttcaagtgattctcatgcctcagcctccctagtagctgggactacaggcacctgccatcatgcccggctaaattttttatttttatttttattatttatttctttttttgagatggagtctcacttttgtcacccaggctggagtgcaatggtgcgatctcggctcactgcaa

SEQ ID NO: 86745 - DNA, 1877 bp, Homo sapiens
ttaacattttattggcattggaaaaatgtacttttaaaagtcattaattgacttttctctaaaggtataaggtaggtttcagtgggaactcaggaatttggccatggaccctcccagaataacctgtttcctttagaattctttttttttttttttgagacacagtctcgctctgtgccccaggctggaggtgcagtggcgggatctcagctcactgcaagctctgcctcctgggttcatgccattctcctgcctcagcctcccgagtagctggaactacaggtgcccgccatcatgctcagctaatttttttttttttttgcattttagtagagacggggtttcactgtgttagccaggatggtctcgatctcctgaccttgtgatccacccgtctcggcctcccaaagtgctggtattacaggcatgagccaccgcgcccggcctcctttagaattcttaaaatcttccagaagtcgctgattttaggattgttcaggagcacttacaccaaccattagggcttgttggaaagagatatgataaaaagtatgatttttttttcctctgtcttttgtcagctaaagagtggtaggaaatttgaattcagtgctagcatagaagtaggattaacaccattaatagtttgatatatagacatccttcagaaaaaaaagttttcttgagatggtatcttgctatgttgtctaggctggtcttgaattcctgggctcaagcagtcctcccaccttgacttctagagtagctggtattacaggcatgagccatggggcctagcctatccgtgtgtgtgtgtgtgtgtgtgtgtgtgtgtgtgtgtgtgtgtatatatgtgtgtgtatatatatgtgtatatatatatgtttaatgggatcatacttgttatatggcttgatctttttaattagggttttttttttgtattccagttcttcagtgaaagcattgtgtatacatctttgagtacctatgagaatatttctgttgaatagatttctagaagtgcagttgctgggtaaaagtttgagcaattacatttgtgattttgatggctattacctttataatgctgtgtaaccacatttaataatagcttaaaaagtgtagttaaaaagtttcctagtctgggtacaggtgcttggtcaagtaaataactggaacttgtagtgggtgaagcctatcctaggttcagttgatgcctcttcttgttaggtggttgatcacttcagacatccccattaacgtcctaatggatcttcatctgatgggtttagcatagaatgctcaggttgcttaacgtgtgttggtctgctgtctgccaggcattgtgctgcttgtaggggacagagataaaacaagctataaccctccttttttaagaagtacatagttggccaggcgtggcggctcatgcctgtaatctcagcactttgggaggccgaggctggcgaatcacgaggtcaggccaggccaacatggtggaaccctgtctctactaaaaaagacaaaaaattagctagatgtggtggcgggtgcctgtaatcccagctactcaggaggctgaggcaggagaaacgcttgaactcaggaggtggaggttgcagtgagccaatattgtgccgctgcactccagcccgggtgacaatgagaggctctgtttcaaaaaaaaaaaaaaaaaaaagtacatactctggggaagaaagagacaagacaaaattgtgagtttatattgtaccatgagcaatagccagggtgtcatgggggtgcaggtaagagcctagagggagggaccccacctcaacctgggagtaatggggaatacttgaaagagcatgtaaccttgagctgaaccgtga

SEQ ID NO: 86746 - DNA, 1076 bp, Homo sapiens
caaaaagagctgcaatatatatttttttttattaagcattttcttgtctttggtagaataaaggtaaagctaaaatagagtgcggaaactgacttgaccaaagtagaaaacacagctcatgtttatgaatcaaaaacaaatgagtttgggcagtctgaaagaaaaaaatcaaacattttatatgaagattttaaacctttatgcaaagagtccctttaaggtggaagagaccttttaaatagagtagaccttccccatttagtagcacaatgcggcaaaatagttgtttaataaatgttactttctgcaagccttgcttttccaagattttaagctgcttccacagtgttaacatttgaaagccctctaccaggaaattatttagctgtgtattttattgttgctgactgtgaacttacccttttttttcctggctgtaatttttttagaattaaagtttctttccaagattttgagggtcaggaaatgcaaagtggaggtagattgagtgcagttttatctaaatgttattttaaaaactctggttcttgtaacctgaaccaggaatccaaaatgagatcttactctgaattttaattacagcagattctgctcttatttggaaaaagttgcttgagtgacatcaaacttaatggagtccctcaccttttaattcctttttaaaaaggggagagcttaaggttagacttggttaaattcagttggaaggtaagtattagggaataaaaaagaggaataacaattttgttgttaggatgttaaaccaaaaattgctaagaactcatatctagactttcctcttgctgcttgttatttggcctttgtgactgtttgttagcacctccaccagagggtgtgaagggaaagaggctcaaagctaagtactgtagctagtttctggtttctagtataggagagacacttcatagaaataccagcctgggctgggtgtggtggctcatgcctgtaatcccagcaccttgggaggccgaggcggatcacctgaggtcaggagtttgagaccagcctggcttaacatggtgaaaccctgtctc

SEQ ID NO: 86747 - DNA, 2518 bp, Homo sapiens
cgtcggggggaggagagcggcgggcccgggccggagccgccgtcgcgcgcccccgcccgccgctggccctcggcgcccaggccggggggctgtttgcaaactgcgcccattttgtggggctgaatccgcccgggctacgctcctccatcacgtggtaggtgctgctgctgctcctctcctcctcctcctgctgccctttctccttctcctcgctctccctgtggctcccatttctctctctctttgttagttgtaactagaaaggcagggcagggtagaaaaatcccccggaactttaaatggcctctccgggcttccctgctgcgggtccgggctgggagtcgccccaagggcgggggtgtgcgggggcccttccccaggagctgccgcctcgttcgccagcttttcctttggcgttctatttaaaaaggcggcctgaagaacatgatttattcccgtaaaagaaccccccaaacaaactctggctctcgccttgaacttctcttgactgcaaaaggcctttctctgctcgaaacacacatcttggcgcgttgcacggtttgtatcacaactctgattgtttcatttattatttttgttgcctgtaaattcaggtcacttacgttttcagatgtagtctccctcaggcggactttttttttttttaaactaaagaggaagagggatttatttgcttttaagtgagttggaatcttaactgcctttttgggggcctgttttccggctgacggtcttttgattcttagcaaatagtttgttttccatacgataaacagcgctactcccgtgtcttacttaaaaatcctcgttttccaatgttggaatcccaatgtggatttatagagaaacgtgctacttaactattgcttactgattgctttaggggagaaggggtgacatgatggcgccactttaaattgctctctttccttttcctcggtcccccccacccccctttatcctggaggtcactggagcattttctgtgacttattaataaaactgtacttgagggtgttagaagcacaactcgtaggggctggagtttagtgctcctagggtcggcagaccgactgccgcggtccccaaagttccgagaaatctctcttcctccagcctcgcctccctcccctccattcacaatcctggtgttgccatctcctttgtcacgtggctagcaatcattgtgtttttttgtttgttttggggtgtgtgtttatatttttaaattgcagctcagaggaacctttccttttcgctttggagagatcaaaacgttttacttgttttagttttagagtcggagaacattttaaaataaacgataaaattacataatctttgccttgcataatcatgatatagttatagattgctactgaacttcattttgaaagtcctttcaagtatggaaactagtacgttagaatatgttttccatttgtcaggatggtctgtaatttctgttttctctgctttttgggtcagttaaaggaccactatttacaaaggcttaagtgggtgtgttttccctttcccctttcctataggctctacttggttccttttctagcatgctgtctgaccaatttagaaaatttcaattgtctacaggcgttgtcagttaaaactatttttttaacctatcaacagtgaatacttttgagtagtaattgttttgtgcctaatgctaagtgtatttattagcatttcggtgttgatctagaaaatttttacttttaatcctgtagttttagaagtatgttattcctttatctgtttctttatatcagtttttcccataattgggtaaactcctattttataaaatacgaagtacatttctggttttttctacataggttactagacattttttcaatttgaaaaaacattttgaattaagaaactttttttttaaagtaaatacgaaatgtggttcttgagtatgcattgatcctgatttaccatgtacattgtcaatggtttggaccattttctttgctaacagttacatcatgtcatgtgatatgtgcagtgtgatgtgtagttctaaaaataaggcaaggtaaaaatgctcatcccttgggaatttaaaaaatgtattataaatgtggaataactaccttcagtcatgaaattctgaattggatttccactaggtttatgcaacaaagtgtgccgttccttcgacctttagcatatttggtgtatttgttagtacctcataatttgaggtgattgactttttattttttgaactacttggagggaaacattaaatgttacaaaggttcttaatgtctatattatggtgaagatggttgtcactgatggccacctcatttgagtatataccagtgtctgtgattgtgaccagttaaaagaatgatcagttaagaattattagagcctttatggtagggtgggattttcggtctttccatctatatgagtccactgaagtgaagtattttagaagttttcttgcatcttt

SEQ ID NO: 86748 - DNA, 1764 bp, Homo sapiens
gctactcaagaggctgaggtaggatcgcctgagcctgggaggctgcagtgagtttgattgcaccactgcactctagcctgggcaaccgagcaggaccctgtcaaaaaaataaaagtacaagtggatgcctaataagaaagatgtctgattttagataagaatatacaacaggttgactgatttaagtgccataaaccctgtgaactcttgactcttgcactaagcaatgagagaaaggggaaactggaatttatagttcccccaaatacatggttttaaaaatgagcattttccagttttctcctaatccattagaaaaatatatttcatataatcttgcttatttggttgcctaattaaatctgacagttcagtcttaaaaatttggagcagcagtaagattattttgttatggtgtgtctgaatttaatatttaagtatacgctgcaaagggctttgccttatttggtatttttcattctgctaatttagatttcaggagcctcagattggggctctagttcgccatctgttggtccaatacccttctactgtattttgtggaattactatttatgtgtgtatgtgtgtacaataaaaaagtcaaagtttttccccagggttgtaaattaaaaatccaagactaaagacctcttttggatgtgtatacaaatattagtttattctttgtgtaatttgaccctatgactccaaactgcctgcctttggtatttgagaactatgactatgcttgagagtgtgattttaggagtacaaatggaaattcgcagaaacctaggtgcagatgttgcaggggcaggtgagttagtgtaactttgtgggaagactaaaaccgttctgtaacgactgtgagggtgttttttgataagcagaagtgacgtataatgccggatattggttctggtaagccacaaaaaagtgtgaagcattttgcgtcttcctttttggtagtagagcatacatacccttcttatctgccgaatttgatgatttaatgatttgaacgattttttcttcagtcatttaagccagttttgatgaatcctagattagtcttttaaatctcaagatactccactcatcttttggcaactttaaagggtggtagaattacactttgtgtgacactttgtattacattatgtttatgaattctttaagtctaggaaaggttccattattttaaaggtcctattttggggacaatataaagttctgtactgataaactggtcatgagaaatgataaggtgccaccactttaaaccaactctggtaacgaggtgggaagttggctttttgttgtgagacttgtgtttctttatggagttctttgttaaacttttagcatggcagtgaacttccttttggtggcggcaggaagcataaatactcattgtgtaatgccatttgcctgttttggcggatctgccaagccatgacacccaaaacaagacgcgtgtttcttcacgaaaactacagttcccagcgggcccggcgccggcggggccatcacttcccctctggctcccggctgtcccttcccgggctggcccggcgcgggccctggctggggcctgcgcagtgactacgtgcaccctccccaccccgcccaactctggtggctgcggagcgcggtgctggggctagtgcccagccgtgctgcagtatacggaggctggctgctagggacaaagggcgggcggcggaagccgcttcactggtcagggagctttctgcaggg

SEQ ID NO: 86749 - DNA, 1005 bp, Homo sapiens
tctgtgctgaaggatttctttctttttttttgagacggagtctgctctgtcgttcaggctggagtgcagtggcgcgatctcagctcactgacactgcaacctctacctcccgctgggttcaagcaattctcctgcttcagcctcccgagtagctgggactacaggcgcatgccaccacgcctggctaattttttgtattttagtagagacgggttttcaccatgttgcccaggctggtctcgaactcctgagttctagcaaaccactggcctcggcctcccaaagtgctagtattagagatgtgagccaccacgtctggcctgaaggacttcttataccaaagaagatacagtttcatttaactattttattttattttttctgatgctggttaaagttggttcatttgggacacatttcattagataaaattgtgtttaaatgtgatagtgagaatttggaatatggtggaaaatattgaatattatattctataatttttgtcagtctaattcagaaacaaaaaagattgcagttgagaaaatcatacatgatttctttgtaaatgagttacagagataagacaggacctttagcatttcctgaattccagtcatgttctcggtaacttatggtctcttttataatattgtacccatgacaatttatacgttagatttcaggttttatcttctgcctggaaggattacattcaggggttttagccatgcatatttatctataaatggtctaaaccagtacctctttatctttccttaaagtacttttcagggtctagggctgtttggagctgtttgttacaagcaggacatatctctctgaggactccttttctatcttgaaacagtgagaattctgccttttgctctgtatacattgaatatcccttatccgaaatgcttgggaccagaagttttttggatttcagatttttcagattttgggatgtttgcatgtacataatgtactatcttggagatggga

SEQ ID NO: 86750 - DNA, 1023 bp, Homo sapiens
agctaatttttgtatttttagtagagacagggtgtcaccatgttggtcaggctggttgcgaactcctgacctcaggtgatccacccccctcagcctcccaaagtgctggcattacaggcgtgagccaccatacccggccatcactgcttgctcttgatggcacttagtaaatgagtgttaaagactgtattgctggacttgggacatgcatctttaggagggtatcagtggaaaagctgagagtcacatgcatttgccagtcttggccttactctttggatctattggtcccagtctgataagtgcaagcaactttggaataaggattgccaagaattaagatttttaatactctttctttgaatgctaaagggcaaaagtgtttttgttgtttttgcttttggaaaaagagaactagtttgctgaccacccagtgtcatttggtaatttagagtgttttcacatagttaaagtatagggaaatgaatatttaggtctgtgatgtttatatgtgccaggtagtatatttggcagggaattgatttttagaattgtttgtgacattagttcttgcatattagtttttttttttttaaatggagtctcactctgttgcccaggctggagtgcagtggcgcagtctcggctcactgcaacctccacctcctgggttcaagcaatcctcgttcctcagcctcctgagtatctcggactacaggcacgtgccaccacacccggctgattgttatatttttagtagagacagggtttcaccatgttggccaggctggtcttgaactcctgacctcaggtgatccacccacctcggcctccacaaagtactgggattacaggtgtgagccactgcaccccgcctagttcctgcacattagaaaacgtttgggccgggcacggtggctcacgcctgtaatcccagcactttgggaggccgaggcgggcccatcatgaggtcaggagatcaagaccatcctggctaacatggtgaaaccccgtctctactaa

SEQ ID NO: 86751 - DNA, 2406 bp, Homo sapiens
ctccattttaagcgaagcagtaactggttaagctggaattgtatacaggcccaggacttgaacgaggatcctaccagaggtcatttagtccatcctcctgcctccaggcaaatttaccttcctcccaccctcaaaattaagttgctcggtctgcttttaacgatctctggggaagaagggtcttttatttgtttctagtacttcagtcaagaataggttttacttttcatgtggaattgactctgaaacttaagcataatcttgggacagtcgggatgattagagaagttttactttactaaatataattaaatgtggcaagggtctttctttagacggttagttaacaaatcacgtttagtgtttatgaagtaccctggaaaattactttattctctctgggattttggctaattgtttgataagcaattttacattatctaaaatacgtgttacatatttatttctctttttatgtaaagtatgtttctacacacatatatatggagacacacatttgcccttttctaaaggggactgtattttctatacttttttagtgcgatgaggcaaatagtacttcaaaatccctgcccaggtagcttaaactatttgcattgtcttgattattttttagtctaaatgaaaatcctctctttcagataccttctcgaaacaaaagattttcctacctgcttatacttggtaaccgagggaattactaagacttcttgctcatttctgagtattgtctttatatcctgacactatgaatgctacttggatgcctcttaaggtaagatgtgttattttttcattaccagcctcattttattcatttttctttagaattgggaatattgtagtttttgaatttgctattcttcacttcctttacctgccatttctcttgcctcttgtgtttgcttcctaggattgattggctatattttactttgtatctctactgttctttgattatcggtgtgaatgttttaatgaagttctcaaattaacttccattataatgaaaggcagtgatctttttaactttaaattatggcaacttacatagttgtaaaattatgttccggtcttaggatgggttggcaattcaaacatctaggtccacttttcaaacaggtactttagagtcataggtactagggtgtgtcccactcttgcaaatcagtagctgattcatgtgttacaaaagatgtgtcattaaccatttgtttactctgaaacttcatatagtatattagggcattctaagacctgctggtttacacgtatgactctttcagagtcctcctgctgcaccccagtcctttgtgtgacatttcatactatttttctcagcaggtagcacttacaccaagttttatttcacagggtaaacctcatttggacagtgtggacagatgacctttagatgaaaaagctcccattgatgtggttctccagtctctttggctcctctaatctcttgtacatagatggccaaagaactctccattaggactaagcaaagggcagagcttaagacttaagtaggtggcttctttgattttcttgtgactaaaaatacattaaaaaaaaaattaaataaaaacaaacagaaaagacgtaaggaggggatgggaggaaggacagagaaggataaggagtcttggaaaccctccaccagcttcgcctttcttcagagtaggatactagcttagttaagattgttgggtgctaatctgctctgtggacttccagattgatgcagaggagaaatcagacaatagtgcagtgtgtgtaacctaaatatctggacttgtgggaaatcttaggtcatgtaggctgagttctcatcttcatttatgtttcagctgctattgctggataagagtgcttatattaatatacaggaagccaaagtgacacagtttttccagcattctccctgtagagttggaggggttgcatggggaatgcaaccagaagttctgaacccgttaagaatcagaggacctgtgtaagagtgtttcgacttagcaagtgttgagcaccagtgttggtggcctctgtcctctttaggaagcaggcaaggggattgagatcaatacattggatttcattttatagtttcctaggttttaacgaatgtatttggtacacaaagccctacttttaaagatatttccagtgtttaaggttttacctctaaatctctctgaacctgggttgtaatacagtaacctcagaagttctactagaggtctctggcatggcaggaatagagaaaggaaatcagctccatatcgtgagttaccacctgttactacttaagaatgcagttaggtggttgccttaatattatgttccttaccaatcctttgctcagtgggaaacatcttc

SEQ ID NO: 86752 - DNA, 1404 bp, Homo sapiens
gggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcg

SEQ ID NO: 86753 - DNA, 1404 bp, Homo sapiens; identical to SEQ ID NO: 86752

SEQ ID NO: 86754 - DNA, 1404 bp, Homo sapiens; identical to SEQ ID NO: 86752

SEQ ID NO: 86755 - DNA, 1031 bp, Homo sapiens
tcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctc

SEQ ID NO: 86756 - DNA, 1031 bp, Homo sapiens; identical to SEQ ID NO: 86755

SEQ ID NO: 86757 - DNA, 1031 bp, Homo sapiens; identical to SEQ ID NO: 86755

SEQ ID NO: 86758 - DNA, 1061 bp, Homo sapiens
tgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataa

SEQ ID NO: 86759 - DNA, 1061 bp, Homo sapiens; identical to SEQ ID NO: 86758

SEQ ID NO: 86760 - DNA, 1061 bp, Homo sapiens; identical to SEQ ID NO: 86758

SEQ ID NO: 86761 - DNA, 1089 bp, Homo sapiens
atagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagc

SEQ ID NO: 86762 - DNA, 1089 bp, Homo sapiens; identical to SEQ ID NO: 86761

SEQ ID NO: 86763 - DNA, 1029 bp, Homo sapiens
aacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttt

SEQ ID NO: 86764 - DNA, 1028 bp, Homo sapiens
gtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaa

SEQ ID NO: 86765 - DNA, 1082 bp, Homo sapiens
taccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgta

SEQ ID NO: 86766 - DNA, 1179 bp, Homo sapiens
tttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaa

SEQ ID NO: 86767 - DNA, 1005 bp, Homo sapiens
taggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttca

SEQ ID NO: 86768 - DNA, 1061 bp, Homo sapiens
tttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgaga

SEQ ID NO: 86769 - DNA, 1251 bp, Homo sapiens
ttttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccct

SEQ ID NO: 86770 - DNA, 1162 bp, Homo sapiens
ttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagat

SEQ ID NO: 86771 - DNA, 1061 bp, Homo sapiens
gtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaac

SEQ ID NO: 86772 - DNA, 1011 bp, Homo sapiens
tttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttata

SEQ ID NO: 86773 - DNA, 1005 bp, Homo sapiens
ccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattg

SEQ ID NO: 86774 - DNA, 1084 bp, Homo sapiens
ggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtg

SEQ ID NO: 86775 - DNA, 1025 bp, Homo sapiens
tatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctt

SEQ ID NO: 86776 - DNA, 1037 bp, Homo sapiens
attatgatagctttccgaccaccaccaacttcagtttccttggctgccgtaatattcagctccctgagctgagccttgaggtccgagttcatctccagctccagaagagcctgggagatggccggactcgaactcgtccggcttctcgccattgggcttcacgatcttggcgctcgaactgaacatggctttctcctgggagaacttgcagcgcctgcttaggaagagacccaaatctcgcgagagcacgtcaaaatccctacattcttaagattaattttggggggagtctgtaagatacggttcttaccttcttacctccagcctcagtcctcctggcatcttctgtgttggggcatctttggatctagagcaagcactgtgtgacctgctgtgtgctataactcacggtgagtttggcacttcagttgtactagtctggctagggcagtttgtacaattttacttttctcgcatctttctttccagtacctctcctcctgctgggatttatctacctaaagttgtggtgcagcttcccggcttagtatgtaaatatctcacttggattttcctgtggcagctaacctcacgtacttgccagccaactctgagtatcttcttagtgagaattctgctggggcctgggccagaaagggtgaaagggactaagggactgaggagactaggcagaaatcgtggatcctgggaagagttatgagcacaggttacactagtgactagataaggaagaaaatgtacgtgtgagaagaaaaagggatgtgtgtgtatgtatgtatttaaattagagcagagtagctacccggaggagtttcagttgactggttacctgaaactagtcaagttacaactggaattgcacagccttcgtcatggtcggtgtgttaatagagcttgctgtgagtgcacctctccctctgatagtaattagcacagagaccgactgcaaaaaacaagaacgtcactacttgatattaagtgactgctgcaggtatttttcctctcaaatgttatgt

SEQ ID NO: 86777 - DNA, 1004 bp, Homo sapiens
atctgattccatgatagccaaggcagggaaaggagtatggtgaatcatgcagtgactcctaaggcttctttcagaaaggggtgtatttcccctcatatttcattaaccaaagcaagccccatagttatgcctaacttccaaggcactggggaaatactgcctaccctgtgcccccgtatcatcttgtatttcccctagcctaataatgtcatgctttgttataattacatgtgacttgcttccccaactctaacttttgtgaaagtaggattatttttgtcttatttattatcctctgcagtgccttcattaatgcttgatacataataagaattcaaaaatatttgttgagtgagtgaatgaataaggcagcactccaagactcaatccttaggcctttttttcttcttcttctgccatttcttcttgaagatggcttcctctgtcatggtttcagcagtcactgccctgagagtgatttccattccctgacttcaatcagatatctccaacttctcacttaatatttctacttgaatttaaaatgtgtaaatttattcttttagtaaatacttcttaattactctctaataaggcattatattaaatgatatgaggatacagaggtaattaagacagcacttgccatctgagggcttgcaatctagtataatacaaaaatagtacaatgaatcaataatatatatacgtaatatacaaaatcctgtgccaaaggagaagacaagtgatttatggcaagatggaattggaacttgtgttgtttcaaccattgaacctacagagcagacatcattactgaattctgttctgtgctgggcactacacataacatgaacagaataaagcttttatccacctcacagtccagtggggagacagatagcttaggacgaaaggatagatggggtttagacagagtgtgggagggtaattagggggtaaagggatggtgcataggaaaacgttttcaccagaggggttga

SEQ ID NO: 86778 - DNA, 1050 bp, Homo sapiens
acatgaatgaactttgaaaacatgctaagcaaaaggagccagtcaaaaagaccacatattggatgattccagttacatgaaatgtccaggactggcagatctataaagacagaaaatatatttgggatggcctagggctgggaggggagaatgagaagagtgagagggtcactgctaatgggtatggggtttctttttggggtgatagaaatgctctaaaattgattttggtggtgttgtgtatatctgtgaatatactaaaatactgaattgtacactttaaatgggtaaactgtgtgctctgtgaaccatatctcaagcgattacattttttagaagtggtttaggagctacttaaatgatgaaaggagacatagagttagaagtgaggggtgagcatccaaggtacgtggcccagcttgggagaaagaggaattggatcatttaaaaagaacatggagtgaatttatctaaggactgaagaggaagaatatagaaatatgtaagaagtaagagatgtggttgccttagtgattggaaatggcaggggttctctctgaagggaataccatctggtcattaatctgaatttggtgactctgacctggactgccagattacctgcagtatacatgaatcagtaacaggataaattaatatttgtagtatttctagttggcatgtatttaacaaaataaaaatgtgctttgtcataccaccttgctttttaaaatgtttatattctctcaagaaaataaggggaaattttcaggctgatccaagtgttaagaatattagtcattgtaaaatggaagcattcactttgtcaaaccattagcatatagttttttcagatgtttttaattaaatattaaaggtatattcagctaaatattgtagaaatgcatagagtgatagaaaaatatttattactggtaagaaaacaaaagttgtgagcatttttctttaaaaggaggaactatacttatatacactacagtaatcatatcagtcacagaatcctcaattttgcatttgttgtatttccag

SEQ ID NO: 86779 - DNA, 1023 bp, Homo sapiens
ttaaatttttctaagtaaatgcatagatttttaatgaacctggtattcagtggatttgctttaaatttagctgcagagttaatttcatgattgatttattagccctttgaaagtataaaaagtggtatctgcagttcgtgaagagtgaaaaacatcatcacattttgtttagcatctttttaaaaccaattaaaagcttttctaaaatggattgaacaggagaaaataaaacatgttccctaggtctttatttcaatcaagtttccctgtgttctgcaggagaagagatcgagaggggatagaaaaattgaaaagggctgtcccagcagggagccaagccggaaaaaagggcttctctgagaactcagcagcagcagctaagaaagctcccagcctgcttcatctacatgcagagtcacacaaggcatgggggtgctcactgtcacacagaggtttcacatgtgcttccctgctgattcctgtgaaaagctaacaattggcttggagggtaaaagaccactgcagttcaccctccctgagctggacgtacaatttgtccagtgttaggaaatgtccggcttagcagtgagaggcttgaagacacccctccttccagtgagattcctaacgccgtctcttttacttgatgacactggggctcttttcaagttttgcagatttatggaagttgaggggaatgtgcttttcaagatcaggaggatgaaagccttggtcttaatgtcaaggaggaagcggtagtgagtggtaaggccaggtaactcttcctgcagcctgcaggaccagtggcttgatttttcctcatagatctcttctgccaccttcttttttttttctttttgggagacagagtgtctgaaaaggaactccttgggctgtaaaatgacatgattccccagtttcctcaacaagtgtgagagtagttaagcctattaacctcactgtttaatgctgggtttgacacttttgtgcatcaaattggaaaacctcatctgtatgtaacag

SEQ ID NO: 86780 - DNA, 1192 bp, Homo sapiens
tttacaaaaaaaagttagtcgaatgtggtggtgagcatccgtagacccagctattcaggaggctgaggcaggaggatcgcttgagcccatgagttcaagaccgcaggaagctgattcttaccaccgcactctagcctgagtgatagagcaagactctgtctctaaaaacaaaaccaacaaaaaacagtgaagtaaattattttataaaacattgctacagatatctgctgaataaaatcaaattttcaaaatagggttttgttttggttttggtagagcacatctatagtagatattaataccagaataaattataagatatatatgccattttctgataactcaaaattaaatatctaaattttaatcatcagagaaatgctaatagtgttgagacgaaatattttttcattgctagaatgtattcttccagatccattgccttaaataagttactgtggcattacattagcttttgaaaggtggggattataacgtcgtagtagtccatgggtgccatgactctagttaagagcaccctttctgtagaacttactctttgtattgaacttgaggtttaaaaaaaaaaaaaagaaacctatgtcttagctcagatatcatctggcattatagccttgaacgtcccttaatttcttggtgtctatttcttcatctgtaaaatagagataattcctcatgtgttacctactctgttgagggtcagctaagataatgtgtagtgaagccctttgtaaactggtggactacatgagctgtccaggcgcagtggctcatgcctgtaatcccagcactttgggaggctgagacaggtggatcatttgaggtcaggagttcaaaaccagcatggccaacatagtgaaacccgatctctactaaaaatacaaaaattagctcgacgtggtggtgtgcacctgtaatcccagcgactcgggaagctgaggcaggagaattgcttgaacccaggaggcggagtttgcagtgagctgagattgtaccactgcactccatcctgggtggatggagtgagactctgtctcaaaaaaagaattgcctttggatagtccacagaaccttttcagcttgtaagataggaaaactgaagaacgtataataactgctatatagaggaagtttccataggaagtgagttcagagctcccactttggaatg

SEQ ID NO: 86781 - DNA, 1410 bp, Homo sapiens
ccatcggggagttgacaggctagaaacaagattcaggcttgaagataaatgcagagaagcactatggcaaggtagaatttttctaagggtctctgttgaataatacaagctaagaaaatatgaaaaattattcctatttcaagaatgaagccaggttaagtgatagaccaaaggacctctaccaggaaagcttcttactcttggctctgagccaatttcctcctcagaagttgctgcctctccctgaggccccacgctgccatgagtccttctgactctctgtgagtcaccccactgccatgactccttcggagggggtgtctgacctcttgcttcaggcctcttctgggcctcacagtaacccttgtgaagctgaagatgggagctctcatcttccctaacccagagccaaccttggcctctctgcgtcatttgctgccagtgccctgtgtttgtttttgggaagagagggattttcaggcatcccgtccctcacccacctgacctaaccgtatggattcctgacaccacaggcagaggactattcttcaggttcctctgaagcccacctgttcagatgcttgcttcttttccttcttgcctgttctgactgtgatgacagagaccccgcctcaggaatctccacctcacactctattctcataagtaggtagaattttctcatcgcatatttatggttgaggaggagatagatgctgagaagttaaataatctaccccaaatcacacagctgtgagtgatggggcctctacttctgttgcaccaagctacctgtccatcaggggacttgcctcaccattgctttctgccagccctgggcttgccttaaaaaggacatcatatgcataagacactggttaaaaggtgcagcatggtccctggagatgctcactcttacaactggcctgtccttggggcagcagctcctcacaggcccctaagaggtagacctcctgcctgtggctgccagaaccctcttctccatcacaggtcttcctcctcaagagccttctctggtttcctgttgctttttatattaaatatttcccttagtttagcatcccgagtctgccttttgctgattgttccctccctgtgtctgcagacaacttcgttttcagccttggtgctctgtctcagctgcttctaccacacacataggatttaggcgcattcaggacctgtcccttcttttcaagggccttgccagtgcctacttgttgtcattgtctttgcagtactacggataaccttcctagataacccccctccaggaaactgtccccataaaccgggtgccctccgccatgattagtttgtatttgcgagtgtgttacttggttgtgttccctgaatatttatttggttttcccagctaagttgtaactt

SEQ ID NO: 86782 - DNA, 1033 bp, Homo sapiens
atcccctgttccagcaaacgcacaagtgagggccggtcggggagcgggcaggggctagacgaggcgaggccaggtgagcctggcttctggggctgaggcctcggacgtcagccagggtagaggccgagtttttccgccagggcactgctggggatgcctccgaagtgcttaatccttggcgggactcccaggtcagccacagacagtgggttcaggctggggcctggagacgtggggcagatgactcctggggtctgcaagttcgtgactacctgctgggtagactgggtgacgggaaactggcacctgcaggttataaaactttgtccagcacttgtcaactcggtgctcctggttggtagacctcgagaggagacacggagtaggagacacggcccctggccgtaggagtgtactgtttaattggagagtcagggcacgtacgggaaagtatttgtattcttattcgatttatactaaagaccacatttttatggtacaaagaaattgctgtccacgtagcattcactattattacttgttaatcgtatctggttacaggttatcgctaagaaaatcaaattgtaatttagtttctcataacttaaattccttggtagtgtcctttattcgcatcgtcctgcactttcggaattgctgagatacgtagttgagtattaatggggccatacttaccctatttttgggggcggggggcagaattatgatttttaccctgttttggagggacggaattttatgatttttattttttattgtaaaatatacacaacataagatttactgttttaacaatttttaagtgtacaattcagtgacattgagtacattcacaacttacatcactacgatccatttccagaactttttcatcatcccagtgtgcctgttaatcagtagcacttcatttcttccttccagaacacctagtaacctctgttttacttctctctatgagtttacctattctagatacttaatataagtggagtcatacagaatttgtcctttt

SEQ ID NO: 86783 - DNA, 1010 bp, Homo sapiens
ttcacttaatgttttcagggttcatctatattgtagcctgttaccagaatttcattctgttttatgacggaataatattccgttttatgtgtctaccacattttgttatccattcatctgttgatggacacttgagttgtttccaccattgggctgttgagaataatactgctatgaactctggtgtagaagtatctgttttagtttctcttctcaattttttgaggtatatacctatcctattgagaactttcaaacttatgctgtagttttgttgattaaaacacttaaaatcacactcccaaggcctggaaatgaaatgccctgaagcatgaggaataagagggtgatgatcctctttctctttcattttctaagtttatgggtttcttttattttggcgatgaggtgtttcatttggacaggcgaaaatacagaacctactttgtaatgacagaattttcttttacactggggagccctattctcacataaacgttataggaagggacttaaaactagtctgtgagtaatttagagaaagaatgaaacgaaattatgttcatgttactaagaaagggcctatctttcacaatagcagggcacaatgggcatagtagtgccttgaagttaatctgttatgtatggtcttatctagttaatttagttaaaggatgttgccaagaaggccatgacccattttatattcaagaataactttatttagagagtcttagactacctgttttcagtgcagctaatcacagagaaaactgcatggctcagaagaggaattctaaatggtaccccaaacaaggtgtgtggagtgtagatgctctgtaggcctccaacaatgcacccttggactctagcagcttgccagttttttctattaagggccagatagtaaatattttaggctctgtgggctatacggtctctgtagttactactctgctgttatattgggaaaacagccatagacaatatgtaaactaattgatgtacct

SEQ ID NO: 86784 - DNA, 1028 bp, Homo sapiens
cgtggggctgtgtctaggctgtttctttcctcttgggccagctgtagggtttgcctttccttgtctgtctgcacctgcactgccgccatattgtttccattgttactgctttgtaagtcataatggcaggtgggacaagtcattcctccccctccttcttcagagtggtcttggctattctttacctcccccctttttattatgtcactgttcgtgttgatcatattaccaactttcagatttttctgttaaatcagcattgaaaatttacctcacagcctgcgtcaggacttccttagagtcctaattctcctttctgtccccgttaccctccggtcccctgtacctgttcccttggttgccctgcttcaggtgtcggctacctcaggctgcattcctacatcagcccccatacctccacacccccgcatcatcccacaatatcccagacttactttccggaagcaacggcctggtctcggactctagcagtgatttctagttgcttctcagggccacaggtcttgcctaggagcaccctggggagtcatttgacagctcacccagcttcttttggtgcccgagggcatatctggaggccatagggaagccctggaaaagactgggcacaagctgaagccaaagttgggtgcctggctggcattggtagatttggggtcctggtttgcattgctcacgatgcagaatggttgctgacctttcctccagcgttggggatgatgtgagagtccagcaggcccccttcatgtgggccctaacttggggaaatctccaccgtgagcaccgggaagtggatggtggggccagcataagcagtatcccgaggactgatcatggaggaccattaggaagggggtcttaaggatgaccttggccagaccgtgggaagcctccagagagtgttacccagatccagggtacagtgttgcatttccaaatgagatggcagttccttcgttccttgatattgtcggagaaggatgtttaccaaacagaaggtccctgtc

SEQ ID NO: 86785 - DNA, 2167 bp, Homo sapiens
actatagggaattcaattggcagcctttttctaggtatttataatccacgtctgagaatcccaaaggaaaagagacctatatcagaaaatttagcttaaagtatttatttggacaacctttgcatgtttattttctaaaggtaggaaatttatttctacagatttaccttcagcttttttaaaaaattggcattgttatgtcattaacagctatatacatgtacttttttcaaaacaacatttacggcctaacttgaattttttctgttattcattagtgtatacatttttctccttttgaaatatgtagttctagtttattggatattgaaaaaaaaatctgtgatttatcattgtaatttaagttcactatctcttttccagcaattattcttttttcttttttgtacagtagtagaaaacgaaatccaagcaagcatagaccagatattcagccgtctagaacgtctggagattttgtccagcaaggagccccctaacaaaaggcaaaatgccagactgtaagtgctgacctctgacatggctctgatactccaggcccatcaagacaggcttttctccctgggggaggtgatagaatattctgaaaaccaacgtacatgttgaaaaactatgactatgcaaagaaaaagccccctcaaagggcacaattctatctgagtgatgccgctcaaaataaatagcctgtgaggtttgtgactcagaaaccttgtgaccccttacctctttggtgtcattttgaaattttgcctccagttctgttttttgactagatccatagccacctgaagcctaatgttgccatggagttttgttctgctctttggttcctgctgggttcttcttgggttgaaatgaaaaatcacttcaatcagtccacccataatgaaatgctgatctaatgtttgatactccagcatgaaattaaaatgaaaccacccttgccacctccacccccagcgcctgtttccaaaagttttatgaaactttgtggatgctttacctcaaagatgcccttgggcttcttccaggagagccatataatccatagaaggtcaagaagaggtcagtgagcctgcttcctgtcccctgttctctgtcatgcatccagaatcagagcaacagattctgaagtcaagctgctggaatcttgtgtgctaccatctcactttaaccacaagtttcttcttgactttcaacatcgttgatcaaaattagatcttgtggtgagggggtatagtgtggggtggtgtagggagaagtaaggaaacgccgtctttcctcagtacaaagcctggccccctcagattctgctgccctgagttcctggaatttaatctctctctccatcaattccagtcgggttgaccagttaaagtatgatgtccagcacctgcagactgcgctcagaaacttccagcatcggcgccatgcaagggagcagcaggagagacagcgagaagagcttctgtctcgaaccttcaccactaacgtaagccaggcccgtggtgagggtcggcctgcacttgacagatcgtgggggctggagttcagatctctgagcgccatctgttttgggggtgtctgaagaagactgatgatgaggaaaccaactggaaatgacaggaactttgtgcattgccacagagactagacctagacagagaatccctttttctaagacaaaaacctgaagaggaagcagttaaattgaaggggaataggcagaggtgaaaattacctggttgggctggtctgagacagaaaggtggaagttcacatggtggaaacgtttttctgatcagatagagacagatgattagaacttaggccatttgtagagaaggcagcatttcaaagctgcctgcgggcagttgccattgtgccgagtatgtgtgtggctccagtgtcaggtgcattaagatgtttttgcccctagtctgagcagcaatttggaggaatttgttaacagatgtttagggttagatggactgcttgcctgagtctgtctgaaagtgtgttggtttgcatgtttgatttttcagaacccattgtccctgccctttagtcttaaccagatcatttcctgcacatggctgtagaacatactggccttttctgtgtcctgcataatatattccactaa

SEQ ID NO: 86786 - DNA, 1008 bp, Homo sapiens
tttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgt

SEQ ID NO: 86787 - DNA, 1035 bp, Homo sapiens
acgccaaaggcttctccagcttgagggcatcatctctccacacccctcagttattgacagaaactggcacacgcactgccagaccacgctgtccctaggaggaggcagacagaggtggacgcagcccacaggcttggctggaacggcgggttccagaggtgcccgctggccgcccacagtgaagtctggtaggggtggcactctccccacaggttacccattggaccagagctcatccacccagagcccatttccatgacaacagcaagctccttacccatcaatttcatccttaaagattcccaccccagctttctgagcctgggctcctcgcccagctgccgcgccagcccacgtctccagatcacaggtttagcagtgacttgtcaagctgccagagagagcctcctgggaggtgccttttaactggcgtagcccttgaaaacgaccatataatcacctgctaattggattaggaacttgttcccagggactttcttttgcccccatgttgaggccaccctactccattcttccggaacttagcattggagagcttccccgttcccctctgcacaacctcccaggccagggtaatgctgacagggttgccccaaagtcagatagtgacacaagaggaaaaggaaacctctaattttctggggcccaggtacactcagagaggaaaaatggcccagggtgggagaacacacagggccctctcttcccccactctgcccgcctttcagccttgcaagaaaatctggcttttccctcggggtgtttgcctcgctgcttctcccccccagacatcacctccctcacagcccagctccatgttcacccccaccaggaagtcttcctttctaaaccgtttttctctgcatcctctcagagtggctatatttggttcctgcaatataacttcgtatatattgcatcagggagagggggagattcctgaagctgggttgttattttttgtgaagctatttttttggtgcattttctttctattccagaaaattcttatag

SEQ ID NO: 86788 - DNA, 1120 bp, Homo sapiens
agttagcaggagggtccatcttaaccttcagggaaaaaccgattcacagcacataaagctagttctggatcagaatctgttattcaacaacacttgcaagggtttaactcagatcctgtcccctctggggtagaaatctctacccgcctaaggccaggattctgccttgccagtccttttttttttttttttttttttttttttttgagacagagtttcgcttttgttgcccaggctggagtgcaatgctgccatcttagctcactgcaacctccacctcccgggttcaagcgattctcctgcctcagcctcccgagtagctgggattacaggcatgcaccaccatgcctggctaaatttttttgtattttcttagtagaggcagggtttctgtctctactggttggccaggctagtctcaaactcctgacctcaggtgatccacccaccttggcctaccaaagtgctgggattacaggcgtgagccaccgcacccagcccttgccagtgtttcttatttctcttgtcccttgatgattgtgtaatgatgaatcccttcgttaggaagcttgtcaaatgcaagtagacgctgagggggcggccatgtgtctactgtctcgtggctcctgttggatgggagtagcctgcgtggctgccagtgctggctggagaggataccaccatctgctctcgtcagcatgctgccctgcctttgagtcccctcactcccgccccaagactaaatccttgaaagagcagctccacagcgagcatgtggcaagaaaggatgctaatggagggaagaaagtgatgaatccccaaaagagtcagggaaagccacacaagaaggaaaaatagctgcataaaggttgcgggggtgagctgggcgaggctgcccgctgacaggtgaatcaagactccagagagctgggtacggtggctcacacttgtagtcccagcactttgggaggcccaggcgggtggatcgtgtgaacccaggagttcaaaaccatcctgggtgacatggtgaaaccccgtctctacaaaaaatacaaaaattaggcacagtggcatgtgcctgtagtctcagctactttggaggctgaggtgggaggactgc

SEQ ID NO: 86789 - DNA, 1050 bp, Homo sapiens
tcttctccagggctgtagaatgtccaatctctgtagtgggctctggagttatggcaagccctaggtctggaggctgagttgaggtctcctccgtggttggagatggtttaacctctgtagtaggtattgtagttatggtaagctccaggtccagaggttgaacggtggcttgagtcaggtgtgaatgctgagcctgacccttgtctgaaggtggaagtgtcacctcagggtgtcctggaggaggagctgtagtcatcagggctgtagaaggttcaacctctgtcatggattttggagtgatggtaaaccccaggtccaaaggttgaactgtggctcgagtcaggtgtgaatgctgagtctgaacctggtctggatgtggaagtgtcacctcaggatgctttggagaaactatagtcctcttcgggggtgtagaatgtccaacctccgtagtgggttctggagtgatggtaagtcccaggtccaaaagttgaactgtaacgctgggtgacactggatgctgagcttgatcctgacctggtgttggatttgttaccccttgatatattcgaagttggggtacaactttcttaggaggctgagttggggtctccttcatggttggagaaagttcaacctctgtcatggattctggagtgatggtaaaccccagatccaaaggttgaactgcggcttgagtcaggggtgaatgctctggaggttgagctacaactacattaggaaactctggagtctgagctggggcctcctgatgggttagggaagattcaccctcctcagcggtctgtggatgctcagctgcagcctcctgctgggttggagaggggttctcattattaataggttccggagactgaaatgaagtctcctgttgaactgctaaaggtccagcttcttccgatgactctggaagcagatgtgggcccccgtgctggatggtgggaggttctacatcattacctgaccctgagagctgagctgtagcctgctggtggactaaagaatttcccacctctgcactaggctctgctg

SEQ ID NO: 86790 - DNA, 1030 bp, Homo sapiens
aacatggcgaaaccccatctctactaaaaatacagaaattaccccggcgtggtggcgtgtgcctgtaattccagctactcaggaggctgaagctggagaatcactggaacccaggaggcagaggctgcagtgagccaaaattgcggcactgcactccagcctaggtgacagagactccatctcaaaaaaaaaaaaaaaaaaaaaaaaagaaaagaaaagaaaaagaaaacaaaaaagaaaagcatgcagagacttctggggccggagaacaatagcggtaacctcattgtaaatctgtccctcactctcccaaaacaaccataaaatcaagtaggacaaataaaaattacacagggcagaatactgcaacttcaaattacctgtaagtagaagaaaaggtttgcaacagggatcctgccaccaccataagcctgtgggtgtgtggagtgaggaaagggaggttaaagcattatatggacaaagcagaatggagtttaggacttagaggaagcacagacacaatctccaggggggaaaatgtgacataacaagtgtaaaatactgaacacaggttagtacttggtagatcacagccctgtctttgggacacagccttaaaaatgtgtggtaccaggagtggcagcctcatagaaagtgtttctgggagagaatcggttataaggaagggtggtgaaaggaaaagagggaattgaagaaaaagagaagagaaaatgccaagtttttcccccaccccatcaacaaatatctttaaattgcacaaaagagggcagaactgacaaggccactcaagaattttatgaattgggctgggcgcggtggctcacgcctgtaatcccagcactttgggaggccgaggcgggcggaccatgaggtcaggagatcaaccccgtctctactaaaaatacaaaaaaaaaaaaattagctgggcgtggtggcaggctgaggcaagagaatggtgtgaatccaggaggcggagcttgcagtgagccgagatcgggccactgcactc

SEQ ID NO: 86791 - DNA, 2836 bp, Homo sapiens
ctccatacagtgtactcttattcttggcaagaatgctttaatgtctaaccaagaattttaatttattcatcttgcttcaaagtgttgatcattgttgtcttggtattgcaaactttaaaattgtttcttaccatattgcctcttctctttgagctctgtgggatcacctttaacattcagagatgatagagtggttccccactgagaagccaaaacaaggcccttaataaccccttaagttcaccatatgaatcagaaggagaacactaaagtggagagacttttaagagatcatgatagtgaaagccttaatataatcagaattgtaccataaccttgaatctatatttgttcaaaacatccctttgacttttctaagtgtttgcttaagcagagtgtaagaatgtgtggttacctttggttgagatcctttccattctttttgactctctgcttcagattttttcagtagtgtgagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtactgtctaaaacaatacttttttaaaaaaaaggaacagttgggagaaaataaatataatgaaaaattcccagaggctagcacttggattctaacacgtatgctattgtattatccattagttctgtaatatttaattttagattcttttatttttttaattggcaaagcacaaggtgctgtataacagtgtcatttagagttttatagaaagcttcaacctgagttctgcgttataaagcctggagaaagctaagcttagaacataacttgctgaagtataattatctttttgtagcaggaatttatgtgccagaggtgagagtctttctggtactgattttttgagaccaaggataaaaggatcgttttgtaagacatgccatggcaatggctggttgggggacagtttccgcccaagcttggcctattttatttttcctcatacctactttcaaagtcatttaggtatttgaagccttatttcccacgtagtaacactttctggcttttgcagtttctttttttgtttggttttgttttttgcatggaatggggatcaaacaacccgaagaagaacacattttgatcaagcaaaatgtttgcttcaaatttcagaagtttattttacagaaattaaattaagtagtttgacatccttttctctgtttcacacatatattaggttggtgcataagtaattgtggtttttgccatgacttttatggcaaaacctgcaattacttttgcaccaacttaatacatctatatacatatatatatacgcgcacacacttgttcagaagttatgttgtggccttggatttgtttttccccttggaaatggttcttaactctgggattttagaaggttagaatattttttcaagagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagtctctgattagccagagtatagtatgagtcttcactgagaaatatggtgacccattttctttgtgaaaacctgggaaaatgcaagtgtgggtatgaagtgtgtgttctgtttgcattgaaacaatgtaattttgtgtcttctttttgctttaactgacttatttcagaaattgtacagtgttgagggggaaagtcttttctgttaatatatttgcaattcattaaaggatatggaaaatccaaataagttacttttgaaagcaatttataatcaagttgttaaagctatatgaaagctgtgccatctgtattttaataagaaggcacagaaaaacagagatacagttttatgtttcacaaaaaactagagcaatgtttatctaattttttaaaacttacactcttaatatatttatatttttaaacggtcatactcttttttagtattatttggaatatcaaaataaatactatgacaaaaacaatggtaatttttagaataccttttttcaaactacagaagccccttaccaaccagcagctgcgaatttgcaagtcaactgcttattctttgatcacgtgatttctgaaatttcttcaaaagggacacaaaggtttttttgttccaattagaatctatttaaaaaggtcaggatctgaaagaagtaagatgtagaaactaaatttt

SEQ ID NO: 86792 - DNA, 1060 bp, Homo sapiens
ctagccagtgagaccctgtctctaaacaaatttttaaaagtagctggctgtggtggtacgtgtctatagtcccagctacttgggaggctgaggcaggagaatcataccacttgagcccaggagtttgaggctgcagtgagctatgattgtgccactgcactccagcctaggtgacagagcaagatagatgattgattgattgattgactgatagactgaccccataaaccttttgaaactgaaggttatagtctgtgtttctgtggactagcagggagtattcttaaagtggagtcagtgattggaggttgggggaaatgtcaattttttttttttaatgtctcagagaactagctagttgtaattcctagggcaggaataaggaactcattaggaagaggcagttttggtagttaaaacttaaaggtaaaatgcagtaagctaatatcagacctattataaagttaggaaacttgagttgcattttattaaaggatatgaggatttttaagggcctttatttagggttttatctctctgaatataatacaatttttcttacttgttttcatgaaccaacaggacatatttgtcagaaaacttactgtggacttctgttttatttttaaagtgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtga

SEQ ID NO: 86793 - DNA, 1024 bp, Homo sapiens
cttaaaagtgccagcagtgggattcaaattctgtccaactgtccccagagccaaagcttcttgcactacactaaactagcccacagagtttctgtccctggtcatctctgcatgagagctaaaacaagaaggtagagtcacattattcaacctcaaatgagaacataccttttgatgactatgaaagcactgcaagtattgattttggttttacaaataaattttagcaatcagacaaattcacaaatatggaatctgtgaataattagaattgagtatctactgaagctcctccatttttgtctttctgttctaagttgaggcttgattttagtcatagatttggttttagaaaaagtaaaattttaattctgtttggtttttgttcccatttttttaaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtaagtggtaatgaagtacaaagacaaagtcgtattgatggtgctggtacttactaatttttcttgttagatagctctttattatcatgaatttggttacttatacttagggatggtacatactggtcaataacttctaactaaaatgttttcttatgaaatgtacgtctttaacaaactcttaaattaactaatgataatagaataccagatccttatactcaacagtttcagccttctaccaaacttttgcagatactgtagttgttttttgtttgtttagttttgttactttgttgctttttcttcgaacaccgaaatggtgattgggatgaaaagtgcttgggaaattggaaaggaatagcataattcacttattggataataggaaaaaaaattgaaaaaatttactag

SEQ ID NO: 86794 - DNA, 1022 bp, Homo sapiens
atccagtctcttccaaaataaaaattaaccgggcgtggtggctcatgcctgtaatctcagttacgcgggaggctgaagcaggagaatcgcttgaacccgggaggcagaggttgggttgcggtgagctgagaattacatctacttattttcttacttttaaataataaatgagagtttgatatactttcacaagagggctacacttaatgctgacacaccttagtcactattagttaatgtaatttatgttcagaattactgtgtttaaaattaaatgactttgaagacctttgtttttataaactctcttctgaaaaaaatatagaattaatcaagattgtacatttattttatatctaatactggagaaagggctgaggagaaatctaaaatacatgagtataacaggtgtgaaatttcttcccttttacaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcaggtctgttttaaatgcttaatattatctttgtattttattatgtacttattttaagtaaatttctttatgttcattacagtaccttcattgttttttatatagatgttggaatttttaatagattagtttgtaattaccttttctagagaagcagactagtttattgcgttttttcctttgtttactatgttgttttctcctagaaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagtaag

SEQ ID NO: 86795 - DNA, 1148 bp, Homo sapiens
atgaccaggctctcctagggaaagaaagagtagctaaggagaacagagtaaacctaatttaaaaatagtagaaggataaagggccagcaaatgaagtggcaggacaaataatgtaatgttttggaagtaacacaaagtttcaaaaagtagggcatgatcagtgatgttgaatgcaggaaaggctaaaataaggttttaatatctgatgagacagtgattattagtgattatttataatatgcagtttgaggattgtgtacaggacatcagggtaacagtaagttttgaagaaaattctctggtagccaaaggggaaaaacagtgcactgatacaatagtcatagatcatttaaagaagctagatggtggaaatgaatagaaataagggaataaattagagaagactgaagagccaagcaaagatttttttttctccaagggaacagaaaccaattaatgaagattagaaaaactaagcaatattaactctaaagaacaatatccttaggttttggaaagtaatcagatggttgtttttttaaaatctactcctctgaactcctttagaactgttaccaagtgccaaaggagtataaaatcttatcgtattattatttttttctgtgtataatgagataaatcataaatcttgagaatttagctgtcttaaaattttttagtacttaaccccaaatagagaaggtatgtaataaatggaggatggtcacaatgagatgaaaagaatagcttctggggatttttagtctttgaaacaaaaagcgaaagatgaaaagacattatagaggtaaaaatactgtgagattaaaacagggaaatagactgatgttcatactaatacaacaataattaacaatatgatataaatagtttatctttaaggtgacagtatattatggctgcttgtattgagaaaatgtagatgggagcgttgtgttgtcttttatcatttacagtgcagcccataattcacaaaccttagacttttcgtgttttacagtctgttgccagaatcggccaaactggaacaaagtctgtcttctcacagagtggaaatagccgagaggtaactccaattcttgcacaaacacaaagttctggtccacaaacaaggtatttatcattgtaat

SEQ ID NO: 86796 - DNA, 1454 bp, Homo sapiens
gtttcaagaatcatataactgaaaattacacaaagattaaatccagtagattcttctgttgaaccaatctattttcaagtatctggtgtcctctagaatgggttatattgtgtgtttaacactagcaaaattgctttctgaataagaaaattaataaaatttctaatgcaattaataaatgcctgaaacttacaagacctgaacagtacagggagagaatttctcagtatatttggcctaggatacataaaggaccatttttcagcattgttgcatctatgtatatatagaagggcttcaacctttactgtaaaatatgatgggttttaactcttcaacctcatctcctactttgagaaaaatgagatctagttattttcagctttaaaacaaacacagaaatctgcatttttctgcgatttgttatgtttaaaattagtgttcttgtagtttattttcatttacagctttatcttactggtaaacttttatgatatattgatagatgggttttttgggggtaaatttgattagcagaagtggacaggagatttttaaagtttggataaggcctatttcctgtttccactgatttatgcatacttgaaaaacatgtattcctcacttcctcagagacaaactttttttttttttgtcttcacaggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgtaagtgtcttatattctagtgttcaaaatattatgaaaactacaaagaatgatctgaactaaataatatattgtgaatgacttggtagaaattttctgtttcaggaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaaggtaagtcaaacaagatactttcaaatgtgctataataccaaatgatcttatgataactcatattgttagtaatgcagattattacaacagcaacttctaaatcactgtggaaacaggggcattctgttttcagaaaatgaagtaaaaactggcaaatagtgatgttgccaggtgcggtggctcatgcctgtaatcccagcaccttgggaggccaaggcaggcagatcacctgaggtcaggagttcaagaacagcctggccaacatggtgaaaccctgtctctactaaaaatacaaaaattagctgggcatggtggcgg

SEQ ID NO: 86797 - DNA, 1547 bp, Homo sapiens
tttacggaggttttttttattttgtcttgtatgagagggtggagggagcgtaggatcggtctttttaatactaatttctattttggtaacagacttcctatcccacgtttcctttctcggtgaatttcccaccggacaatgatggtttgagaagacaactccaagcctcagtgctgaggcgcaagcaccaataccaggggaggaggtggaaagggcacatttgggttgttttcatcctctctgatggggatcaggagcattttgttgtgcatgtttataaggcattcaggaaatgaaacacaaataatggtgtttctgtccatttcactgcctttacaccagggtatgctttgacgcacagtgctgtgttgcattaaaggaaccctattggattttaagtgtgtgatgcggtgccaagtcattttcccccctgacatctggagaaactgtatcttttgtgccttggtaatggaccaggtctgggagacttcatcccactatatgatctttaacttgatcagaattgacctctatcaactgctgtcattgagtcatggactttattttgaagttataaagcaaactgatttttagaaattccttcatattgcccttaaaaggcttgaggtatcaaacagtaaatattttaatatatcactactttcatatttatttcatttttctaaacagcatgaaatactcatttcttctagtttggtttttttctccagctgtttacatatagcagctattagtgtttgaattaataaaacgtaagattatatcttatgaaatttacctgtctgtaagttgtattagtttttctagagctatttccatccaaattctttttaccagtatagtttcttttaagatttttttttattctggctgtagatgaggtaattatatatatataattttttaaggcctaacatgaacttaaatagataagcagattactcaagttatttaatttctgttgcatattcttataattttgttttaatagttaatgatttttttttttttgccttctctggccccagaagtcttctaaagtgataaactagttgcattgatagactataaccaccatttaataataatttcagactttataaaagcatggaaggccgggcgtggtggcttacacctgaaatcccagcactttgggaggctgaggcgggtggatcacctgaggtcaggagttcgagacctgcctggccaacacagtgaaaccctgtctctactaaaaatataaaaaattagccaggcgtggtggtgggcgcctgtaatcccagctacttgggaggctgaggcaggagaattgcctgaacccaggagatggagtttgcagtgagccgacatggtcccgctgcactccagcctgggcgacagagtgagactccatctcaaaataaataaataaataaaaaataaaagcatggaaaagaaaaggaatatgtagcctgtttctagatagtacccatcaggtttcctgtttgtccttaaagtactctgagcagtaatacactttgatattt

SEQ ID NO: 86798 - DNA, 1004 bp, Homo sapiens
gaaggatcacttgagcccaggagttcaaggctgcagtgagccatgatcatgccactgcactatgggctgggcatggaaagaaatgtctgcttcccaggaaggatggcggacataacccaagctgccccagctgccaagtatatctggaaagtagagatgttgggctgccagaagggtggggaaagcagaaaggctgtgtcccgaggctaggttccctagaagtacagcttggatgaggatcttatttaagggactcgctgaggatgtagagaggagggagggaaacaggacatggcaagaggcagagctggcaggaatgtggtctcagccagatgccctccagcctgatcctacgtgaatggcaccacaaagccaggcccaccctgaggcgaagagtctagccttgagtaaccccttctccatcagtcattggccaacatctaggggcaagacagctcctgtcagccgagggcagttcttcacagaaggggcagctgtgagctgctatcggccaacctcacagcagctgggggaggagtgcgccagccagcagagctgcccccccacccgccccccggcctttcactacaccctgcatttggccacggctcctggatgggaaagaccgacaccacaggggcctggcagcactcagaggcctccgcctcctcagaaactcttgtcccatagtgtttcctttgtgaggctaaacaaagtgatctttgacaagatgggccagccagggagtgaggttgggagtggaagtgacaggtcagagccagcaggctgaccccaagccttggtagggttagcccttaaaaggtagccacagtgtggtaatgtcacaggactggcacccttccagcaaaagggaggctgagtccgggttcatcggaaagtcagaggagtaaagtaagaaatgaagagtggaagaggagaaagggaggggagccagaaaagggagggaggaacgggtgcttaaggtcattgggaacacgagcccc

SEQ ID NO: 86799 - DNA, 1050 bp, Homo sapiens
ccctgtgcctacaagggcctcatgcttgttttaatgctctgccatcactgtcttgacattcttagtaatctttgaacaagggagctgacattttcattttgcactgggcccccaaatgacatgactggttctgactttatagttctcagaaatggcatagggttcaccatcctggcacagccctggatgggacgggaagtttaatgaaggacctgggaggcttctggctgccaggtgctgcctacaggtgagggggacactcccacccctgaactccacacttgccattcaggtccccaggattgtcttacaggcgcgcgcgcgcgtgtgtgtgtgtgtgtgtgtgttttaatggaggtggagcagctttctgaatgcatggagatcagagctggactgggatacgcttaggcttgctccttctttgccttaatcactgtgtcctctctccttcagagaatgtgtggagtgtaagaagtttgaccggggagccctacatgacgaaaatacctgcaaccgttactgccgtgacgagattgagtcagtgaaagagcttagtaagttcagcacatcttagagttgcacacacccaggttctaaatgtttctaattcaatcccagaacctatccaactcccacctgtaaaatggaagcgtgacttctacctcagggaatgttgtgcaggcttgaggaacaatggacacttgatgtgagctggtgtctctgagagttgtcctcctctcttactagtgtgtgcagccatccaccacttctgcttcccagagcccacagactcagcaagagcctgcaaagcaaagggagcaagtgcctccctaaggaagggaagagaatgtatcccattttacagatgaaaaaactgaggcacagagctgggaagtggttgcctgtgatagtcatcatcttagctcagtaggctagtaagcgtttaccaagtttacttaactaaaagtgttatgcagtgcccaagattttgcttaaagctttgcagtttggagggaaaccttcaaccttatggataggcaaccaaaa

SEQ ID NO: 86800 - DNA, 1029 bp, Homo sapiens
aaattagccagacatggtggtgtgtgcctgtagtcccagctacttgggaggctgaggtgggaggatgtcttgagtcaggggaggtggaggtttcagtaagccgagattgtgccactgcactccagcctgggcaacaaaatgagaccctgtctgaaaaaaaaaaaaaaaaaaagaaacggtggcaggatggcattctacctcatctcctcctgttatttcctatcaattcccatgccaagaactaaagtgtgagcaaaatgaacattattctgtttcattgatgatgtattccagagaacggtgccttgggaaaacttctgagatgaattttaaacattcagggtagggaaggacttaaggaagtcactgtaagatgctattctgtttcctccacaggccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggagga

SEQ ID NO: 86801 - DNA, 1045 bp, Homo sapiens
gggttatttttaactattagagctacaaatagaaagctattggagtggagaaaactattgaagtagagttatagaaaattatcagagtggagaatggaccactctaaatatttaaatggccacatgtgactggtgactgccttattcgacagtgtagatctcaaagaggccatcaattttattgttatgctcaaaagacttagatccatggactgaattacatgttgtatgtatattctctgtttgtagcattgaatgagactatcaatacattggactccacgaaagaaaattgtcagtttgacaaagacaaaaatccagatgtacttgaaaacactgataggctttcttttactgatgacatacttcaagaagtaatggatgactcctttgttgaagatgagttgatttgacagacaaccagcagcttgtataaaaaatttcttctgaattttatttagttttttgttttttgtttgttttttgttttttaatttagggaggtcagccatgggctttctggtccaaatgtttgatattactgttcttctaaatttttatccaaggatttcaaactattttaccaagtattatttaagtcttaatacttggcccctaaatcacaccataaacttgttggacactttactgtagaccatattcaggtctatgtgttatatgtgcccacagagatttagtcattacagtatcaaatttctgggtgatctgatgacctggattgtaaaattgatctcagagtatttatatatttgtggcatggctttgaagaataattttatttcaaagttaatccttttccttttatgtgttttagagaggtcttaatggttttgtagctttctgtttttggatgaaaggccctttgagaagtgcaaggtattgttgaaaaattaatgtttatttctatagccagttgtaagtgtcgagttgttgtttactttatttacaaagaatttacctgatccatctatatagcctcagcttggatgtactgagatagagtttaccccatatttagaaagcc

SEQ ID NO: 86802 - DNA, 1067 bp, Homo sapiens
gaacctgggaggcagaagttgcagtgatcttagatcatggcactgcactccagcctgggcaacagagcaagactccatctcaaaaaaaaaaaaaaaaaaaaaaaaagccaggtgttgtggtgtgcacctgtagtcccagctactcaggaggctgaggagggaagatcacctgagtctgggaggtcgaggctgcagtgagctgtgattatgccactgcactctagcctgggtgatgaagtaagaccgtatctcaaaaaataccagtttttatgatagaatttacttagttgcagaagaggggtggcaaggggaatgttaatttggctcactgtttcctgaacctgaaagaaccaaagaattagcagtgtagtgtcaaaagttaaataaaatttcttttttgtttaggaaaataaaaatataaacattttagattatcattgtttatcttctagaggatctctgggaaagtttagaaaatgctagtggtaaacctatagcagctgtgatgaatacctggaccaaacaaatgggatttcccctcatttatgtggaagctgaacaggtaaacatataaagtctttccatttgtctgatattgtattaaatgaagttcagtacagtgtatcaagtttgcttttctgtactttaagttttctagtgacatttaaaccagccctgttactcttttatcagtaattttacagcttgcatcattaaaattatacatgcttaagagagaaaacaaaatgttacttgcttgtctagtctccagggaaaatactgtaaaatttgatataattctaaaaccaccaaatatggtttattctacaaatgcaaggttggtttaacattttttaaaaaattaggccgggcgtggtggctcacgcctgtaatcccaacactctgggaggccgtggcgggtggatcacttgaggtcgggagtttgaggccagcccggccaatgtagtaaaaccctgtctctactaaaaatacagaaattagctgagcatggtggcacacacctgtaatcccagctactctggagacttaggcaggagaattgcttg

SEQ ID NO: 86803 - DNA, 1026 bp, Homo sapiens
cctgtggcatcaaagtggccattgctttctcacttaaattttttcttagtttttcaattctatttcttgcagtaagtttatccatgaaactcattagcccaattttacatttgatttaggtgatcttaagtctgtgttatttgaaatccaggatgtggtaactaataaatgacacaaatgactgcatattgttgaagtattttgtaaacacatgtacttaccattgttgcctctggctttttagttatttggacttttctctttagtattaccgtcttcatcacaattgcattttgtatactcatgagacatttggttgtgctcgttccagcatttgtcacagaaatgttgtctccctcctcttcaaaaacaaaaaccaaaaccccagatggtgtcagtactattatagcctttgttttgcttctttaggtagaagatgacagattattgaggttgtcccaaaagaagttctgtgctggtgggtcatatgttggtaagtaaatggctgtaagtgagatatgattgatgaatttggatattaactaataccagtagtattccaactaataggaaatttttcttttttttttttgaggagtctcactctgtcgcccaggctcgagtgccatagcgtgatcttggctcactgcaacctccacctcctgggttcaagcaattctcctgcctcagcctcccaagtagctgggattaacaggaacatgccaccatgctcggctaattttttgtatctttagtagagacagggtttcaccatgttggccagactggtcttgaactcctgacctcgagatccgcctgcctcagcctcccaaagtgttggtattacaggtgtgagtcactgtgcccagccatagaattactcttttaatgaatatatctaacaaagctgggcacagtggttcacgcctgtagtctcagtacattgggaggccaaggtggtcagattgcttgagcccaggggttcgagaccagcctgggcaacatggcaaaacctcatctcaaaaa

SEQ ID NO: 86804 - DNA, 1038 bp, Homo sapiens
cttttaggtccatgtacttctttaaaattggaatctgaaaattgttattccgttcagtctctgtgcttataagatcaatgtttgtaaaggcctaagctttcttagagattccactgtccaggtgttttcatatatattaagtattttctgtaaacctaaaattgaggttagaaatagaaacccacattattttgtcccttccttgttctttctactgtccctcactttggccctcacaatttcaagtttcccttttcttttgtctgtgcattcattctgtcttgatgtgttgtcttgttttaatccattagttggcatagatggtcttaattgtttttcatccagatatatctaaaaccagaactccttttaaacatacaaaaggttgatttaaaaaattaatggagctgtttaatagtacttactggatatctttgcagttaaacttaggaacagttgggttttatcggacccagtacagctctgccatgctggaaagtttattaccaggcattcgtgacctttctctgccccctgtggatcgacttggattacagaatgacctcttctccttggtgagcatctgtgacttaagtaatatgatggattttgctgattaaaagattctgtttttcctggagtgtctgaaacataattagaagaatatgggtcttcatgatggttaaaaacacctttgggactagagcaaatcactgtttttaatatgacaagattgaggctatataatttaaatcccatttcactactcctaagccagctttctgaaactcttaattaaactatcctttgtaaggcaaaaaattcctttcttttcagtagaaataaatataagccttgaagaaatgaccctactgataggtttttaaaataattaagtcagagtgattttatgtttttctaaatagtggttgtactttgctgggaaagccataatttttaaacattgtgttcttatttcaaattatatcccattagctttagaattatatttatatttggctttcttccagaaaggat

SEQ ID NO: 86805 - DNA, 1023 bp, Homo sapiens
acagattctctccgctgatctgaggagtcctgtaggttttcatcataaattcccttgacttataggtaacatcattttgtgaagcatggaacttttttttttttttttttgagacagagtcttgctctgtcgcccaggctggagtgcagtggcatgatctcggctcactgcagcctctgtcccccgagttccagtgattctcctgcctcagcctcctggctagctgatattacaggcgccgccaccacgcccagctaatttttgtattttcagtagagacgaggtttcgccatgttggccaggctcgtctcgaactcctgacctcaggtaatccacctgccttggcctcccaaagcgctgggattacaggtgtgagctaccatgcctgtaactttttttaaaaagcctggaacattttttaatagccaaaactgacctaagaactgacccacaaaccacgtctaactctattttaatatatactatttaagtggtttatagtcctcttcttatttgtttaaagtttctcagtcagtgttgcagtgctgaaaggtgattagctgtgcacattcccctgaaagctgctgtgctctgctggtacaacatgccatttacctttgtggttgctcacaggcactgctagctccttaactacagtttgtaatattcacatttataatatttacttttttttttttttttttttttttctgagacggagtctcactctgttacccaggctggagtgcagtggtgtgatctcggctcactgtagccttcacctcctgggttcaagcagttctccgtgcctcagcctcctgagtagctgggattacaggcacctgctaccacgcccagctaatttttgtatttttagtagagacagggtttcaccatgttgaccaggctggcctggaactgctgacctcaggtgatccgcctgcctcggcctcccaaagtgcagggattacaggcgtgagtcaccgcagccggccaacatttacaatattgtttacttgcttt

SEQ ID NO: 86806 - DNA, 1021 bp, Homo sapiens
gcataatcccactgatcagaaaccatcattaattaatactaccattttgatgtatttccaggggttctcccccaccccctttttttggaaacacagtcttgctctgttgtccagactggagtgcagtggtacgatatgggctcactgcaacctccacctcagccttccaaagtgctaggattacaggcgtgaaccactgtgcccagccatatatatatatatattttttaggataattctgctttgtctgctttcttcacttaaatataagaacatgtttatgatatattcttaaaatataactttcaataatgcatttttataagtacagtattcattttcaatttttcactattataaattaatttgatgatctggtataagaacactaatgattagtttgttcttctaaaacagaacattagccagatatcaatgatgtaaagaatttggctatgatagattttacctcttagatcttgatgttaaactggtctgaactaatgacaggctgttcatctggtagcatttacatctagtgatttacttactgtaacagcagatgacaaatttagtgccaaagcatcattttttttttcttttatttttgagacagagtctcgctctcttgcccaaactggagtgcagtggcacgatctcagctcactgcaacctcccaggttcaagcgattctcccgcctcggcctcccaagtagctgggattacaggtgggcaccaccacgcccggctaattttttttttttgtatttttagtagaaacagggtttcaccatgttggccaggctgatctcgaactcttgacctcaggtgatccacccgcctcggcctcccaaagtgctgggattacaggtgtgaaccaccgcacctggcccaaagcatcttgaaaagtattctctttctttaatataatgccctgccattcttacctagtgagaatatagaacctaagttttaccttactggggaagaagctcatataatcatatgcagaacatccaag

SEQ ID NO: 86807 - DNA, 1030 bp, Homo sapiens
gagtagcttgctaatcatggatattatttagtgacatccatgattcactacacccatacattgtggtctttgctctttaaatgtttcctgtggccaggtgcagtggctcacgcctgtaataccagcactttgggacgccgaggtgggcagatcacctgaggtcgggagttcgagactatcctggccaacatggtgaaatcctgtccctactaaaaatacaaaaattagctgagcgtggtggtgtgtgcctgtaatcccagctacttgggaggctgaggcaggagaatcgcttgaacctgggaggcagaggttgtggtgagccgagatgaggtcattgcactccagcctgggcaacaagtgtgaaactccgtctcaaaaaaaaaaaagtttccttaaatagttactggctttatttaaggacttctccatctcccatcacacatcctttataacagactgaagttggcagagaacagaatgatttatttttagggtaaatggaagtttgttctcagcctcttggtttcacttactgtttaaaaccattgttttgcagctatcagttgagggatttgcagttgataaaatggctggagaggttaaggtaaggaaaatactgtttactcttcacttttcagtctagtaagtaaaaacaataacctggttgtaattatagtgttgggataatgtactgtagcatctctgtgtttttgtttagagaaagacatcatgcagggctgtataggccatattaagaatttcctaaaaatggccaggcatggtagctcacatctgtaatctcagcactttgggaggccgaggtgggtggatcacctgaggtcaggacttcaagaccagcccgggcaacatggtgaaaccccaaattagctggacatggtggtgcacgcctctaatcccagctactcgggaggctgaggcaggagaattgcttgagcccgggaggtggaggttgcagtgagctgagatcgtgccattgcactccagcctgggtgacagagcgagactcctg

SEQ ID NO: 86808 - DNA, 2060 bp, Homo sapiens
gtggcagtggtaaattctcatgcctgaagattatgcatccttcatatagaccagtgggtattttttcataacctgtaatattaacttcttattgctagtaatgatcctgcattctgggttgttttataccaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaatagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattcactttattctctttctttgataagaaactaaaaactttcctatcattcagtaggcttatgcaaagttatactatcataggatttttcaaattcaaaaaaaatccagttccttaattcctaatttatagatcttaacagaaaaatcctgagattcattctaaatcagttctacattctcaaaactctctcagagactcttatagtcagcattcaggaatgaacttgagacttcctcagtccctagttttgaggcaccctagttcaggcaccatgctcagggctgcccttaggctctcaaatgttcttaaggcaccagtgaagcaggggcaccaaaaagactgagaaaaatgcaggtttaattgaagaactcagaattttgcaatcagaaattctggaaacaggttattt

SEQ ID NO: 86809 - DNA, 1046 bp, Homo sapiens
cacgcagcgccgcgcaacctaacttcccttccctccctctttctccctcccgctgcaccgccgccctcaggccgcgcaacgattgggcggcaggcagctcggcgcgccaagccattggccagtcgcgaggcccggggcgggacacacccaccggcttcccgatggcggggttaggttggaccgggttggggggggagggggaggggggagggggacgggatggggcggggtaggttcccgaggcctgggcctccgggagggcgggaaggccccgcacgcaggggatggggacgcggcgggatgggcgcggcggggtagcacgcaccaggttctccacggccgcacgctccaggaacttctgcgccgcttccagctccagccgatctagggggaggaaagtgggagacggagcggggtcagaggggccgggcctcccctcccccaccccaatcacctcagccctacccccggctcctgcgtcctaccgggagacacggtcttctcgagaatggtgatcagctccatggcggaggtggcggcggcggcgactcctcctaagacgacggcccggcctttcgggcggcggctcgaactggggatgggggttgggggtcgggtgggaagggagggtggggtggggggcgggggtcaccacaaacccattcaccggctctgtctgggtagtcggtccggctccccttcctctcctcttcccttacttcctccctccaaatgggctgctggcggcgggggagggaccctgggggcagctcagagcgcgctggtgctcgggaggcggagggagaaagaaggaagggaggctgtgagtgagaggcggcgcgcagggagggagcgagggagggaggaaggcggagggatattcggaccggacctctccgcggaggcgccgcgctccacgacgattggccgttgtcctggccacgcggaatccctaactggccaggcgctcagcgtcgaagggccgtctcgcgcccattcgcctgctggtttcaaggcccgggttggctgggcgggcagcggaatgg

SEQ ID NO: 86810 - DNA, 1061 bp, Homo sapiens
gggagggagaaagagggagggaagggaagttaggttgcgcggcgctgcgtgttcagcaggggtgggggcgggggagtcgggcctaggggccatgtggaagctccgggcccggccgcccgccctgtctgaccccggccggcttctccttcctatcccgtggcccctgtggctctccccacctatttcctagagctctgccctttcctagctaccttggtctgtactcatggccaggcctggcacccgactgcctcttaacccatttccactgatatttttccctctttgctcggttattcctctcttggggttttttctttttctttctttcttttttttttttcttctgacctggatgaatagagacctaatcactagggatctgcacccagaaaacagactgaggctcatctttgagatggggcctgtttgctgatgaaatcacaggggaaagttcctcgtttttcatattttaaaatttaaggggtccggagaaaatgaagctaagtccgctagagactggtcctttgtataaaaatgtgggatggattggttgaaacagcctagatgccagttaagtttctctttggtgtccatctcctgttgggggatggggtcagagggaaggattggatgatgcttgacatctttgagaaaggtaataggaattaagtctgagtaacactaaccatatgtgttcctttgtgttatataggcaaaatgtcaacatcaacaaagtgacaaggcttattttatacagactgcctttgaatgatttttttgttgtttttcatatgtgccaatttttacaactaacctgtttatcctttcctagaagagatttttccactagtataggctgataattccatttagggtattattcctgtttctgcttttgcaaattttgcaaaaagctttttatcttattcctaacattcttaacattctttagtggtacataattaataaaacttttaagaattatcttctgctgtgattgcagagcttgttagcagtaagaaaaatgtgtctgcttttgacttttcctgctaactttg

SEQ ID NO: 86811 - DNA, 1933 bp, Homo sapiens
accccccatcataacagccattcatttaacaaacattgagtaccagacattattaaaagttcttgggacacctcagtatacatagaagactgactactactaccatactctgaaaccttgcaattcgggggtctaacatgacaatttgggcactaagaatgatcttgatagggaaatctgtaattcctcattaagtgctaggctccacgagaaaagtggaagacttcctgttacactaagtaacatttttatagaagtcagtgaagtaaatattttgtggtttcctgaaatgcttatatcaaaaaaaaattagacattagttccccccctcgccgcccctctggtggttcagtgctctataaattatcctcagttgtggaaattcctaagatatttttatttacaaatttatcttcccttaacagcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgtgagtaacgcttatctgtttggttatattgcccagagaacaagaaatcgctttctcagatcttttgctatttgcatgggatagagctaacagtgtgataggtttctgggacctcaactttacctaaagataaaaattgtctttgtcttaaatctttctcaacacagcttgtccattcccattgatggattggaattctttttagatgactgaggtaggctgcagcagtttgggaaactttaattacgtgccataattggtaaaatctgtttggcaaatgggagtagtgtacaaattggtgctacatttgtataaaaattagggaatttgttaataggtatttccaagctctccagaaattccgattcggtacttctggagtacagctcagggaatttttttttttttttttttttggagacagtcttgctctgttgcccaggctggagtgcaatggcatgatctcggctcactgcagcctccgcctcccaagtagctgggattacaggcacccaccaccatgcccagctaatttttgtacttgaagtagagacggggtttcaccatgttggccaggctggtcttgaactcctgacctcaggtgatctgcctgccttggcttcccaaagtgctgggattacaggagtgagccacctcgcctggctgttgttgtttttaaattaagttctttagtgatctgtcttacatgggtaaggcacaaagaggagtgagttaaatatctgtgcagtcatcattttgtccttggtatttgagtggaaactagtggggaattcctacatatgtacttgtgcaggacatggttatgcacatcatacttgctatttcctggttctagatatcagcattaggtaaagtagtgccctgtaaggcagtaacttctgtatctggttgtgtacctccttctgtcaccaatcttgcatacccatgataaggagccgggttattaaatccaacttggtttcaaatcgttttggagcatgtagagctgtttctattcatgttggttctgcttgtgtaataacaacattttaattccttctccctcagctaagtgacataaatggaagtatattctatcactggaaatctcgatactgatagtgcccattcagtttctcatcttccttaatttacacactagtaaatgggataagatgtaattggaattgtaattggcttattttttggcacatcactcttaacaccaaccctttaaaaaaaaattagacaataatggctgggcgcagtggctcatgcctgtcatcccagcactttgagaggccgaggtgggtggatcacctgag

SEQ ID NO: 86812 - DNA, 1056 bp, Homo sapiens
tttgtccattctagctctgctagtcctcgagagcaaagcctttcatttaacatcaatcagaactgtttgtagttgggtagagctgatgggggtgggggccagggatgatgatataccgtataagaaggaaagggggagttcattattggtgctagctgcaaagcaggatactaagtgatccgacccagtcagcagagctggcctgaatatctggcagctattctttgtcccgtgttcatgccagaacagttaactgtttgcctttgagtggactactgattcttagtgagttcattgactgaattagctgatcacggtaataattagctctaggtcaattgtggcttcatcttttatcatacctgtgcctttactctttacataaatggtggcgtggttaccatgtcaagcgagacatgtttaatgacaagtggatcttgttttgacatctggctagattttggtatctgtcagtgatagaacagttctttgattcttgggcaaacagaacaaatcctttcagattggaagttatataaagattagttcataggtgttattaacatcagcaacgttgtttttgtatttagtgatgttgttacttgaccaaggcctttctatgtaagtcaccccgaatgctgagttgttagtgattagaaggaaaaagttttgtttcagcccacgtctcatgagtaagatctccttggatcagattagacagtgatctactgtgaataagacccacctgaatgccccagaactagcttcattctagtgtccatgtctgtctacaaaacgagggtgtgaacatcctttccttataacagcaacaatgagcctggaagatgagttttgtccccatctctctcctttgccatttactgctacctcctcttgtaacttctggtttcccacctcgtgttgaaggttgaagtgaggtgggatgactggttttgtttctaggttctagggcagtgttgattatgctgatgttgctactgaggctggttttttctgacagcctttcctacttctccgtattatagataagaattc

SEQ ID NO: 86813 - DNA, 1023 bp, Homo sapiens
ctgggtttttaccatttcttgactttggaaaggtctgaaaccccagagcaaatggcaattctaattgattagaaaactggatttttccttaatagattttggaagatttaggagggtagcacataaagttcattctcccttttctcaccacatttgatgtgaatttgctacctctcagaaaacaaatttggtctctgaaataaagcagatgttttgaattctcttatataaggaaactgattttcctacatgtaaatttttatcttttaaccatttttatttaaaacttgtgacctacatttttctgtttcctccctgaagtctttgttagtggtcattttggagattaaaagattagggacctcattggagggcaagtcacatagcagacaccgaaggtaaactctttatagcctttatagtgctgtaccatctcaagggagagtggcttgattgtaccaggcagggctgtgtggggccctgagggggagtgagaggttttccttgtagagggagtctggaaatcttcctacgtacaggttatgctctcctaattctctttatttttattcctcctacagtctgaaaggcactttattatgcaggtggtctgtgaagccacacagtgtccagatacgagggtaagtgtgaggttatatgaaaaatctgtcttacatctttcttaggaaatgtcaaatctaatataagtttgaaatactgggaatcagttgacttcagcaataaggtttgattaatattgttactaataattaatattctggctgggcatggtggctcacacctgtaatcccagcacttagggaggccatggcaggcagttcacctgaggttaggagtttcataccagtctggccaacatggtgaaaccctgtctctactaaaaataaaaaaaaattagctgggtgtggtggcacgtgcctgtagtcccagctgctggggaggctgaggtacaagaatcgcttgaacctgggaggtggaggttgcagtgagccaagatcatgc

SEQ ID NO: 86814 - DNA, 1020 bp, Homo sapiens
gtgggaggattgcttgagcctggtggttgaggctgcagtgagccgtgatcatggccactatacttgcaccagggcgacagagcaagaagactgtctcaaaaaaaaaaaaaagagaaaaatggccgggcgcagtggctcacacctttaatcctagcactttaggtggccgaggtgagtggattgtctgagctcaggagttcgagatgagcctggtcaacatagcaaaaccccgtctctactaaaaatacaaaaaattagccgggcatggtggcgggcacctgtagtcccagctacttggaaggctgaggcacgagaattgcttgaatcggggaggcagaggttgcagtgagccaagatcatgccactgcactccagcctgggcaacaggagcggaactctgtcccttccccgaaaaagagagacaaaatgggaaaataaaggaacagataatgagggaattaaagggagagaatgaattttagggaaatgataacgtatcccatatttacctcaattaatccttaggattattggcccatttgagtgaatctaactttgtcagattgcgttgttattttagtaaactatctgatctgctgttcataaaaggtacgagtggctgctttacagaatctggtgaagataatgtccttatattatcagtacatggagacatatatgggtcctgctctttttgcagtaagtatttctatttatgtgatttgagcttgtggctaattacagagcccatcatccttagtcgctattttgccaattctgtaatattttacttaatactatggaatcaaggaaattcctcgagactgttcggtttaagctcatcagtggtgtgccaagaaaactggtgctaactttgtgtgggtaaaagaccttcattttgaggtcaggcccggtggctaacgcctgtaatcccagcactttggaaggctgaggtgggcagatcacctgaggtcaggagttcgagaccagcctggccaatatggtgaaaccccgtctata

SEQ ID NO: 86815 - DNA, 1945 bp, Homo sapiens
tggtggctcacgcctgtaatcccagcagtttgggaggctgagactgacagatcgcttgagtccaggagtttgagaccagcctaggcaatatggtgaaaccccgcctctacaaaaaatacaaaaataagctgggtgaggtggcatgcacttgtggtcccacctatggaggaggctggggtgggaggtttgtttgagcctgggaggtggaggttgcagtaagctgagattgtgctgctgtactccagcctgtgtgacagagtgagaccccatcaccaaaaaaaaaaaaaagaaaagaaaatctttcttttcctatcttttctttcaagcctagcttcctttttatagttacatttctgaaatttgcatgtctgtggttaaagccgggttggggcagggactcacttgaatcagtacttatttggggcctggggtgtttttcttcttaagatcacaatcgaagcaatgaaaagtgacattgatgaggtggctttacaagggatagaattctggtccaatgtctgtgatgaggaaatggatttggccattgaagcttcagaggtgagctggggagaactattactctgaatacgctttgggacatatctcatttgtggatgatgttccccttctaggagaactttattctgtctgggtttagagggtatctccattggcagagattttgatttttctgctagccagagcccttcatgaaggaggcacatcagtaatgagggctcacgttcttgccaagcagtcaggcatgattgatcgtaaatagtggtattatcactgtgaacacaagggggcagcaggctgtcgcagtttaccaaggtgatgcctgatgctgaattatttccttttggaagtcctaatgcaagcctaggatgtataattgatactttactaactctggtgaaagagtcagatatggaagagaatggggagttctgtacttgggatctttgaattcaagttttgtttccagcttggtctttacacacttttatttcaggacaaaaataaaaaggttttttttggcatctttaggcaaactgagtgtgtgttgatccaaggaacactgaaatatcaggttgtccatatgaattgaacttatgaaaaaaaagttatacttaatgttgccttggacctatattatatggcctaaaagattctcactgaagtagaccaaaaaattagcactttccaagatcacattgtatgttaccatttgtccttgtatgtttctgtttctgttaagagatccctgttcggctctcattgtatgcctttagtatacagagctcggttgcttttgtctagaatttgctttgtttctcctcaggcagcagaacaaggacggccccctgagcacaccagcaagttttatgcgaagggagcactacagtatctggttccaatcctcacacagacactaactaaacaggtgagttaccttccaaatataggtaggtaagctgtggaaccttactaagagtaaactgtggaaactttccatggaaggaacttcgcagcccatcaactatttgatgttctgttgttgatgacttagaaacagctaagctgcatctataagatcccctaggctctgacttctttgtgaaggagaactgagtcttaacatctcagatgcatcttgctcaggaatgagccacatgctgctctgatttcctgagtgctccattgtccaaactcataaaagaaaggtgctctgtcaaagcttcagtgaagcaaggttaggagcaaagatgtgctggttttaggccacttgcgtatctgttgtaatatccaggatactttcgtgagttcacagggtgtatgtttttaaaattctaaggaagttggatataagttattcagatgctaatgaaggaccccaacccaagaaagaaacccttctactgatcctttaagataattaact

SEQ ID NO: 86816 - DNA, 1229 bp, Homo sapiens
gagtagctgggactacaggcacgtgccaccacacccagctaatttttgtatttttagtagagatggggtttcaccatgttgaccaggctggtctcaaactcctgacctcaggtgatccacccaccttagcctcccaaagtgctgggattacaggcatgagccaccgcgcctggccgattttggactttacataactggaatcatacagcatacattctagttctgtattttgttctaaatgtttggaattcattctttttggatgtagttgaaattttttcattcttgttgtgtagtactaaatggaatcttcttccatctgaatcttgtttaacaaaggctatgctgtgatgaatgtttgtggaagagacaaaatataaaggtcttatattttatttccctggagtttaagttctaaagacattcaagagtagtcagaggacctttagagttaaaatgattctttggacaaaatcttaactagtgccatattctttcaccaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggtgaaactgagggatttttggagtagaaagtaggatatttattgtttaaacttaaagcatatctttatttttcaaaacaaaactgtaaattgtcatctacaaagattatctctagatacttgtttacttttaatgagggtaaaatatatttcttaggtttttaattacataagtcagcatgatccagagacatgtgaaagaagccaaaagagaaaagtcatctttaatttcattgcccagaaataccactcttaactctgtatttatccttgaagctttttcctatgtgcatgtgtgtgcaacaggctcttcctgtgcagattgttttataacttgtttcttcatttaatactatgttgtaaacatttcccaataatttttttttgcacctagcactgattccccataatttttaataatggcattattattctattctttggacaaaatgtcctttatgtaatgaaaatgttcttatggaaatgttgtgcttgttttgct

SEQ ID NO: 86817 - DNA, 2135 bp, Homo sapiens
atctaggctcactgcaacctccagctccccagcttaagcaattctcgtgcctcagccccctgagtaggtgggactatgtgccaccatgcccagctaatttttgtattcttagtagagagaccgggtttcatcatgttggtcaggctggtcttgaactcctgacctcaagcaactcctgacctcaagtgatctgcctgcctcagcctcccagagtgctgggattacaggcatgagccatcatcatgcccggcctctatctgagtaatttattgcagactactaaaagcatttacaccaaattcttaatataaaactctaaactggagttttgaaagatattttcaaatattttgaaagatgtttcacaccatgtcctgtaaaattacagaagtatcttggtgacttttttgagttaagccatccatcagtatttctttctctggggtagtagttaacatgaattttaatctttgttttgctttgctaataactgttatattttcaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggtaagggattttcttgctggtgagaaaaggagcttgcctgcgccactggcaagaaagtagaaggtgtgggagagaaatcaatctgcctcactggaatgctttttctgattttctttctaatttattcaattaaaatgtgggggagattccaactgcaagagccagtgggaacacttgacttatggttactggttcctgaaccacttagaacagtcatggtaacccagtggggaaactatctggacttgggttgctttcttgaattgcttggggacaagaagttttgattaaggtagagagtttttggctgtaagaagtatcattgctgagtagagggcaagagggaaggaaggtaggcagcctaaatgctgagtcagtataggctaatgtaattggttaaggggaggaagttcaaataaggaaggaatggggctaaacgtctttctgtgaaaggaaacagaaatgaaatggcaggtatggttgaaagtactctgctgcttagagagttgtcagattatcaaacaggatgatgagagatgtcagattatcagacaggatttctgtgattggaaacagaagaaatggcaggtattggtgaaagtactctgctgcttagagagttgtcagattatcagacaggatgaacaggaagtacaaatcaaataaataaatagttagtttaaaagatacctgtaaaatgctgtcttgagatgaccttggcagaaaaagttggaagttcactgacacggcccaaagtatcttaatgaaaaatgagataatcctaaggtgtggggttctttcaggattaacattgaacctatgtgcatttcaggctttctccagtctggctgaagctgcttatgaagctgcagacgttgctgatgatcaggaagaaccagctacttactgcttatcttcttcatttgaactcatagttcagaagctcctagagactacagacaggtaactgatatttcacagaaatgagtgacgtctttgcatccaagttctattgccttctgtgtggaggatatctagcttaatcatagaagcataatgagacaggacaagactctaccttctctagaggaattaaaagaaacccgctgggcgcggtggctcacgcctatattcccagcactttgggaggccaaggcggctggatcacctgaggtcaggagttcgaaagcagtctggccaacatggtgaaaccctgtctctactaaaaatacaaaaaattagccgggcgtgctggcgcatgcctgtagtcctagctacttgggaggctgaggcaggggaattgcttgaacctgggagatggaggttgcagtgagctgagactgcgccattgcactccagcctggacaacaagagtggaactcgtctcaaaaaaaagaattccatgattgattgattggtttgtttaaagatggagaaa

SEQ ID NO: 86818 - DNA, 1022 bp, Homo sapiens
ctgaggagttctgcatatgaatctctgatggaaattgtgaaaaacagtgccaaggattgttatcctgctgtccagaaaacgactttggtcatcatggaacgactgcaacaggttcttcagatggaggtgagacctaagagtgcccctgactatgggtgggaattgggtagtacttttgacacctaggtctgttttccagactgttctgtctttttagtgtttaagtatatattttctcagaaagataataaagcttatacaaaaaacattgcaccttaacgttagcattgtttgtcatggtttactcatatatgtgttacactatatgtattatgggttttttgttgctgttgtttactttcctatgttagtattagggaagattattaaatggtcccagcaaaagtggaaggttttcatgtagagtatgttttcttattttctttgtagtcacatatccagagcacatccgatagaatccagttcaatgaccttcagtctttactctgtgcaactcttcaggtatggtggtgccttatgacttaataactccaggttggagaattattagtatctcagtataacaagttcgtgtacacacagaactcgaaaatggtatagatgatgcggatcagaagctgttctcagaaggctttggtctgtgattggttgattgggagaggaattccccacctgccttacctgtctgtctagaaagattcaaatcctacttatttacagatggtctagatgtaatcttgataaaatcaaaccaacttgacttctcctaattcaacatacactcctcagacctctcttcctcactcgtttgtttcaactaatgtcactgtgtagagaaggaaactacttaatgtgtgatggttccttccagatgtatagctcatttgtgttggcagcttgaatggttttggtttttttattttgaaaaccaaaaaactcttggtttttcattaggttattcaagcctagctcagtcagatttggttcccagctatagttca

SEQ ID NO: 86819 - DNA, 1050 bp, Homo sapiens
cattagttgaaacaaacgagtgaggaaggaatgtttgatgggagaagtcaggttggtttgattttatcaagtttatttctaggtcatctgtaaataggtaggatataggaagggttgctttttgtttgttttatgaataagagctctaaggtgatagggccttctctaaagctgaagtaatttaactatcattccagtaagactggactatggcggctaccagcagggatttgtcagacagtaagacaaatgaaattgagaggacatgaccttctgcacaacggaggatcagctcacgtttgttctgaattgagaaacaggagaaatgttaaaatgtattgctgatgattggtactgtcaatgtttttgtgtataaaatacatttggcattcccaaaattaaaaaatatcaagggacttaattgattttaaaaagaaaaggtatagtgttctgattgggagatttggaatcaactgatcttgaactcttactcatttcacagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaaggtcggtgagaaatactgtctggtcagggaatgtctttggaatgtaggcatttcagtggccttaaataattgtcacccaggctggagtgcagtggcacgatcttggcgcactgcagccttgaaatcgtgggctcacatgatccttccacttcagtgcccccacagtagctgggactaacagatgcacaccaccatgcccagctaatttttatatttttggtagagatggagtttcgccatgttgcccagactggtcttgaactcctgagtcaagtgatcctcctgcctcagcctcccagagtgctaggattatagatgtgagccactgggcccagcttaattttgtttgtgtgtgaagatagggtctcactatattgctcaggctggtctcaaactcctgggcc

SEQ ID NO: 86820 - DNA, 1850 bp, Homo sapiens
gtgggagacttgtgccgtgccctgcaatccaacatcatacctttctgtgacgaggtgatgcagctgcttctggaaaatttgggggtgagtatctacacacaatctaattaaccagtcttctttgaagaaaacaacagttggaaagatagttaaatatcgaccaggctgggcgcagtggcctgtaatcccagcattttgggaggccgaggcaggccaggagttcgagaccaacctggacaacatggtgaaaccccgtctgtactgtagatacaaaaaaaattagccgggcgtgatggcaggcgcttgtaatcccagctactcggaaggctgaggcaggataatcgcttgtacccgggaggtggacgttgcagtgagccaagatcacgccattgcactccagcctgggcaagaagagccaaactccgtctcaaaaaaaaaaaaaaaaaaaaaaaatcagtgacagggagctgtaagtttctagaacattggctttgggcttataaagaggggagttgttcatttcacagatgactctgaagaaagattgtaaagttaaaggaatgtgtgctctattagagatttttaaaacaaaacagtaaaatgcaaaggaaaagtaaatacagttgttccttgacttatgatggagttaggtcccaataaacacattgtaaagtggagaaatcatcaaaccatcatgagcaggggaccatttgtatattatacctctctccagagatagccatcattaattattgtacatgtgtgttctcagacaagtcacttgattcttaagtcagtctcctcatgtgtaaagtgggaataccaatacctgggctagcttcttagagttggtgtgaggtgcaaatgggaaaggttttgtaagctataaaggaccatccaaatatttaaaatcaatagttgcttgttagaaatgaaattttcatgaatctttggaccaaacaagttttgacttaattcacttttccttttgttccttgtcagaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaaggtaagcttaaagctatcttggctgttctttaagtctagctctaattggagggactattgacaaacatgcagctaaaagtgatcagtgtgatgtaggttctgttctttgtgtcttacagtcagactatgacatggtggattatctgaatgagctaagggaaagctgcttggaagcctatactggaatcgtccagggattaaagggggatcaggagaacgtacaccgttgagtatacaacccagttcccttcgtccgctcgccaatgtgcacttagccaagtgggctatgtctgtcattctgtagctcgcttgtgaacctagtgcctgttgcttaaaaggctgggagaagggggagcagtgccctaatgaagagagtggcttggggaaaactgtagactactgtttttgctctgcttcttctttcttttttttgttttgagacggagtctcactctgttgcccaggctggagtgcagtcgtgcaatctcggctcactgcaacctccacctcccaggttcaagcagttctcctgcctcagcctcctgagtagctggaactatacacatctgccactatgcctggctaatttttatatttttagtagaggcaagctttcaccttgttggtcaggctggtcttgaactcctgatctcaattgatccacccgccttggtctcccaaagtgctgggattacaggcttgagc

SEQ ID NO: 86821 - DNA, 1633 bp, Homo sapiens
gtcgacttgaggaacgacacattaatcaaaggaagaataatttgatataactatatgcatctagttatccagcttggaccttgtatgataggggtataatagttggaaattttgaaaaaggatgtagtcctgccatatgagggacagctgcatcagaccttctctctcttttttttttcttttttttttgagatggaatcttgctctgtcgcctaggctggagcgcagtggcgcaatctcggctcactgcaagctccgcctcctgggttcacgccattttcctacctcagcctcctgagtagctgggactacaggcgcccgccaccacgcccggctaatttttttgtatttttagtagagacggggtttcaccgagttagccaggatggtctcgatcttctgaccttgtgatccacccgcctgggcctcctaaagtgctgggtttacaggcatgagccaccgcacccgaccaataccttctctctcttttatagcggatgtgatgctggtacaacccagagtagaatttattctgtctttcattgaccacattgctggagatgaggatcacacagatggagtagtagcttgtgctgctggactaatagggtaagttataccctgcttctaagagctgaatagaacttctcacagaaaatgagaaaacatggagtaaggagttttgagagtatcgcggatggcaacagttcacttttttggcacagagatttctttgcagaacgcttcatgtcctgttttgagtgttcacatgatagtttattccagaccctcaaggtgtctgtattacaccccattaaactctgatgttggtcaacaattgcctctgtctagtgacctctactgagggttttatttatctttgaaatttgctaagaaacccatagcactggtttggaaggctcaaaacattatactggtatggggctaggagctcattctcagctgtgtttgttttgcacagggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttggtaagatcttgcctccactgtcctctttcttctacttcctggaggaggggggtatgttttctttaggccattctggcaagcactgccttctggcattttttttgtttgtactttttcccatgtaggtgcttctgagtcaggcagcctcagtttttccttgagccaaatgtttgactcctcatagtgatggagagcagaacttttaaaactggaattcactgaaattccctgagtattttgggtcctaataaaatcatcagtaatgccatttccccctaattctcttctgttttctattcctttcctcatgccctattctttctttacagcagtgcttttagacgttgcctagctctagagaagatttccaaagtcaaatgtttttttgtgtgtgtgtgtgtgtgtgtgtgttttctttttgagacagagtctcactgtcgcccaggctggagtgcaatggcacaatctcggttcactgcaactgctgcc

SEQ ID NO: 86822 - DNA, 3495 bp, Homo sapiens
gtctcccaggtgtgcaccaccacaccaggccttggctcctactttgaaatgcaatcttgtttgtttggagacagagtctcctctgtcacccaggctggagtgcagtggtacaatcacacctcatagaagcctccagctcctgggcttaagtggccctcctgcctcagcctcccaggtggttgggactgcaggcaagcacctccatgactggctaatttttttttatttttagagacaagatctcctgttgcccaggctgggtttgaactcctgacctcaagaagttctccctccttggcctcccaaagtgctgagattaaaggcttgagccactgcacccagactgaaatacagttttaatttctttcactcttaattagttatcttactccacagatctcagtaaaattggctctttgagtttccctcgcaccctctgatgtaggtgttaataagagcaggtcaatggcacataggacaagaagaaagagtgtcaatccttgaaatgttgacaaattccattcaggcctaggagcatgtaattgtaggagtcagcattattggctctgttgggtatatgtgatctcaaagattgacctttttttccatctgttttcagatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattttcaacttcaagtcattgcagtttctttttcccagaaaacaaggggttagatgttgcatttcataaaactaaccgaagttttgtttactgatgcagcacaagagatgtaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataaattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgttgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaag

SEQ ID NO: 86823 - DNA, 1064 bp, Homo sapiens
tgtttgggatctgggacattccctttgctttcctctggggcccaaacccatctcttctggagatgccagggctaagtgacacttactcggctgctttgtcgctgtgtccagtgtaatgtcccctgctgagcttttgggcctccgtagggccccattttctattccagtgacaaggcccggccagttgggttcaccctcccctccctagtgaggaagagggaggtggtgtttcttgggatttgttgggccttgtctgctgatctcaggagagagaagcctgaggcttagagacaggagaggtttccatgggttcacacagccgtggggtggggagttagaatctgctctgctagggtactcccttgaatcctaccaagaaaggggcagcagagagcggcaagggagctgtgttggtggggggcccagtgctggggcctccaggggggcactggacagcaagggaggggtgagcagccacccggcaacagtggaacctggtgcctttcacatccgcactgaactcaccctctcccactttctgagaaatagagctcaaacctctttccgcctaagtcctctcccctaagatgagctgtgtggcacagactccctactctaattggaggagaagactgaggcccagagaggggcaggaactaaccctccaccgcatagcatacccagctccggggctccggaggtctcctgcccagcaggcttcttccttatctgcctcccagcttctggccaactggggatacccctcgcctacctccctacctaagagtgagggcttgggtggagctgtgatagctggggaggtggtgagaacccagtttgtgggactggtgggtgggacccctcagctaggcctttgtggagagggtccaccctagcttgtggctggagcttggggcccatcatagcccatgtgcccagacctggaacacacagacacacacagacacacacacacacacacacacactctctctctctctctctcacactctccaatcctagcttgccccagaagtcatgatgtagggcccttcatgggtcac

SEQ ID NO: 86824 - DNA, 1102 bp, Homo sapiens
gtccagcccactcttaggcgggagtcttctgtatggtgaactctgtatgtatgtatgcccacctgtcttggtctagacacctccggggcagccagttttattgcgggagtcctcaaggttaaccgcccccacccccatctctattaattcccttctctggatcctagccccagccccagggtttcccagttccttccctcccagcccctggcccacaagttctggccattaacgttcccacgaaaacagacacccagaccagaccgaggcagactactaccctccaggtctgaccccctgggaaacccatggtttggtttgcccagctcctggggacagagcccagggagacaaattgccccagaggaagagccactgggggtcacgcagaggccaaaggcagtgatgagggaggcggtgggagcagagcccaccctgctcctgaggatgcacagggaggtaaagaccctgacccttggggggttcccagcccaggtggaaggcgcagcacccacaacccccttctctctgggcccagctccccagcctggggttccagagtggggccttttggagggtatggccgtgctgagggggaggggaaatgcgggggggggaacttcttgaaggggatgagggctccgaagggacagggggtctgtgaggggaataagggcccggtaagggagggtgggctcatctgtgcggggtccatctgggagaagatggggactcagtatgggcgatgaggaaaaaactataggcctttctttcttcccaacgttgggggctcagcgctgcagcccgggcccttttccgcaccacctccccccccacccctctctccacccacaagcctctgcgtgggctgcggttagtggtgggaagaagtgtgaactcgagagagaggatggaaactctgcacggaggtcaagggcagcgtggggtgggtcaggacggaagtcggagacccccgcataccctgagcgtagcctcatgccccagaaccagcaggcccagggcctcccccttcacgcttctcaccctccctacttcctttctttcaagtctccttcggccagggcacccgcgctgcactcac

SEQ ID NO: 86825 - DNA, 1680 bp, Homo sapiens
taataggggtcagggccaggtggatatattaagagttttctgagggaagagtgaagaagtagggatcgatcccaagcagagtgggtgtggtgtggggcacagtggaacccaggtcctggggaaggcaggattttgagaagggcaatggagagcaagttactagggtcagaatattgttttcagagaagaaaggcaatctgcaaggagcctaactgaccctgtgttcttccaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctacttcctttattttgtggtttacacggttgtcctccctctaaacttactctcaggggcttctctgtcatctgactttcctcactcttgcttcccttcctaggaaaatcctcttcccctatacctgttcccacaaatggcatcccgcgcatgcttgccctattaaaggcagctgacagctgtacccactagctaacgtgtctctggtggttctggacaaaaggcctgcgggaaaactaggattctctattaatggggaattctgagagctctagggtaggaggcctcatgcaagtcttcatgaaccagaaattcctaataaaggagacgggatgcttaactcagagtccaccatcatccttgactggagcacattctgggtggatgcaggggtgacccggggaaggtggctgttcaacattccttctcggacttgaagcaatgccaccgct

SEQ ID NO: 86826 - DNA, 2109 bp, Homo sapiens
gaggaggtggcacccgggaccgagctggggtcttggaggaagagagggtgaggggaatacagtactgggggtgagagaagggttggacagaagagggtcgggtatctgggcatgcgcagggccgcaggactcttggtggggtagcgagggggacggtcccacgactgctccgaagggccgggactcccagtgggggcgggacccccggagtgcccgcctgcggactcccaagcctggagcctggggagagggtgggcacctccgttcccgcacacccgtccatggtgtgtgcgccgagcgtccaggagccacggcggtgtcttccttgcgcgtcttttacacgtgtgggggtaggctgctcctcggggctgagccgtggccagggttatggagaggcccgcctctccccagatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccaggtgggttagactttatggggtgctgggaggtgtggcagatctctgcattcttttaagaccttcttccctgctccccacacctgggaggctgccagaagtagtggaagagcatgagctttaggtctaccaacctggacctgagctcattatgtagcctcagtctacctcagtttcctcttctgtaaaatgggaatgagaccttcctcaaagggatctataaggtaattggcagagtgccacactcgaggggccgcccctctatgagtggacgcttcctttctcctccctcacctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggtgcagaccctgcccttcctcatctgcctgacacaccagaaatctaggggctgagttttgacctgggcccatccatccctcccccagcctggttcacaggggcctcctcctctctgcagactttgcccttgtgccttcgtgaagaaggctgcagcagcagccacctttgggcctctcctggcccagaaatagagcagtggttatttatttattttcagttgaaatcttacatagagtcccaatttataaaaccagtaatagtggatggagcagctctgggtggagagaggttaggggctcaggacacttctctctctgaaactgtgtttcaggccttttcatggaaccctcaaagcatagcacatggaaccagagcattgaaagccactggcataattgcatttgatacgatcagtgccagcagatttgctgtgtgacttgggcctatcaccaaacctctccgggcctcttctgtcccctggagcttctgccaccagccattgatccctctgtcacccttctgtcccttggccctctcttttgccaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccagggtgaggtgttccctttctcccagctttgggaagtgggagagatggtaggggcagggaggggcccgatccaggtgcaagcctgtcaggacatccagggagatgggagatgagcccacttgggaattctcctccccttcacttggttaagtcttccgtgtgctacagcctgttgcttcctctgggaagccttcctggacttccctgggtggtcaggtttcctgcttatatgcaagcaggtacttctttttcatcgcattcaacacagttgcatgcttacatttatctctgtgattatttt

SEQ ID NO: 86827 - DNA, 1048 bp, Homo sapiens
ctggccacttttttctctcagattctattaaagtttgggcctctggagaggcctgtcagagaggagaaaagaaattataagatttgggcaaatgtctggggtaaagaagctttatggcatttcagcaagtagagtggttggttcatttggatattttggccttgaacttcttatttcttctggtggttaataccagctttttggagaagttgaacagtcctttgctataggtctgtggcagatcccaagtactgtcagcaagtatagtattgcccaaccagggcccttatgaagacattttaaacttgttgcagccaaccagtagaccttagtattggcttggtttcagccatcttctaaaccttgcccactcatttctgtgatagatatgtataacatgttttttttctaatacttattttttcacacacaccccccttttctgtatacacaaaaattggaaaccctgcttccaaacactgaaaaacttaggatattttggatcaggtggacaatggctatggaatgaaagatgcagagaaacactgctttaaagagtatgtagagagttacagagtttagggatgcagtagcgtgaacacttctgagtttacaagatttaacctcatggccccatcttaaatcttgcgggctgcaaacctggagtaaaatctgttcagggaagctcatatgctttcttacaagttcattgggtgatatgtctggagttttccctttttgcaactgacttggatttgtcggaatttcttcccagcacctacaggctgaactaaaccagtatccagtacatttctgggctgataaatggacatcattttggaatgcatttgttgcttttttgcttgtttttgccttgcttttgttttggatatgcgtgcaactccttgtatgacgttgtctagacctgttgtaggaggaaaaaaagttctttctctttatttcttcccttgtagagccaacacttagatctttatgtttctgaaatgtagttgagtgtctttttaaagatgctcttcctcaattatca

SEQ ID NO: 86828 - DNA, 1037 bp, Homo sapiens
gcagagcggggccaatgtggtgaagctgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtaccacactccctgtactgtcctccttctcctcctctggttatctctttttggcttgctttgaagatgatgctggtcatctcccagcttgatctgaccttgagagtcagtatcttttggggtgggcagtaagtggccgtttctacctgacaaatgggctctctttagttcatagggccaagtacttcttatctttagaaattgatgaaacatagggatattttggcaccttttccttataggttgttttttttcaggggatggtgaggggatagatacatacttgttaataacttatttttgattatagaattactcaaaacattagcaagaatgaaaacattccagttcatagaattttatgtaaagtaagaaaattaatgagaaaaatgctgatcattattaatgacaagaaaaaaacaggaagagcagcctagctttatagcaggaatatttaggctagattcatctggaatgtttgtttgttttagggtgttttttttttttttgagatagggtcatactctgttgtccgggctggagtgcagtgatgcggtca

SEQ ID NO: 86829 - DNA, 1310 bp, Homo sapiens
aggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaacttggcagttcggcttcctttgtcttttcccttggagagctcggagaggggactccagaggagggagctgtggtctctcagagcgatccacactgggaccaaggtaggaccttgccctcctgaccctcggcaaacccaagccacatgcccaaaaggggccgcggccacatatacctcatgacactggcacgagcccccagagcacctccaagggccagggcccaatgcaggtgttcctgccttttt

SEQ ID NO: 86830 - DNA, 1117 bp, Homo sapiens
cacaaccagattacccttttctctatgtgtccccatcaccttgcctcagagtctggcccctaattccattttccatttttcttttcccattccactagtctcccttcccagggggtacttcctgccctaagctcacctacaggcacctactatgggccagccacttaatactgactactcccctcaagcccccgggacacatcctccgccccgcctgagctgcaagagatcctcctatacctttaaccaacctccacgtgcgtgttaaccgcggtgacagcatttccttgtctctctgctcccgcccccaaaggcgctacccattggccgctgggttcctctgttctcgctctaattggcctcgttaccgaaaagctccaaccaatgacctctccgtgtctgtctccctcctccgatcctggaaactcattggctccgaggacttaggacctgttagcttggttgggcgactggcaaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggtgccgccgctagggccaggcctcctgcaggggcgggggaaaaggggtccccggagtcatctacagcggggaggggagtagtaggagcccctcggggcttctggggccacccggtggggcaaggaggtttgaggatcaccccccgtgggaaaagggggcttcaaagacatcccaccaggggaggagttccggggaaacgcaaatgaagatgggttcaaaaggcagcctttcgtaatgggtaagagctcgaactttggagcctgcctgggttggaatgtttaatgtatctgggcctcagtttcctcatctgggaagtgatagtatctgcctcacggggatgttatggtctaagatgtttgtaaagtgcttagaaccctgctactcgacaggtagcaaggt

SEQ ID NO: 86831 - DNA, 1098 bp, Homo sapiens
gtcccactgcctctctgtctggcgagtggcttccctgtcttgaccttgactttgacccttttcttgtctcacactctccaaaagcattgtgtcaccccactgacctgaatcttgggtttattcagccctaccttaaattctttctttaattcttcttcttcttcttctttctttttttttttttttgagatagtctcactctgtcacccaggccggagtgcagtggcatgatctcagctcactgcaacctctgcctcccgggttcaagtggttttcctgcctcagccacccgagtagctgggattacaggtgcgtgccactacgcccagctaatttttgtatttttagtagagccgggatttcaccatgttggccaggcctgtcttgaactcctggccttaggtgatccacctgccttggcctcccaaagtgccgggattataggcatgaagaaccacgcccagccctttatttaattcttaaaacagcccatgattaggagtctgcagcaagctggtccaaaggcacccacccccttttcccactgacccctttgtctcccccaccctgctccagcagaaagccccatccttggcttagggagcgccatgacgactgaaattggttggtggaagctgactttcctccggaaaaagaaatccactcccaaagtgctgtatgagatccctgacacctatgcccaaacagagggagatgcagaacccccgaggcctgacgctggaggccccaacagcgactttaacacccgcctggagaagattgtggacaagagcacaaagggcaagcacgtcaaggtctccaactcaggacgcttcaaggagaagaagaaagtgagagccacgctggcagagaaccctaacctctttgatgatcacgaggaaggacggtcatcaaagtgaagggctgaggagggtgctagcacctcttggctccctgccatcagccagatctgagacaggaccttgccacgctggcctctttggccatagctgaagctgtggggccagttgatacctgctggcaggaaatggctgttttttaggtttgtatttatgtgccgccacttttgtaaggcct

SEQ ID NO: 86832 - DNA, 1188 bp, Homo sapiens
tgaccaccattcattgagggtttttttttgtaccaggtgctgttttaggcacttgacatgataaaaatgatcactgtcattttttgagtccttgccgtgtctcaggcacactgttcagtgttttacctgcattcccttttctagtcagtgtcttattattccccattttacatgtgggaaaactgaggcacagaatagtagacttgctcaagaaacttgataacgagaacccaggaccatctgaccacaaagctcagctcttagctctcactgaggaaatatgcatggctctgaagccacaaatctgggcccagactttgagaggtcagtcccattggtattcacatgtacagggtggtacttcactgttcacaacagagtcatgttatctagtccttagggcgctgtaggtattaggggctttgcagctgttcattcatccagtacttggcataaccatcttgtattttccattgtcatggttaaccccagccctgaggaaatggaagttgagcagcatcctcttgtcaggaagaaagatataattacccatagaagcaaaaatattatggggaattgagaatggtcaaaagtggcactttcaggaccaatttaaactttttgttatccctgtgttgaggcaattgctctataaaaatcacactgctaatgaagtcagattgtcagagcctggtttagccccaggcatctctttgggcttgtctttattcccatcttcccatgacccccatactttaaccaatgtaaagaaaacttttagactaatttcagtgtatttcactcgaattagtgatggaattttggtgatgtgaatgggaatgctctaatttgggtgcttctcatgtagattggctggtggacagaaggcactgcagcctgaaatggcagagtctggtgctgacgatccgcgagaagatcaatgctgccatccaggacatgccagagagcgaagagatcgcccagctgctgtctgggtcctgtgagtgcttaggggctgtcactggagtcccctctttgctgaggtagtatgtatcagctgagctactctcttgttatttagccaccagggctggcctttagagagggagcgatttttatttgaggtatagatgctggcttcttccactatgaaatgatttagggaaaagctacacactaaagttactg

SEQ ID NO: 86833 - DNA, 1902 bp, Homo sapiens
tgtcttcctctgaccccgtctgacccctcagcctggttgcaccccctttgggccagtgtcttacttttcttcggtctttggatgttttcttcaatctgttggactccacctcttctcccctctctagggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagaggtagagaggcctcagcttctcctggtgggggtgctttgcctgtgttccccagctcatgacccttctccagttgtcttgttcccatataacatttgaactctttacacacctgaacctgtgggggccttgcccatttgaccatgtggcccaggccaaagcccagtgttggccttacgcatggtcggcaggagagtcagttgtgtgctctgttgaagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcggtaagatgggccttgtgatgagctgtaggagtggagtgggagctgcttgtcccctccccacccccaacagcccaacccaagacccagagagaagaagggaggatttctgtgagagtgactgtaggtagaagggcccaggaggccctactcctttatttttctgagtataggtgagtgagtgccacagaggctttgcaaggtggttcgctttgaactcggaacctccatcatgtgagctctctgaagatgggctttctttggggtagcttagaggccactgcatttgaacagtgtgctctctacagaagcagctgaggcctgtgggaaggcagccccaccctcctttttaaattaatttatttttgagactgggccttgctctgttgcccaggctggagtgcagtggcatgatccttgctgactgcaacctctgcctctcagcctcaagcgatcctcccaagtcagcctccaagatagctgggattacaggtttgcaccaccactcctagctaattttttattaacatctttgtagggacaggattttgccatattgcccaggctggtctcaaactcctgggctcaagcaatccactatcctcggcctcccaaagtactggggttacagacatgagccaccatgcccggccctttttaaatccatcttccatgagctaacactctctttccctttccagattgactggggcgactttggggtagaggcagtgtctgaggggactgactctggcatctctgccgaggctgctggaatcgactggggcatcttcccggaatcagattcaaaggtgaggaggccttctcagtctgtctctctctgatcactactctaaccataagaaaagtgtcatttgtgtctgtaacggcatcacttgaagttcatagctctaagaccaggtatagtccaagggaggcagagtttcacacgtcacatgtcagagttttgttttgttttttgagacagagtctcattctgtcgcccaggctggagtgcagtggtgcaatctcggctcactgcaacttccgcctcccaggttcaagtgattctcctgcctcagcctcccaagtagctgtgattataggcgcccaccaccacacccctctaattttttattttgtttgtttgtttgttgagacagagtctcactctgtcgcccaggctggagtgcagtggcatcatcttggctcactgcaacctctgcctcccgggttcacgccattctcctgcctcagcctcctgagtagctgggacta

SEQ ID NO: 86834 - DNA, 2359 bp, Homo sapiens
attggtgttgaacatggaggtaagactccgcagactagcagggtatagaggaggtaagtggactgcactctggcctcaacactcaggagggatgctcttggcttagggaactgcctgctgctcttggtccctctccctctgggagattgccttctagctcctgccccacctgttcagctgctggctccgttggccatctggccagcctcttgcagtagcagtcagttcactgaggcatactacccttgcccactctaatgtcctttgcccagtcaccagctgttacgcagactccattgcttacagcaatggagcttcagggagaaaccccgtggaccaggtgaccatggcagaccgggttcaggcctccaaagcttctgcccctgcgcttgcagatgagcacctgacctgctttcccagccctgcctaaggtcagcgaggggaagcagtgctcactgaggtttggctattttcccaggaagggaagtgggtttagatagagttttctcagctgattttggcccccttggtaagcagtgtggttaggccactgctctggatcagagatactaggtgactgcttaacaggtgacatcaaggcccaccctgatccccaggctgaggcaagtggtttcatgaaagcctttaactcgataacattgggtttgttctccagaacctttagcctccctttcctttaccgccgcctgcttcctgagtccagccctcctggccatgctgaaggcactgaagggatccacccggctggttctccctggcaagagcagctctgtgtctttcaggtctgcctccagcttccctgagcttcactggttgtatttgggttcctgcttgtgtatctcagaatgccctcagaagtcgttgtagggacagaatgagttaagatatgcagagctcttagaacgctgcctggtgcggaggaggctcttggtggacatgtgtgagctcttatttttggtttggggaaccatgatgaggactctccatcctggcctaacttgtcttcttggaaaggagaggtgaggggctttaggggagcttgagaccaagtttcaagcagtcaggttgaaacttccctctttcagggaaagagggaagcggtgcaccaagattacaccctcagaatccttagtttgatgtgaattatgctgccaagagcacactatacttttgtgttgacttttatcccacctctttccagagaggatttaaggcaacgcctctcactacttggctaagactcctcacccggcttcagataaggaagcagcgagtcacctttccaaaattctctgcttgctaaatccagccatggctcagccccactcactgcctctctgcccaaacattgcctctctccctgcgtcagttctaccgtgtcctctccggtgtggttctctttatagaccacaaaagtaggatccctttgcactgcagcctgcagtggctgactgtgaacatgggataagtggagtgctaaggctcgttcatctgggccccagcggtccaccccctgtgcccctctgagggcctgccagtatcatggggagtctggcacatctagaattcctttcctattgccagttcagagcagggaacaagctgcatcattcagagtgaacatctcctcacccatctaaagaattaacctgctctggagacctggccgggagttgaggacaaaagaaaggcacatccccagcctttgggagcagaagccaaccttgctggagctcctcacatgcacctcccaaccaccattaattccccagaattaatggttgcgtacagtttctccccagaaacccaggtcctgtggctcttctctgccttttcatacactcctacctgttctgttaatgatttttatttcatctgtttttaaaacttattatttttgagacagttttgctcgtcacccaggctggagtacactggcgcgatctcggctcactgcaacctttgcctcccgggttcaagcgattcttctgcctcagcctcccaagtagctgggattacaggtgcagtagagcctgggtttcacagcattggccaggctggtcttgaactcctgacctcaggtgatccacccacctcggcctcccaaagtgctggtattacaggcatgaaccaccatgcctggcctaaacttattttatttatttattttttttttgagacagaacctcactctgtcacccaggctggagtgtagtggcgtgatcttagctcactgcaagctctgccgcccaggttcaagcgattctcctgcctcagcctcccgagtagctgagattacaggcacctgccaccacgctcaactaatttttgtattttt

SEQ ID NO: 86835 - DNA, 1125 bp, Homo sapiens
cccgtctccgcctggacgtggcactgtgggcgggaactctcatggcatgacagcggggagacaggctgctgccacacccacgctgcagatgcaggagccagaggtctgggcaggcttgggcctgaggtgggagctggctgcagccggtttggtctgcgctttctgacttggagggttggccgcgtttaagccaagtggagacaagctgctgccacctagtgaccggtggttgcaggggcgcttcggcaaggtgggctgtggacctccccatgactgtgtatggaggcatttgacattctcaattctctctcaacctcccccaccccaccccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgccaagggtctccttctctcttggcctaggaagtgtgtgtgtgtgtgtgtgttcatataagggctcctgcactttctgtggctcatcgtggggatatccagtaccagggtggggcgtgtccctgtggttgtgtgattgggcagagatgtgggacaagggaaaggggactatttaacaccatgagggggtgcgacgctgataccacggagccccatgtgtggcgcatactgccaggtaggggagagcaaaatatggtacccctattttgcaatgcagtacatacatggtagctccgctggggattccttgagtcattttttccattcccaaactccagaagggaagagaggtaaggcttcctctgaacaaaccgagaaacagcatggctatttttcttggcatgcctggaaccgtggaattcctatcctggcatacatcctgggcactacagctctctgcaagcttgcgggtggtgggggcgaggaagc

SEQ ID NO: 86836 - DNA, 1023 bp, Homo sapiens
gtaaggaagcagaactgccctttgctcagaaatgccttgcatgggctctgtgctcactgcccttcacattctccttcccagtccttgtttggtgaggggtgaatgaggcagtctttggagagtggggtcagcctcacctaggcagggactcagttcctcccagccacagggaggctcaggagcttgtgtccaccttcaggaagaacgtggagaagcgctggttgctggagaacatggacggagccttcttggtgctggacgagattgtggatggcgggtgaggaggggacagtcagggacactcacagcaggagtgcctttgataatcatcagccccagatggcacccagcatggctagaactctgaccaacttctcactcccttcccccagcatattcccagggatcccattcccctagcccttccccttactagcgccccactcatgaagatagaagttgatttcaatgttagccaaagtcaagccaaacaagagactaacctgatgtcaaactatgggagactgttgaataggcagggtttggggaaaatccagtttggtctccaatgcccaggggaagcactggcacagatgctggccctctctggaaggacttcagacagtcccaccagccccacatgtcctgctcttagggctcaattccaacacaagctagatgcgtgacctgggtcaattactgaccctccccgaggcttactttctccatctttaggatggaggtaataagggattgtggggattaaatacatgtgtgagaagatacatgtgaagcttgtggttctcattcaatagatgttgcctcctattggtatgctagtatattcttaggaagctaggagctcttttgagaaaagttggcttgtgaatttccatcaggggatcaatattcagagagaaaaagaagttctggctctggggcaaaggataataaaaatttcttttttttttttttttgagacagagtctcgctctgtcacccaggctggtgtgcagtaagtgg

SEQ ID NO: 86837 - DNA, 1889 bp, Homo sapiens
gcggcgatacaccttcctattccctgacctaggccttcattcccccgccacagaaagcgctggaagcgcccaacctggatacttcacccaacgcccaagcccactaacatcgcccgccgcgaaggcgcggccgaggggcccagaatgccagacactagggccttcgccctcctcattggtgggtccataccgcggggcgggcctaggtactcattgggccgggaattatgtcagtcttgggaaatcaggtccggggatgaggaggtacactcagccattgggccctctctgctgccaatcagagggacatccgtcgacggccccggcctcggctcgttgattggagaaactgttcctagggtgtttgcggcgggcgggtttccgagtgcggtagcaggagggggcggggaggtaagcggaggctccgagctctaggccggccggcggtggcggcggcgaggccgggactcgggcttagggcctgctgtggaggcagcggcggacgccgagctaagcagtgggtatcgggcacattcctttcccagaagggagggttgcagcgccgcggggccgaggcttatggggcgacgggatggtgctgaggtgcaggaggcgggggccgagcggggttcccgccagagcccggccctgggcctgacagggaggggccccgcgcggggccgagaggaaagctggctccggggtgggatggactgggcagggttgagggcacgagaaggcgtggtgtgaggcctggacttgggagtggggtggggccatcgggacggagggcggggtggggtttgctgtaagggtgggtcaaggccagggaagtagcacttgttcgctggccgcccctggaggctagaagctccggcgccgagagtgggcatggcgacttggtctcagccggactcgggtatccgggcagggtgggaccagcctcaggctatgggccctgcacctacttgatttttaagggactttgtccggttcctcgaacttaattggctcctgggaggttttagtaataaattgcgtgagaacgggagggtagcgtaagcaggaattctgggtcgcaattgtgtttactctgaccagagagagggagtgtgagtgtgtgtgtgtgcgcacgttcgtgtgtgtacgtatagctcgctctccccctgtagaatgaagttggtagatgggtcacaacgcaggagaggagaggcggtatgtcttggtttgtgacattaatggaagctcaaaagtggagaccagaaacagatttacttcctctgcactgggcagtctggctagagaacgtggccatatccttctgctttggctcagaaggtcatatgaatgaaaataaaacctgcctatgcaaattctggacggaatagtcctgcgtagtagggcccccaccatccctctcctttttttctttccttttcttttctttcttttttttctttttttgagacggagttttgctcttgttgcccaggctggagtgcagtggcgcgatatcggcccaccacaacctccgtttcctgggttcaagcgattctcctgtctcagcctcccgagtagctgggattacaggcatgcgccaccacgcccggctaatttttgtatttttagttgagatggggtttctccatgttgttcaggctggtctcaaactcccgacctcgggtgatccgccctcctcggcctcccgaagtgctgggattacaggcgtcggcccttttccttttttttcttttgtaagttgtgaggataggaaagggaaatcagatttcaaagttcagaaaacaaaaggcattcttcttctgggtgaagtggtggcctgaacattgtccttttgtccttccacactctcactgtttaataatcttgcc

SEQ ID NO: 86838 - DNA, 1829 bp, Homo sapiens
tgggcgacagagtgagactctgtctcaaaaaaaaaaaaagtgaaagtgtcctttgaatgtgttttctaccttctactgtgaaggttttcctaccctgatcatgatgtgaaaagtatggaatcttatcctgttgcttttgtgattcccatttcaggtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggttagtggacctgtggtgggtgtgtggggcctggggcttgggggtgggctggtcccaaaggattgtggtcagaacactgagccctgtaaagagccagacaggtttcagcagggcctcaggcactgttcttgggtagggatgggctgaactttctgactttaggattgggggctgggagcatttccctgtgttgaaccattgacctacctctaaatgtactgtcagggcagtgggaggttcctacacatgccagggtgtttactgcttggatttcagcgtgactgctggaggcctggggtgggggaggagtcatgttgtgatgggctttgatgcagtgtacatctgttgctaagacacaaatactttttggactcttgttttgtacctccccccacatcagaacacagacataccctgaagttctcctttgtggcgaggcctgttgttgtattgtcctgataattcagacctcctgggcctgagccaaagggtagatttggatagttattcttggccaggagagggccaaggcttccaatctttgcaaaaggcccactgcagggagtagggaagagaagtctgggagctagaaagagaaactgcattctgctgcccaagtcaacttgctttgagctgtcagaagagatccttag

SEQ ID NO: 86839 - DNA, 1011 bp, Homo sapiens
gtgaggggcttctttcctgcttggatgagatatgggccaggaatcaggcagagaatgctcttgaataaagccggggtgaaaggggaggggggacatttgtggccaggagaatgcagagcacctgtctccctaagtatggggcttcagggttgtgtctcccctcctcttgcttggggctaggcttggccagcactgtgacattgctgcacgtgggcaaaatggccttccccttttctctagtctggcctattttggggtgacaaaacttacggcttatggtgggcctgggtgccctgggttcctgcccagcctggctcgtgatccctggccttgagaactggccactgccttcctgaggaatgggataactctttccacttccagcaaataatttagattcccagagaatctgcgggagaagtgtctgcccagtcctgagtgggctggatgagcaagatgcgacaggagggaggagagtggcaccccttcccccagggctctcactgcgccaccccagctgactgactgggctgggtggggctgcccgcccctgggcgcatctcctcaaggagacggaggcggcccagggatgggctggttccttgcggcagcttctccagctgccctgatgcagagattggctcccgtctgcagctaggtaacaggcggtgggaggggattggctccttccgcatctccagcggagacttgggggaggagattggctctcggcgcagcctaggtaacgacagtgggaggggattggctctttgcgcagcccagctgctgacctgggggaggggattggctctctgcagcctcagcagtgacctgcggggtgggagggggtggggattggctccctgctgcagcctaggtaacaagtttggggggcgtgggggggaggagcgggaggataggcccaggagggagcttgctttcctctgcagcttgagcacggagcatggggtgggagtcccatctcactgcagcctctgcggtgagctcagg

SEQ ID NO: 86840 - DNA, 6967 bp, Homo sapiens
tcccggcaccggctgccctggggctcatctcgcagaccatgacccgcctggaccgcagctctcacagtggtgggggccatgccaaaggcagccggccccttaactctttgctggctggtcaccgggtggcccagcccgcctctgctcctgggtccagggcttctgttcaggttggtgtatgtggggagactaaagtagtacgtctgggaggtcttagggtcagggggggttaatgggagaagaataccgacttagaggtagggaggagggtctgatctaaggaaattgctttctggaaagtgtatgtctgcattttaacccctggatggaaggcaacactttagggtttcttcaggcttgtagggagggctcgactacaggggggtgccatgtataggaagcccaaatagctctatttattggggttatatgctgttagtgggggtggcagttggtgcagcaactgttcacgagccaccagggtagagcgggagggaagcatttttggtgcccaaggtggcagttgtagctgagcagtgatggggtttatgtccttgagggggttgactgatggggatttggtgagtcctggggtatggtgagggaatgagagcactggtgtaggggacacagtgaggctggcccgagcagggggtggggtgcacccctggggatcatctgactgcctgagcctccctggaatggaggcagcagctaggatcagctgagagggaattctggcggggatgagtcttgaggtgagcctgggcttgaggagttgtgggtgttcagccttactcttgctgccagctggggaatggggaatggctataggaagggctggagacagcatggcgttgtcattggttgcatcaggtggttggaaatgcagggattttcctctctagcccaccccacccctttatgcaaatgaaatggtaccacaggctgatgcaagcctggccactgctaagtaattctgcatgacaattcgctcttgcttgccatggccagcttcctccaaaccaagttttaaggggtccaatccccaaagctagaggtgtctcctgatgttccccttctttcttatgtaggggggaggcggccctgccttttgtctgggtgtgtcttggtccagatcctaatcctttgcacccttatggtgatagtcacactaatggttttgctagtggctctttttttttgtgggaaggggatagtgtctggaagtagatgaatgaacacttgctggtgcagggaccagggggtaaaggctggcaggtgaagagctgggaggggccccacccaggactaactggggtgacactaggagggaactctgaggggcaggacaaggaagggaccttgggatcttagagctaaagtcatgtgatctgtctttcaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtaccatcgcccctgctcactgggctctcttcttgtccctactaccctgacacaaaccaggctggagttcttccagaaacttcctttagagaagacaggtggtgtgtggggtggacctgaatttctgttttgggttggggtctgtaagtcacagtggctgagccttggaaggggggagtggaaagcagcagatgcagaatggccaggccgtggcaacagacagtgcaagggaggcagagcatgtagcatcttcctgcttgcttcaggactctttcactctcttctgttgtttctgggagtttgggactcggggccagccattagcctgggaatgggagggagactgcagggcttcagccattctgggaaagaagcttcagccccaggcagccaaggcccaggtcaatcagacttacagttcctgttgccacaggtgcctagtggggaggaccagacggccctgtccctggaagagtgccttaggctgctggaagccacctgcccctttggggagaatgctgaggtgagcaggactccagtgagagtccaccaagtgagcagggcagcctgtacctggtgtgtccctccatggctgaggggccagctgttggttctggccttattctggctgctgggggtaaatgcagaggaaggaagaacagaaacaggtccaggtggtaatctctgggaggaaagcacaaggtttttccttcccccttgttaaagcctctgtgttttgccctagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggtaggattgtcggaaccgggcacaaacctattggattttgcacagattgtcttagcactcagttgcttttccatctccaaggagagaaagtgtaatactttccctgaatcatagagaagtggggacaatgagaagaaacctgtccaggtgtgtccttggggcaatgggagctggagacaggtagggtttgggttaaataaaactcaggactcagccttccaaatcagggcctgcctcctgggtgtgccttcttcctttccttcaggcagataggcacttggctgaatgcttccaaggttgtgcgttaataatagctgacattcacatggtgcttcacagccatcgttcgctcacttggccctcacagtcatctagtcagcctttatctcaaaggtgaggaaattgaagctcagaggttaaatgatgtgcccatcgtcacacagcaagtggtgcagctaggttttctgacttaagtctgggtgttcttttcactgtgctgattttgcagtaacaaggtagtgttttcttcctctccctccaagatgggggagtctggccaaacatgaggaaaagctgatcagtcctatattagggtggagcctacatggaagaacccatctctgccaggcctggtggacgaagctgggtcaggagctgacactgtgggctttggtttatagtattttgcctttacacccatgcagctgtgcctctgttgggtgcctgcagtgtgtgagccccaggggagggagtcagttcctagtgaacagtggtgctcttctcccctcccaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaagtgcactttttccccactttgaatttaaattgagaataaaggaaatggactcattgtagggaggactggccattgcgtggctaaggcagagctcacatgggaagatgggtggagaactggggaggttgacagtggggaacttcaaaaggcaagtcttaaatattgtattaaaccttgggggcaggcattagacaccatgtacttcatagggttagccagctcaatcctctcaggaaggattcggagtttttttattctcatacagctaggataggtggaggtgtcatttaacccagctctttacctgtccacctgctacaaactacatttttaaactcaactgtgctgttatttttctattggcctcacctgccaaaggggtgcagagaattggagtgtagttatgatgttgaaaacctgagaaatccatggcagcgactaacatgtgacaagcactact

SEQ ID NO: 86841 - DNA, 1076 bp, Homo sapiens
taactggggtaataacagttgacttgaactttccaattctcaattaggggctgaagcagtaattgaaatgggctagtgtcccaaagccaggcgtcaaagttgcccagcctgaccctaactatgcaaatagcaaaaagggcaggcttggtcaaagtcaactaggatttaaaaatccatttggggtaaacagtggctttggtactatcacaaaccaccatacaaaccaacaaggtcacaaggcagacccaattgtgctgctggtatattgtaaaacaggttatttaatacaaccaaaaactacagaagctgaattgtcagcacctattctaaacttgatatttagccttccctcacttttgccacttcattagcctaagaaaaaaaaaacaaaacaaaaagcctttaaaaggcactgctctgcttgcccccacaaaggagggccaactgtgcttttcatcccagcaggatggttttatttcacatttcatttgttttcaacattcagtagtttattcaacagtcaacaggaaacttacaaggccaaggtcaattaagtcatccataagagaaacaagtaactttaaacttcacacactagataggaaagcagtaacttttggggaaaaaacctcagtgctggacatcgtcaaaacaaggtgatgtgcagatccacagattgacaagttgtcttgggatcttaagctctcctctatcaaactcctgtaatcccacaccaaaacactaggatgcctctccctgatcattgtttcctagtgctgaaagccaagactcctttattaagttgaacgctaatactgagcctggacttagttcagttctatcagctttaaattataaataagaacatatcttcatcagaagacccaacttgcacattaatccaagctatcattttcccttttactatgagaaataattgctttataatgcagattcccaatgccacagtccataaagatgtgccaagcacacagacaaaccccaaatggcgcaagtttaacatcaaattgagccaagtctatggccaccacagaattgagagttctggaatataa

SEQ ID NO: 86842 - DNA, 1059 bp, Homo sapiens
gtgctgaggaataattgttcctgcatttaatatcatttgaaaattttgacgaccaattttaagtgatttttagtaattaaatttttatttatttttttgaggagagaaatggtctctgtcacctagtctagagtgcagtggtgctaccatggctcacggcagcctcatcctcctgggctaaagggatcctcccacctcagcctcctgagctgggactacaggtgtgtgccataatgcccagctaattctttttttcttttttttttttttaacttagtagagatggggtctcactgtgttgcccaggctggtctcgaactcctgggctcaagcagtcctcctgtctctgcctcccaaagtgttagaattacaggtgtaagccactgcaccttgcctaattaaatttttaaatacctgttttcagatatgaccttatattccagaactctcaattctgtggtggccatagacttggctcaatttgatgttaaacttgcgccatttggggtttgtctgtgtgcttggcacatctttatggactgtggcattgggaatctgcattataaagcaattatttctcatagtaaaagggaaaatgatagcttggattaatgtgcaagttgggtcttctgatgaagatatgttcttatttataatttaaagctgatagaactgaactaagtccaggctcagtattagcgttcaacttaataaaggagtcttggctttcagcactaggaaacaatgatcagggagaggcatcctagtgttttggtgtgggattacaggagtttgatagaggagagcttaagatcccaagacaacttgtcaatctgtggatctgcacatcaccttgttttgacgatgtccagcactgaggttttttccccaaaagttactgctttcctatctagtgtgtgaagtttaaagttacttgtttctcttatggatgacttaattgaccttggccttgtaagtttcctgttgactgttgaataaactactgaatgttgaaaacaaatgaaatgtgaaataaaaccatcctgctgggatgaaaag

SEQ ID NO: 86843 - DNA, 2416 bp, Homo sapiens
atgctttttggggccttgcccagatgttcagatgtgattggttaagtccattgacctggcttttgacatacacgaatccccagagggaattttcaacaggagagttaactctgaggatgtcacttgacatacaattgccagtaaatgctgcttgggccacgttttcattgttccctagcctatttttctaaaattaccatttttaaagcactgtcccctgggttatccaacttaggatagaccaccagcacctggtctcaaagtctctctttgctttattctgcaggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataatccctgatttctgtcttaagtcttaccaggaacccttcttgccttataggttcagcctgttggaaatggcttcctcacttgaatggttttatttcttgaacactgtaggcttgaaaatctagtgcctggcctgaatctttaagtggtcacaccatgttaatttagtaaatacttactgggcatttatcagttgctgcagaggttgtaaagatggtcgcatcatgctgtcttcagtactgccaaaagtttattgagcactctgacctgatagcacttccaaactatggtatatttggaaacatgggtttttaagttaggtttagatcctgcctatggtatgtaatagattatatgaccttggctaaaatctacttctccaaaattttccaggaatttggccctgtgtttgcgcactgatttaaaacgtcattttctgcctatgattttttttttttttttttgagatggagtcttgctgtcacccaggctggagtacagtggtgtgatctcggctcactacaacctctgcctcccaggttcaagcgattctcctgcctcagcctccagagtagctgggactacaggcgcgtgccaccacacttggctaat

SEQ ID NO: 86844 - DNA, 1141 bp, Homo sapiens
ggagtgcagtggcacgatctcagctcactgcaacctccgcccctccgggttcaatgattcttctgcctcagcctctcaagtagctgggattacaggcatgtgctaccacgcctggctgatttttgtatttttcatagagatggggtttcaccatgttggccaggctggtctcaaactcctgacctcaggtgatccacccacctcagcctcccaaggtgctaggattacaggcgtgagccactgcacctggccgactcactgctgtctacaggttaaaactggatttgattataagacaaagtacattttaaaaagttattttactggagaatagagatttttgtatatttctaaaagtagtaaatatttctggggagtgaaatgactaaatttaactcagagggtgttgttcagctgtcagcaaatggcagcatgcttcagattcccatttccctcccattctcttgggtccattgttcaaaaacatacattatcagcttactcttctgctctatgggactatgtggctctgatttcctgttattaaggttctagagatttggggtggtgctttgtcagagatgtcatcaggtgtctcctgcttgctttacgctactgcttctgtctaggacattcctaataacctgaagataagagtttgttttttttttaaatgagacagagtctcgctctgtcacccaggctgaagtgcagtgaggcgatctctgttcactacaacctccacctcccaggttcaagcgattcttgtgcctcagcctcccgaatagttgggattacaggcgcacgccaccatgcctggctaatttttgtatttttagtagcaacacggttttgccatgttgaccaggctggtcttgaactcctgggcctgcccaccttggcctcccaaagtgctgggattataggcgtgagctactgctccctgcctaagagtttactcctaattcccttataatgtgtatgattttcaaattttgaaaactttttttttttgagacagagtctcactctgtcgcccaggctggagtgcagtggcatgatctcggctcactgcaagctctgcctcccagtttcacgccattctcctgcctcagcctcccaagtagctgggactacaggt

SEQ ID NO: 86845 - DNA, 1199 bp, Homo sapiens
ccaaaggattctaacagctctcttacttgagccaaggtattggtgaaatattggcaaaagagtttgtgattgggccgggcacggtggctcacacctgtaatcccagccccttgggaggccgaggcgggcggatcacaaggtcaggagatcaagaccatcctgactaacacggagaaactgggtctctactaaaaatacaaaaaattagctgacgtggtggcatgtgcctgtggtcccagctacttgggaggctgaggcaggagaatcacttgaacctgggaggcagaggctgcagtgagccgagatcgcaccactgcactccagcctgggcgacagagtgagattccgtctcaaaaaaaaaaaaaaagagtttgtgattacattaatcagagacacaggaatggttccagtctggataatagtcccatatagataaaattgttctacccatcttgtttttacagtcagaaaagccacgaggctttgctcgaggtttggagccggagcggattattggagctacagactccagtggagagctcatgttcctgatgaaatggtgagtcggccagtggctctgtgtggttgttttttttcttctcccattggtttcatgccagaggaaaagagctggaccttcgaaattccaatcacccaagtgtgaaattgttaagatggcatagtccttcgatagtgaccctcggcctgactgccaccctggactcatgagttacaggtaggagcccttaggaatcttgggtctttgcccatatttttaggaggtgggagacaatctagagtggaaagagtgtgggaaggaattacatttcacttctgtaaataaagggggagaaaatgaaatgtgattggaccaccctctccttctaccacctccttaataaagatgaggctggccccagaatcagaaattctgctaaattctcagggttaggaaagaatctgtagttcttccttttgtccttaattgttggatccctttcaatttgtgcagattctacaattacaggatcagccagcaggggtcagcaaggctccttaactgctatcaagcatagagcaagcctgcttttttccattatgagtataaataccagtgatagtaatactccatgaaacagcctaatgaagatagttatcccaacaatctctgtaattttcctactctgtcaaaagaaggc

SEQ ID NO: 86846 - DNA, 1067 bp, Homo sapiens
aaaaaaaaacaaaaaaaacaaaaaaaaaaacaacaaaaattagctgggcttggtggcacacgcctgtagtcccagctgcttgggaagctgaggcaggagaatcgcttgaacccaggaggcggaggttgcagtaagccgagattgcgccactttgcactccagcctgggcaacagagcaagactccgtctctcaaaaaaaaaaaaaaagtttgctgtaagattaattggggctgttttatgagctttctggctggacatatcagaaaactattttgtatcgagtgtgagaagaagcctaacacttactataagcagcatacaatattatcacctgtcatgtccctggttttcttaccatccagatattatctaaccaataagagtgctccctaatgccctttttatttcatttatcattttagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagagtaagtttcactgacacaggtaaatgtagccaccacgtgtttatcaggagtctagagatgtatgagacctccagtgctatgatggatacagtgtgactcagtccccaccttcatggcttattgtttaattaggaatatggcctactgcttataatacaaagcagaatgacttctttttaaaaattatttcttttgagacgaggtctcgctctgtcacccaggctggagtacagtggtgcagtcatagctcgctgcagcctcaacctcccaggctcaaggtatcctcccacctcagccttctaagtagctggtaccacaggcatgcaccaccatgtctcgcttagttgcccaggtttgtctcttaactcctggcctcaagcagtcctcccacctgggcctcccaaagtgttgggactacaagcatgagccactgtacccagcccatagtgattgctgagaaacagtttt

SEQ ID NO: 86847 - DNA, 1577 bp, Homo sapiens
acatctcagataaaattcaaaatgtattcgcacaccagcattctagcctttgatcctctggaattcaagggctggtgttcctttaaaaatgaaactcctgactgggcgtgatggctcacgcctataataccagcactatgggaggcctagatgggtggatcacctcaggtgggaactgaagaccagcctgaccaacatggagaaactccgtctctactaaaaatacacaattagctgggcgtggtggtgcatgcctgtaatcccagtgactcgggaggctgaggcaggagaactgcttgaacctgggaggcggaggttgcagggagccgagattgcaccactgtactctagcctgggtgaaagagcaagactccatctccaaaaaaaaaagaaactcctgctaactgtgtgtggcataagttcttgttttctgcttagtcaagttttccatctggaaagcatttgcttcgcaaacagccacagcttacagactacaagcagtttagaaacaagactaccacctgaatatactacacatgccttcacctgccttttgatgattggtatgtagttgctgattctttcaacaaaaggtacttctttcttgttttctctttagggcttatggatcagatttatcttgctgcttattcccttaaaagcttatagctttggaattctattccctgatgcttctgagacagtcatcctcttttttttgagatggagttttgttcttgttgcccaggctggagtgcaatggtgcaatctcagctcaccgcaacctcagcctcccaggtagctgggattacaggcgtgtaccaccatgcccagctaattttgcatttttagtagagatggggtttctccatgttggtcaggctggtctcgaactcccaacctcaggagatctgcctgcctcagcctcccaaagtgctgggattacaggcgtgagccaccgcgccccacctgagacatccatctttattgtccatatagggttcaacaacttgttcaggttccagacctacctttaattgtatgtgcaagtaaaaatagaaacagaatgctttgggaaccccaaagaaaagagaaatattatttagctaggttgggtaggcttcatggagaaagtagcatttttaagctgggtcttgaagaatggataggattttgactgttggccctgtacaggagcacactactttcttttttctttctttttttttttgaggcagagtcttgctctgtcactgaggctggagtgcagtgtcaagatcttggctcactgcaacctctgcctgcctggttcaagtaattcttgtgccccaccctcccaagtggctgggattacaggcatgcaccaccacacctggctaatttttgtattcttagtagatatggggtgtcaccatgttggccaggctggtcttgaactccaggcgtcaagtgatccacccgcctcgacttcccaaagtactgatttataggtgtgagccaccaagcccagtcaggagcacactttttttttttttttttcctttgagacagagtcttggtccgtcacccaggctgga

SEQ ID NO: 86848 - DNA, 1010 bp, Homo sapiens
tcacatcctcaaaatttttgaatcttagattcttcaccagaactttatcatatcgccgctgcctcaaatttccaatgatttcttagtcctcaatctctgcctcctcaaatctctgtaaaattcctactcacgccggcacggtggctcaagcctataatcccaacacttggggaggcggaggtgggtggatcacttgaggtcagggtttcaagaccagcctggccaacatggtgaaaccccatctctactaaaatacaaaaattagctgggcgtcgtggcgggcgcctgtagtgccagctactcgggaggctgagggaggagaatcgcttgaacccaggaggtggaggttacagtgagccgagatcgcgccattgcactccagcctgggcaacaagagcgaaacttcgtctaaaaaaaaaaatactgttcagtgttaagattacttcccctttgaggtcttccctgattccctagagtaggttaggtccccccataggcctctcatagcttcctgaatttcccccttttcactggctgcgccacaaaaatgtcctctttttcattgtaagttgtgctcacctttttcagtgtcattaatctccgtcagcacctttcacccaatcatcccaaggaaacacacaattaggaaaaaaacatgtttttaagccacaatataactaaagttttatttttttattttaaagtatccttctaatcaggaggaagagggaaactctattgcactctaccccaaaaggcaagagtttgcatttataagacagttttgctgatgcaggcactgttcagggcaggagtttgcatttataagacagttttgctgatgcaggcactgttcacggctctggagaactgtcatgtaagaaaaacccagcccagcaatatcataatagagtttagttaaaagggcttcaagaaagcacagagaagatgagaggtgaagccagctggacttcctgggtcgagtggggacttggagaacttttctgtct

SEQ ID NO: 86849 - DNA, 1335 bp, Homo sapiens
caagtaggtgggattacaggcgcctgccaccacgcccgctaattttttttatttttagtagagacggagtttcattacgttggccaggctggtgtctggaggtttttaaaaagccagttcatagctatttgtttctgagtggtattggccccaaaggaaagaagaatttcttcatgaaggtagtgcagggccctatacaaacttcctgagaccaagggtatgatgatcatttcgttcctaaattatggtcctgaatttgacaaacctttttcaaggcacaaaagatgtatgagctccactgagtggatgactgtgatttccttgtcatcgtctttcccgttgttagttttgtttaaagacacttcagaatatttaactctctgctcctgtgctggcagtttatccaatgcctgcaaagagaagagaaaaaaaaaacttaaggaggttcattgttcacagcaaataggtctgctctttttggtctcagacatttgactgatatctggaatgttatatatgggttgttatggaattggaatttcccacctttcagttcaggaccccttggaggtggtggctgcatcagataaaaatcagattgtcagcaagaataccatttaagatggtactgaaatcacaaaaccttaggtttgctcaatattgtgtagcccaattttgtcatggaccatgcagcttcgtttctgcatgcagtgtttgtctgtggagatacttctggtatattggagagaattgaaaaagtggtttgctttgctaatttcatggtgtaaatgagttccccttcttttgaaatgttagccttgtgttagcaaaacataaaatagaaggaaactcattacacagtgttctaatggtaaggcagaactaataagagaatgtgtttaaaattaattgtgggactgtaaaaatgagtgggtatgtgaatgagtacgggatgggggaggagagggagggcttagagatattagagatagtcttgttttcccaggagccagcctggatcatttgttggcagtacatattggctgaagtcagttttcatttcaaggtaaattggaaagggaaattaaaccttattgtttctctcttaagagagaagggggtgcaggcggcagccagggtggatgctgttggaatagttgtagaagtaacaagattagtgctgtattttaacagaaggtgacatcatgggccccattggacttgagtaaccccgtgctgcagccttcatggtccccttgtcggagtgggtgatgtcgctatacacgtgaactgccacattggggaaaatcaggggctgaggctttaatgaatctt

SEQ ID NO: 86850 - DNA, 1064 bp, Homo sapiens
gagaattgcttgaacccaggaggcagaggttgtggtgagccgagattgtgccattgcactccagcctgggcaacaagagtgaaactctgcctcaaaaaaaaaaaaaaaatgctgtgatgtgagtgctcaccagaccctgttgtgcctgcattcttcaaggcaaaagttttacatctggacccgcctgttctggctgcgtgtgacaaactttctgtagactccaacacgctttggggagaggtggcctagttgagggcctggtctgagaagggaggcaaatcccccagggccttttagcttggcattgagctaatggggattttttttttgcttcctcttaagttttacaagaacaaaaagtgttgcctgggtttccccacgggggtctattaaaaactttcggggttttccctggtaaagaatgataagaacagaggcatactaaccttgatcctgtatcctctgtccctcatcagatgtttccttccaatgggcttttggtgtaggatgtcggagaaccaagaacaggaggtaagagtatggtctgcagagaacaggtgggtaaaagttggagaggggatttaggaggaaagaggacatagagatgcaaatcattaattattacctgcagtattactttggtggttctgatgagctcagaataaagtcaggagaaagaaatcaacagcagaggcattcctaggaaattggggttccattctgactaaattttcctttgattggaatatactggaatgtaagcttcatgggggcaggcacttacgtctcttgttcatgctttatccccagtgcctataacagtgtctgacacgtagtggggctcagtaaaaatttgttgaattgagtgactgaattgagtgaatgaaagttgaattgaataaatgaaagttggtgttgagtgaatgaaagttggtgttgggtggaaaaatctagcgacctgtgttgtcagagctgccttgctgtgtagctgaagctgagggagcttttcttacctacaggaggtgattacagtgcgtgttcaggacccccgagtgcagaatgag

SEQ ID NO: 86851 - DNA, 2582 bp, Homo sapiens
tcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtcccgggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaagattgttgttgcaatttgtgtctaacaagctgtagcagagaaggagggagtgagcgctggcagtatttcctttcataaatcatgaatttatcagtgtggaaataatgcttcagaactgtgctctgtagccctcctgcattgtgtgtgcagctcaagttcaccactggaggaaggattgtcttccaaagagctgggatccaactcttctcacagttctgggcgtgaaccttgttaggtataatttacctgatgctgcttccatcctcgcagtctgtctgaggtgccaggtgctgaaagagaaataaagtttgtcaacaggcagatgcaaagccctggctggtattcatccctctttcctgcccgcctcccctgggtctctcctttatatgatgcagcagagcaaggcgaggatagaaaacctacagaggcaaatccaaaatgtcagaagaagttcatttaaaaggggaaaaaaactccatgtgcaaccctcacaaaaacccgacagatgctaagctaatggcatccgctctgccgattggtggggatggctcatgaatattaatgagcccaatgctccaaatggtgcagctgtgaacccagctgtgcctgaagctctctgatctcgaaacttccagacaggagctggaggtggtctgtgtcaattccctactcagccaaaaaaacagcaagctgggttggccttcttctgtttgctccttttcttcctggagttggtgctcagcagctagttctgccagccggctaggctgctgggacagcaggagccattcaaagacatggatgtgatttttctgactcccagcttttttaatgatccattagcagcatgcatacaacagcacctcagttaatctaaggccaggcaccatctcttttcagtctctctcttaactgagtataggccttggaaggagaagtcctaggaaggaaagcacttttctaataatacaagcctagggtcatccgaaaaatagcgcacatgagttttcctctccatccagatagtgccataggcccctcttctgttttgctctgtccctgcgtgtgcccaggtctagccactgtggccagatgacctctatgaaagatggaggatta

SEQ ID NO: 86852 - DNA, 1030 bp, Homo sapiens
atctaaataaatggtaataatcaatactttctggtaggtgtcaggagttcatcttaaagaatgactaactgtaataatccattgcttctcaatcgtgaaacattggtatactttgatcagttaaaggacagagattttgaataatttacttttagaataagaatgggttttggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctactcgggaggctgaggcaggagaatggcatgaacccgggaggcggagcttgcagtgagccgagatggcgccactgcactccaacctgggagacacagcgagactccgtctcaaaaaaaaaaaaaaaaaaaaaaaagaatgggttttaagtttttctataacaataccactcactgcattctgatacgctttcttacagggagaagtcaatcaaaaataacttatagcttatcctatgtatgctacagcctatagtgatgaaatgaatctgatgtactatcataattgtggcatcatgaattcccacagtgctttatttacttgaaaaaaaaaattgtgttccttcaaaaccatgagtgttctgtggtggtgggttaagcatatgtgtcttttgattttatcaataacacatatctgtaacccaacatcctcagcttcatttttatcctaagaatccatccttaatatagaaccgcaaaagacctgaagtatctttagcagctaagtcacagtaagtggcaacagagcaaagtgggaatcctgatacaaattaaggcagaaatccttcaatggtctcatgattctaaaaaggagaagaggattttaaaatgccacattgtctttttacaaaccttgcaagatcgacgtattccccctgagtcagatcacgattatacatgcatcacttga

SEQ ID NO: 86853 - DNA, 1182 bp, Homo sapiens
ctatttgcacagctcattaactaagggctcacactcagcaaacggggaaaaaaagaaaaagaaaaaaactttagtaccaaatacatttggaaagttactatagagacctatatttcccttgaatctaaactaggccctgccacattctgctacactgtggttggatgcatctgtttgtctgtctgtctttattgcttatttagcaagtagcaaatcgggatgaggcaaagcatcttttgtcagaccatgcaggagagagaaagagaacatttctttccccactgaacattatgaacattatggcaggcactggacctgctctgctactgggacaacatgatttacaatgtgaaaagggaaaacctaaatcaccaagtaatgaaaacattaaagttaatgcatcacaagtgaggaatttattaccattaactccaataaacagttataaaacactcgtcctttcctgtccgtgcacagggacacagacactggacttcattaagctcaactttcttttcttcttcactagaccagtcatgtgtgtttgaaccaaccaccatttattgttaggtggactagctcattttccaggactgtagaaagctgaaggcacatccattctgcttcacggcacttggtatagacggatgaaatagcaaagtttagaagacatgcagctcggtattgctgtataagtttatttaaaagtctctaaaatgtatttctgacaaaagcagaatagctcttccgagcagcctttctcacaggcaggtatataagtaataatgcctggtggggaggatggcatattggatgccaatgcacgtcaggtgtgtttaactgaataatttttcccttgttattgtttggtatagcaccttggaagcctgagatggaaacccatttccttctaacatttttctctgtcacaggggcagagaagtttattaccttaaggttgttcctgaacaaaagaggctgcacatattggatggctaaggtagattggttccagattcatttgttttcaaggaaaaaaagaactaaagtgtctttttgaaaagccacttctaattgtggaattgcctgggtgttacaaagcacataggagaggcagcatgaaattcaggctttcctgaccaaataattacaacagtaacatgataatagtaatactttaca

SEQ ID NO: 86854 - DNA, 1064 bp, Homo sapiens
ctgattcaggattatctggagtggggctgaggcatgtttatttttacaaagttctatgagtagttctgatgctcacctagggctaagaaccacagcctcagagtagatttgtatgttaggtccttatcatcctgatggcttgctggagggccttggtgaggtgggcccagggaggcccccaggtggagggcctggacagtgagtatcagaacaagcacgaggggcaagagaagtgctataggcaccaaagtaaccaaaggtgacctggaaaagagccaagacaacttgtactcacagcaattttaacaaactacccaggatcattattaccaagactagaataaactacattaatcaaccaataaaagttaggacttctgcataacaccatttaagaaatactaaagaaattattatctgtgctaatataactctggctttaatcgtttccatggctgaggaggccacttgtagtcatttcatcactgtggtatctttcccattctattcctcatagtctcctcccgagtgttaccctgctcggtttgtcctcggctaccctccaaaggaagtccttaccagatgtatcattaggattagtttagccagtgtgacggaaagccccaaataatagaggccttaacaaaatagaaggtaatttgtccctcatgtataaaaagactggggggaggcaccccaggaatgggagggcacttcatgctcctcttttttttcctgaaaaagagttttgcatcttggtgatcacatttattagaagggttggagaaaaataaaaatgccatttagcttaagaagttatgaattatctgggctgggtgcagtggctcatgcttgtaatcccagcactttggagggccaaggtgggaggatggcttaagcccaggagtttgagaccaggctgggcagcacagtgagaccccacctctattaaaaaaaatttttttttaatagaagttatgagttgtctgcaaatcaattcatttcaggagtgggagaatttcttaatatcaaaatgtttgctggtttctcttttgaatgtcctg

SEQ ID NO: 86855 - DNA, 1065 bp, Homo sapiens
tatttaaatgtagatcataagcatgtaatctgcctagaagctcctggtaatctctcatttatccataaattcatttatccaggctgagcctgatgaaatcaaggggctcctctatggtgttggtagtttgttgctggtttatgtcgtccaccatgtttcaaacccttcgccctttcctcttcaggctctttctatctttataaagtatgtcatttgttcgtcatggtccaaactggctccagttccagccagcaggaaggaggaaaggggcaacacagacagcaccaccatccctctacctgcttaaggacacttgtgtgtggccctaaaaagttgacacattacttacacattccactaaccagaagttaaatcacgtggtcaaatctagttgccgtggaggcagggagttgttctgggcagccacgaacccagaactgggggctagctagcagtctcagctacaccagtaatactgcacacagctaaataagtattggcagtcaccttatgaacctagaatatcccactggaaagaaagaaaatgagtatggtaagagaagactgcttaattccaggtgttgggtaattcgtggcgattagaggaaagtgttttccactaatgaagagtgagaatttgttcaaagtagttatctgtggtccaagaatcataacagaggcctcaaataaatgaagtgttggtttatcttttgaaaggttatgtttcctcttggaattatgtgattcaaaagtccacctcttgcctaaggaaggactggaatacaggccttcttgtccaagttcctgaagttaacttctataacactgtcaggagcagaacaacatataagaccactggagtgtgcgctagctgttagtgctcacaaaaagtaggagaaatgttagtactaatttcacacccaaatttgcttagatgtgcttaaaaagattctgatcaatgaaaaggtatacttttccctaactctagggctccaagtgcttgagggttacagataatgctgttctagatgcatgtggtataaaatacaaataatctgtttaagt

SEQ ID NO: 86856 - DNA, 1066 bp, Homo sapiens
gaatattcataagagataaaattttgccctctcttttgtcagacattctctagaatgcatgttctttcatggacagattggcaaatattataagtatcagattcaaaactttctaagaaatttaaatgttgaattcttctaatacaagaagcaaaaattccattttcagcgtttcatgtgttgagagtgaaaagggggaatataagaaagaagtgaagtccagatttcctaaagtacatctcaggtaagcctctctcttatcacatattttatttttttacctgaaatatttcagaacttaaatgtttttgtcaaatttgaaaaaggtgtgtggtattgacttcttcatactgatctcatttttattttctttatagtctgtccaaatcattttcaggccccttaaatcagttacctttcttctagggacaatcaatagaaagcaagcaaaaagaaaaaagagtgagacctgccctctcagtggtctcctgggtaactttatctcccagacaggatgatgcaaagatgaacagaagaggggtttctgaatagatttccagtaggattgctgtcaagatgggatcagctgcaatggtgccagataaaaactgcaggagaccgagatgggtggattgcttgagctcaggtgtttgagaccagcctgggcaacagggcaaaaccccatttctacaaaatacacaaaaattagcctggcctggtggtgtgcacctgtagtcccagctgctcgggaggctgaggtgagaggatagcttgagccaagaggtcgagactgcagtgggctgagattgtgccactgcactccagcttgggtgacagaggaagatattgtctctaaataaataaataagaaaaggttaggtaaaggtaaaaattatatggagtccactgcaatatctcttatccaaaagaaatttgttaaaaaaaaattttaacagctcaaactacctttgaggctaataaaggcaccaaaatggattatcagaccatgatttgaggtttgaaaaaggatgccagtgctgactgactgggaagctattggaaataa

SEQ ID NO: 86857 - DNA, 1028 bp, Homo sapiens
tgttgaaaataagccaagttaaccagtttttatgagctcatagtgaccgatggttaacagtttgcttggggttattcactcagaactttactggcatgttctatgactacaagtacaaggtaccaaggaacagcagatgtgcacggcactgtatgtgagaagtatgagaggaaaagcagatggcctctagctgaatatctgaaattgttaattaacaataaaaaagtatataggtaccaaaataaaaacctacagctcagagaaggcagtgtgtatagactgtggagaagagtaccttgagctgaactctgagagatgggagacagagagagagagagagagagagagaagaaggaggaggaggaggaggaggaggaggagaaggaggaggaggaggaggaagaggaggaggaggaggaggaggaggaactttccagaaaggaaacagcacaagcaagagcttgaaagtctacactgagtataatgtgttcttagccaacagtaacttgactgatgcctggagcttttggtggatatgtaggtgtgggtgtattctaagaaataagctaaacatttatcctatgggtgtaggacaaactctgaaagatttcaaaggtcaggctgacaagttctaataatctagttttccctagtttccctcactccaatttctcattatgaatgctgaaatgagcaggtcctttaaactggagaggctaggaggtctcctcagctatgcagagttattgaaagttttcagtcaggaaatgacataataaagccagtgtttttctagtgatgaagatgatttaaatatagttgctctacaactattcttctattgactgaactattccatttttcaaatagaataataattcttaacaaagtaaactggttcttgtcttagattctttctggaacaatgtggtatcatacctatgcctagttaatggataggaactgtcatcaaatttaaattttctcttaaaccttgtgttattttaccactttaggtggccaaaaaa

SEQ ID NO: 86858 - DNA, 1085 bp, Homo sapiens
gagcagtcactaacatttgtaactattgagcacttgaaatgtggctggaagactaagaaactatttaaaatgtaattttttagttaatttaaatatacccttaaatagccatatgtagcaagtggctaccaaattgaagaccacagctctagaaaaatgacttccaaactaaatagtcaagagtacctgaaaatagtatttcagaaatttctttaaaaacagatggaatggaagtttggtgggcgagggaaagtagaaaggaaggctcagatataggctggttgaggagaaggtcagaggggcaaggtaggtgagtaggcaggagagccctcaaataaatttatgtgagaagcccagagaaaacaggatgtggagtggaagaaaggaagtgacctggcaaagtgctttgaagaagagcattagcatccatagttaatggatttgcacagattgaaaggtaaataaaaatcagcacttttttttttcagtattcacccactgtaaatcattacttgacattttgattggtggctttggagtaagttgtttaaatggtactgagatgtttgtgtaggacagaaacttacactgctatcatcctatagaaatcacagagctcctgggtcataaggctgtaagtttcctcagtacgggggtatcatttattccttcacaagtattcattaagtcatataggccctcttgtttcaagtcagtgtcatatctaatctttctcaagagatagatttttccaacacattaaaatattttttcattataaaagtatttaagcccctgataataagtaatgctgtcacgaatttgtacactttatagcactttacactttaaaaaccttgttcaaatgcatcaccacatttaaccctcacagcagtctcatgaggcgagtagtatccttgtttgataggtgaggaaaccgagcatgagattcatctgggatcacacatctcacatgtagcagagatggaacccagatgaaagccagacagttgcagagtatgggttctctgatctcactcttgccattgttgtttctcagtattcaactctttgtggtgataatt

SEQ ID NO: 86859 - DNA, 1046 bp, Homo sapiens
aagacaaaacaagaaaagccacatatgttataaatatttgtgtaagcctaggaataagtaaaaaagaatatataccagactgttaacattggcttccttgagagaagactgagagtttggaggaggggaggttattaatttttatttcatacatctttgtgttgtttgaattgtgacaatgaccatgcattacttctgtaaacaggaaaaaataaacagtaagggtatttaaaagaaaaaggaacaaaagacaaatagaaactcagagaggtcagagtgctaacggaccatttactatgcttgtgatcatgtttttctctttttagccctgaggggtatggaaggtggagaaattaaaaaaaaaaaacacgctatcttggatttttggcaaatatcaaaacagtgtgaggtttctagagtaactcaggaaatagcttctttagatagactctgtcaagctctcatatagaaatagtaactagtcccctatcaacaaataaatacctcatagataagtaaaatggagggtgctttctgctttattgaaagaggaggaaatattcaggtctgttttcaaataatggggcttcagatgtagaagttatctttttgtttttgttctgtgataaccacaccgaaaacaaaaacaatgaagtgctggcagtttgcataatctttgctccacagatataaacataatcagtctcttcttcctggtctttctagccctgcttttgaagtcagaagcaaaagagacaagtatgaaggaggtggaatagatatttctttggttcgtagtttgtcctgtgtgatggaatggggcctactgacattaccctggtagctgataggtcccaactgcctacatggtactaaatcctgcccagaatatggatttaagccaaaataacattaacaacctggctgcatgtagtagcaattgctgtgttaatgctgattctgatatgcctatagttatttatttttaaacttccttgtaaagaagcagtcattaatcatttccttccagattgttctccagatct

SEQ ID NO: 86860 - DNA, 1022 bp, Homo sapiens
gcgctttggaaaatatctagatattcgtttgatcacaaactaaaggcttggaggggcacggaggagccgattggggttttgttttttctaaaaaaaaaaaaaaaaaaaaagtcctggggggaggggaggggcgcgaaggcacccagaaaggcctgaatctgacttcgtggcagcctcagaatgacccttcctccttttgtgcttagctaatgtttacatctcataattcatgcgccaccgagagttgcgcggcggcggcggaggcaaggttctcgtccctttgcgaactggctacttgaaattctaatagaagaggagaattgaaaaccttgtaatcccaagaacagactcgcactgcctttttctgttcccagagctcaaaactagaacaaaacgaaataaaaccaaagcactcaaaccacaccccaaacgaagaaggcgcggaaagtaggagaactggaaaatttctgggccaagaagatctgtctgtcttctgtatataccctgtagatccgaatttgtgtaaggaattttgtggtcacaaattcgtatctaggggaatatgtagttgacataaacactccgctcttatttttccagaagaaaaaaatatatatatatgtatatgtagtatttttctgaatgaggacagtctggtgactggccacacgaagactccttcctctttattcctctatcttttcctccttcaactggttagagatggagaaatcatctacctgaactctccccacgcctgcccctgggagccttggtcccttttcacatctctttaagaggttaatgttattgttgttgaagttttaaatttatcttctcgtcccaaacgcacccattttctattctgggctcagggaggctttattggaaattgcgaaaaaaaatgacttgtcttcagtgtgcgaagaaggcaaaggaaatttgtttaacaaacggatgctgaggccgcctttccgtttcagttcagaacaagatgacctggaaatactcgattaccaagg

SEQ ID NO: 86861 - DNA, 1039 bp, Homo sapiens
tagtatctcgtaatagcttctgtgtgtgagctaccgtggatctccttcccttctcttgggggccggggggaaagaaaaggatttaagcaaaggctccctcgccctgtgagggcgagcggcaaaggcccggctgagccccccatgcccctcccctccccgtgtaaaaagcctccttgtgcaattgtcttttttttcctttgaacgtgcttctttgtaatgaccaaggtaccgatttctgctaagttctcccaacaacatgaaactgcctattcacgccgtaattctttctgtctcccttctctctctctctctcgctcgctcgctctcgctctcgctctctctcgctgcgtcctcatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccgagactggcccggccagcgctcctcatttgctcccgggtgccttgcagagccggtggggagcctgtcaccgggctcctgcgcctgctgaggctaggctgcagagaggagggggcgggggctggaggcaggtggtgcgagtccctcggcccaggggcgctgggggtgagggaggcggctgagcctgattggaggagagaaaaacgagggaggggagccaagagaaaccccctcctctcgcgttccgaggctgcccggccagggaggccagggcgcccaggccacgctggagacctgcggctgggctggtggctgtgtcccccgccacctccctctttgttttgctgtgt

SEQ ID NO: 86862 - DNA, 1044 bp, Homo sapiens
ccaggcaatcacattaaggaaatagcgctgcaaattggtaagacacggtacttagtgtaggatgaaccaaattttttatataaaaaaatccagtgtttttcacttggggagaaggaagctagtagctggtggctgttatttttaattggcttagctttatttggcaacttttttgagttccagagtagggggagagaaggtaagaagagaagcctgtatatatttttgtttcctctcttccactcggttaccctcttctcccctccagcccccacataggatcaattaaggctaggtgtgctgtgaagggcttccttttacctccacatcacccctggctccccaccttgggactggagcaattttattccctaatttccctgcacttgcgttaaccaaactgtgagctgagcaggagctgaaaaggagagagactattgcaaccataagttatctgtgagcccccagtgctcccctgtccataagctggagttgataaatggttgcaattgcattgcgtgtgaattggagtgtgctggctgtttgtggctctaagtgcagacccatattcgtggtgtgtggtggtggcagggggggagatttctacgcagacacacatgcctgctgccatgtggtctagagacacaagcttgtttgtgatcaaggcaggggatattgggactggactgaagggctgagaggtctcttggggtgaagtgacaccccaaatgcagtgactgaacagacatctcacttccccacccaactcctcctctcacctcctagagccaggacccttcaggtcagccacccacccctagtcagcctgggagtgctgctggtgggacttcaaccatgctgaactctgacctgagtcctaagcagtttggacccaagtagagaaaaattgagagggaacttgatgtaggcagagctttggaagtgctgaggaagcctgggcccacgtttggctccatcctttccacacagcctctcacctggaggtgtctatagcaatggctggcccatctgtgacacccttcc

SEQ ID NO: 86863 - DNA, 1048 bp, Homo sapiens
gatctcagaaaagaggcctaagtccccttctcacccagcactcaggagccaccagggaataaagggcaactcctcagacagacagcaacccacaaacccaaatcttgtctgctgggagaactcacccttgtagagcacaagccatcagcccaagtgttcttcttcctctaacttcttccctaaactgagtggtcctcttgactcctctcttgttgcagagaggcagctgcaaagtcagggcaggagagggaaggggaaccaggaagacggcagtcagagcgcagtgcctgctttgcttgggtcttaaggacagcccagcgctgtgacttttcaataaataaaaaaaccccagtccgtagtaaacatgtccttttaggccctaatttatatactacagaaatcatatactcagcccaccatgcttcataacaccattatttatggcgggggagggaatcttttttcctgaagagtgtatttatgacaggtaaagccaacagcagacttcatagggctggcaaattgagaacaggtgctttgccttaactgtgattcattcgctcagtgcccagctttttcgctggtgagtccggggagctccctcgactttcccaagcgtccaacctctgcttggaagaatttgcatcggatttttgtttccccacttgggtcctatggaaaaggcagaccttcatgctgtttggttacggatctgccgggctgtcaccctcggagagcaggggtgggaaaggagggggccagatgggcgccggcattgatctttaaaaaatcattttgaaatcgccataatgtgaagaaatatggcgcttcaccctcgtatttcacgtgtaatgacacgagatggcttcatttggaaagacaagcgggtgggagtgtgtgcctgtgtgggaggtgatccgcagccttctacaaggcagaggggtaggtggccaaaaagatacggactcaagttagagtggcccctcttttgctaaaaggaccggactgagggcagcctgccttattaggactcagagtcagagagttg

SEQ ID NO: 86864 - DNA, 1043 bp, Homo sapiens
atctctgtccacctctgcttcataattctgtgagacacatgtgcttataagtaactgtgcctccacccccgcgctcatcgctgtcatgaaataggcatcacacaatgcacaccgtccctgcggtcttgggtaagaaacacagtaaaggattttatggtcaaacaaagaagtcacaaaatttcataacctcttctgggccactttgaagcatttattttaccttccagagaaacattttggaaagaagttgtcgtagaatcaacgtagtgttaagtcatatgcacttgtttgaggatacgctgtatattttgcttgaatatcaagtcaagggacagattttcaagtgcgacatctgaattagctaatattttatagccataattcaagtacacaaatacccaagcttttgccttttccataggtgtgtgatggttataaaaatgtacacacaaccttttgggtaactgatcttcttacacgagcagaatcagaaacctccatcactcacagaggttatgcatgcatccacatatgcacgattagatcctgcatacacgaacgcccaagcacagcaagtttcatagttgggcagatttatttattacatattctatatacagtatagagcagagtgcatttgcacactgggttccccatacagaaatattgatttgaaatatacatataggacacacacatctatttacattaaacacgcgtaaatttcagctaagcttattaattaaaaacaaactatttttccccattctcacttattgtttttctttcttctcccatttccttcccttcctctagattttctctctcttcttactgacaaggacccttccaaaagtcacccccacagcataggcactcaccggctggtcggcctctgctcttcaaacctcggcctcactgttggctgctctgggccccagtgtggccaggagctgcgcttttttccctgcttgcccttctccaagctaccagctactggccccagctgtgttcaggcgaggctccagtgcagggaatggcaa

SEQ ID NO: 86865 - DNA, 1050 bp, Homo sapiens
aaggccccctatgggaccagacctacagaagtaggtccgaaaagtccttcctttcctaatccctcagttgactttttcctccccacccaccccagtggccaaaggcttcccactggccttgggctgggctgggggtacacataggtcctgagtgccacctccttggagaggggcctgacttgcaagctaatggggagcccaggttgttggacaattcaaccccgactgatgcagtgacaagggatgaaaccaggggttgggcagggcaagactctgataccctctctgacctcggtcctcttaaggctgttggccctgtgcccaggaaaggaataactagaagtgctggtggaagaagggggactttccaaagcataagctaacttttgttcccaaaccttccccctgctgcttgaggcagaggaaatgtgcaaaggggcccgggaaagaggcccgaccggatggggcttcggcgccaggctgacttggagggccagggggtctctgaacaaggggcttctgctagagcagaggggcattagggagacccacccctagcctaggggaaatggagccttcaacccactgtcctgataagcaaaggctaacaactctgtcccttgacagtttctcatcctctggtctgggtggagatggcctggcgcgtccctgcggccttatctcacttctccctgggcctctcacaaacctgcccagtcactcagagcctgactgtcttccatccctggtgtcccttggccaccccctcccaggaaaagtgctgtaaaaagaaaaaaggagaatgttagagagaaaggaggaaataaagtctttggaaagcagagttttacaacagccacaggttttatggaagcaatttcgtaataaccttctacctgctcgcctcctttccgcctgcctgccgcccaccccgtttggcctcctggatgccccctcccaaggagtcagccacccccatcgccttggatatccttgatggctgagagttggtaagaagattcctgaggtgggcttgggccactgacctct

SEQ ID NO: 86866 - DNA, 1015 bp, Homo sapiens
tcacccgccgggagaccacagagctgcttccccagccgcccgccgccagaaattggaaaaaaaaaaaaaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaa

SEQ ID NO: 86867 - DNA, 1034 bp, Homo sapiens
cccgtccctcctcttgttgccttcctcctccgcaggtgattctctggctcctctgttttaggaataactttgcagaaatgtctctcagagggctctgcagtataaaatggcatctctgccacaggggaaggggaagagggaccctggtttctcctatcctgctcttcctaggccctggacgtttctgaggggctcattccagaacaagacctctctttccttgctccacaagaatttaacaaagaggccctatttgggccaagaaggagagtggcctgactggccctaacccccctcgtttgggggctgtggagcagtcctgctgctggcagcttctcttagttgttgagtctctttcacaaagcattcacacttcacaacttccctttccagtaggtcttcatctgggcacctcggggcctaaggcacttggccagggtcatgcagctagggacgtcataagtgaggagttggcatttcttggaagagggggctggatttgccctggctttgaatcctgtactggctgtccctatatccgcctctagttttcttatgggcctccccaaatttgaaacccaagaaacgccaaacttccaacatagaaaacaccaaaaagctgcctttctggagatgaattttgcttacaagaaagacacgtttggagggggtgaatggtcgtggtaatttggggtaaagaacattccacttggaatagagggctcctcctccagccctgcttcaccacttttaatagctgctccgatcttgggctaatcacttaattccttcggacctcagtgtcttcttttgcaagctgggggaggggtttaaagatgctggcgctgccctctagccggctgctggggacatcaaaggagattcgggctgtggaaggctccctagcgtcggagatggagttaggaggtaagggccagggggtgggagcggatggggccttgattagctgtggatttctgtcccagcgcactcatttaaccgtgtttctcttggttggcagagggcgccaaagg

SEQ ID NO: 86868 - DNA, 1051 bp, Homo sapiens
aacgtcaagggcctgtagattcacaacctcctctgtcggggatgggggaagatgaggtgggatagggaggctatgtccagccaccagcgcagggagtggctctaaacgctgacccaacgcctcgccccaagcgggatcttggcgcgcagatagaccgagcccgtggtggggcgccatgccgggctccctcgcccttaccgagtgagcatcttcttcccaatttgctgctcagagagggagtgggtcctagtctctggatctcagcgctcacgactacctcgctgctcctaacgaacggttcatctgctctctcctggccgcctgcgccagcgccgctcacccacttttccagccctggatctcctctccccggatgcgtccttccttcccacaattaacaaatgatctagcgaaaccccgccaggtccccggcagagaagcacctccatccgccctaaccaaccaattaatcagatcattaaggagcctgaggagttgtaattgggtggtttgggacgagggggcgctgaggaggtcattaacctccccgtaaagatggggaacggagacgcgcctggccgcctctgccgcccctgccgcccctgccgcccctgtgggctcttcttagcacgcgggttttggccactccacctgcctgctgcgctccagttcccgcctccagtccagctatttcacttctctctttgtcattctccgtcttttctctggcaaccgtccagggcccctttctttgtgcctacttctgtctacctgtccagctgcctcttgcaccctttctgtggcccagcggccaagaaaactcaaaggtcatggctgttggcccccgctgatgatctctgggctcccgggtctcagacaattcctcagggctggctagaaatggtgggagctggagatttggacactatacccattccccaagagaagggcatttgcaaaggggaagtgtttcctgaaacgttcaattctctttcggtatgagatagctttggacaaggtgacaaatggcggaaggtccaggccccagtgg

SEQ ID NO: 86869 - DNA, 1098 bp, Homo sapiens
gccagaaaactgaaagaccaaatgctttactttttttttcctttgtctgatctcagtgcttatcaggtcaaccttcacctttaaaaacaccctggtggcagtatttctttgccatcactgtctgtaaagcaaagggcaagcatctcagggcttttagttgggccgggaattcaaatgtctcctttctcaagaagatgccaaagtggccaccctcagcccactttccgtccttacctcctctgccctttccccagctgtagttataggaataatggcctttaacttgcagagatcattaaggccaaagccctcactccttcccatctctcctcttggggccgtctgagtcgcttcctccacgaccctcctcttttgaagcactccctagtactgttaaaggccgaatttgggctggagcgaagatgggggctcagtccaaaataacctagatattaagtaatagtaatgatttttttaaaaggtaactatgaactctcaagcctcgaccacccagtaaagttcctccttaaattgttgccggccctgggtgcagacacgcaaggactggccagaacgcgagaaacttcttcaaggagagagaagtcagggcccaaattcctcatgctttaaagcagtataagaggagagagtccaaatttttactcgttaaacctcctcttacctcttcctcaggtctgttcactccttggtccagggaccggagctcctgggcttcgaggtgaaccagagggaacgtggctccccgcagcaacctttttgcttcagggctcctcctgggggctgagtggtcccctttgctttgctattcccgctgcggctcctggggggacagctccgtgggaccaggtctctcagggggtggagggtcgccgaagtcgtgaccaggagttggagaccgctgcgtccctccgctgcggacctgcctgggactgcgtggaatggaccaagtcctccgtctaggattccctagtgctcgacggcgcgcactccgcagtgctccgctggagatctgcacctgtgtcccggggctgggcgcagagtgaagatctccgtgcacgctgctgaccggctcggcga

SEQ ID NO: 86870 - DNA, 1051 bp, Homo sapiens
cagtgggatcactggatcccaggaagttgaggctacaatgagccaagatcacaccactgcactgcagcctgggtgacacagtgagaccctgtctcaaaaaaaaaaaaaaaaaaaaaaaaagacccaaatcaagaataagaccagccaggcacggtggctcacacctgtaatcccagcactttgggaggccgaggcaggttgattacctcaggaggtcaggagttccagagtagtctggccaacttggggaaaccctatctctacaaaaatacaaaaattagccaggcatgatggcaggtgcctttagtcccagctagtcaggaggccgaggcgggagaattgcttgaacccacaaggcggaggttgcagtgagctgagatcgtgccgttgcactccagcctgggagacagagcaagactccttctcaaaaaaaaaaaaaaaagaactacaagaccgctctttttgacagcagcttccccaaccagaaccagcccaggaactgcttgcaggactacctggacttccacctctgtgagaaggcagtgattgctaaaggggacaatgtctttgtatgtgaatggtaccagcctgtgtacaagtccctcattcccatatcctggatctcagcctgggacgaccactgggcagaagccacatttccctgggaagatttgaactggctgcaccccacctttcctctgtcctccgtccttctcccagggtggtaaaaggggacctgggtacatggcgatccccaccctggaaccctcaatcatgacttgactaataataaaacttattggaaagtgaaagaaagaaagaaaagaaagaaagaggccaggtgtggtggctcacacctgtaatcccagcactttgggaggccaaggtgggaggatcacttgaggccaggagttcaagaccagcctggccaacatggggaaaccctgtctctactaaaaatagcaaaaattagctgggtgtggtgacacatcaccactactcgggaggctgaggcaagagaatcgcttgaaactgcggaggttgcagtggg

SEQ ID NO: 86871 - DNA, 1030 bp, Homo sapiens
cttgacttaggcatttaaatgtttccaagacaaattggaacaagaactactcaaatggaggagccaaggacagaaattgcaggtggctagaagttgtttccctgttccaaggcagcaataattcttaggccttcccaatgatattttggtcacagtgcattaagaaactccaggatgtgaatgaggactccataaaattcctgcttcctgtaccaccgcaggctgcagtggctctgagatgcttacagcaatggggtgtgtattaatgagactctaaaacatgccctaggatgttctgatgagtttttggtatagacttttcaaccctgctttgattccttaatatataaaaatggaatttatttttagttctcttcttactgagctcagacagggtcaaaatatggcaataaatgtaattttgcttctcatttgctgagtgttgtccccttgaagacacaatagcttcctttctattctctggtgtgcttttattttctagataagatttgagcaatcttttacccccttcacatttgtgagaatattttccacttagccagctttctgctctgaggcgtgttttgctgcatccttatgtcttatgatttattgtattcaatacctagaagaggcctttacgactaccagattgttgttaatatctttattaccaaaaagccatcattaagcatgcatgaagaaaaaaaattatatagacctggaatctcttatctggtgcctcataatctaagaaccctgttctccctctgcccccaacacagacattatgaaaaataatgggtttttttttaatgcagtagtatatccaggttggtatatgacaaggcttaattggacacaatagaggacacaccaatagagagggcaggtcagaagtgatttctgatttagaagtccaaagaatgccattgtaagaggatcagggttcatattcccgcaactttccccttaaatcagtctcagctctatctctgacttgtagatagaatttttggagcttttttcc

SEQ ID NO: 86872 - DNA, 1046 bp, Homo sapiens
ggcctatattttcaatatatacaaataaaaagtgattttaagaagatgtagcccaattaggattttccccagtcccctttcaggtactaaataagaacttcttgtcattgcaggtggggtggaagacaacccgtgagtattacaccttcatgtgggttactttgcccattgacctaaacaacaaatcagctaaacagcaggaagtccaattcaaaggtgagaaaaatactggatcaaaggtgttgaagacagtagccaagactaattaattcccttcagcttgagctttctggggcagataaaaagatttccagaattttacttttctgaatagatcttattttggatgaaaaattatgttgtgttttcagcttactacctgcccaaggatgatgagtattaccagttctgctatgtggatgaggatggtgtggtccggggagcaagtattcctttccaattccgtccagaaaatgaggaagacatcctggttgttaccactcaggtttgtaaaacttctcacctcaatcccttactgccattacgggtagcaatataggataggatggaatttgagttaataaggctttattgaatatctaacgggtatcattggaaaaaatgtatgtagtactcacacagactcactcaggaatgacttcggaatgttaacaagactcataacaataagtggtttcttcttttctaaaacttctttaactcagctggcattcagttattcttttaactttccaattgcttaatttttgtcatctacacatcttatcacaatggtaaatgtaaaagctcctttgaggagagaagcaccaaatattcttatctctttcagttctggcctacagcctgtctgtcatacgtgagtattagattcattttcttacttcatcatttaacaggacacctacttttcatccagcactatggtaggcactgggaacacaatgaagaatcagttaaaacactgtccttggcctcaaggagctaagtccattgggagagacaaacaatactaagcgtctgcaaga

SEQ ID NO: 86873 - DNA, 1049 bp, Homo sapiens
tgcctgtaatcccagctacttgggaggctgaggcacgagaatcacttgaacccgggaagtggaggttacagtgaaccgagattgcaccactgcgctccagcctgggatacagagcaagactcgtctaaaaaaaaaaaagaagaagaagaagaacagggacagatttctgttcattctcctcagtgcaaatctctggccccagctttcctcatcattattcaaacccaacatatattcggcatttactataagcaagtgctgttattaagcccatttatagatgagggagccaaggcttagcaaggataaagacttgaaggccgcacagctgcagaaggtcaggctggaccagggtttatgttgttaacactaaattgtttggagaaacagcaaacccagctgtgggggaatgggaggggtgggtgtggagcctgaggctaacttcctcccacccagccattctgtcctctctgcaataaaattcatagtccaggaaattccctgcaagtgacaatgactcttaaactttcctgaagataagaattgctgggccagagcctccttcactgcttgccatcccttcagctgatggtcagtaactctttctttgccagtagcctgcctggccttccagtttaccagagaggccctggtgatgaaccaggcccacctcccatcttccggaacccatccctgccacctcacccaaccccaccctccttccctctttcactctgggagtttttgcagttcatctgctcagccaaagagaagtaactgctaatgttaagccgaaatttgggtcaggccaggaggcacctttaaaataaaaaatttactcgggtacaggaaacagctataaatgatcttggaaatgcaggcactccatctggttacacactccaggcaatgcccaacagagcatctgaaggggccttgcttatcaactgtcatggattcaggaagccaaacagacctgcctgttaccaaggtgtctcctgcaggcccctgcctccagaaatgaccacccctgagatgaaaacttctct

SEQ ID NO: 86874 - DNA, 1047 bp, Homo sapiens
catagtgaacaacagtattatttttgttgtgttccacatctgccgtgtataatctccttttatttttttctgagttaactttgttttcttttttctttgttttttttttttgtttgtttgtttttctgctgactacctacttatctgtcataactttgtttttattgtggtaagaacacaatgtgagatctagcttctttttttttttttcattttaaacaagaagtttatttaaacaacaagacgcttgacttgaagggaaaactatgtaggattcttttttgttttagagtaatttatccttacttaaagacagattaccctacatgtaacagctacgtacaaaaaagttataaaattgtccttggttttacaatgataaatgaaaaacattaaaattctccaattgaacaaggtatgcaaggatttttatgttgttgttgttgttttgttgttgttgttaaaacagtgagagcaaaataacttactggaatataaagataggagctgaatgagcatgccactaatggagaaagggggtattttcacagaatcagtatttttccccatcccgtctccccttgatgtcagtcaaaacataccattggctgtttagttaaaaaaaaaaaatgcaatatgcttgtgcacatataccagttactttacgtacaataaaggaatggggaagggggaaatgaaagaacagagaaaactatacggtagtagtcaggatgtggtggaaccaaattgcagttttctaattgagaatgtaatcttggtctttaaagaacagagttctggagtaaagaagcaggttcccttttcagtagacacctcccgtctgctgttggaacacatcaattgtatcttcatcctccatttccaactgtgcaggtgtgtctgtttcattgactggttgcccgtcgaatgggaatctgatctacctcattgacaatccctgttgttcacaataggctttcattagtttactgagtggtgtatgcctcttaatcttaaactgcaccatagaaccatcctgccccgcca

SEQ ID NO: 86875 - DNA, 1025 bp, Homo sapiens
tgcccagtatccgcctccagtcttcccgagagaccattccctttcgcaacatttccttcctggggcttgggcacatttccttgacttccgatctccatgactttgctttgaagacccactgctctgtccctctgacctctaatgccctcctcagctggggcacggtgcaaggaagagcgtggtctagggaggacggacgggggtgaaggggacgaccaaaggtcgtcattataagcaaacaaccagggtctcagtgggattattattactattttttccccctctgcagactgaaaaaatgcagaccgccggggcattattcatttctccagctctggtaaggtgccgcgccgcagtgctctgtagtaccaggtgtatggtgtggacgccatcagtgtttaatgaatgaacccaggggagcttggcgtcctgatgatgtaggctctttgaggtggctgtaggatgtgatgaaggtaacccctgtttatctgggcctgtgaaccaagctatcttggctttggaatgtggtcagagagtctggatttgatttttatccccagtctgtcctggccatagagacagcccactaaaacagtggttttcaacagtggctgcacgttagaatcatccagggaactttttaaaatcctgatgcctaggctgcaccttagaccatttgcatcagactttgggaatgggggtggaacccaggcatctgtatcttttaagacttctccagatgattccaccgtgcagccaagtttgagaaccactgcactaaaaattatttcaaaaaagccatgttacagatggctctccttggatggctattccagtcggtttccggggctgactggcccactccatttagggtgtgtagctgtgagtgtattttagcagaataaaatttcccccatctgattacttggtgatctgggtataaacctttcctgtacctgctttggtattagtgtgggttcttgttccattctgagaagctgattaaagctgtgcccaaagaagtg

SEQ ID NO: 86876 - DNA, 1051 bp, Homo sapiens
gaaaccaagaaaatatctaattggtgttaagaacaccttctaactgaaaggcaactagcaaagagggttaaaacatacagaaaatttggattccatttacgtgcaatttaaagacagtcatgtaggtatttaagcatcttcctagggaccttaggggaagcaaagaaatctaattctaatgtccttgccctcaaggagtttggggcaccaacagagtagaaataagtacaccatgccctacctcattgtatatgtgggtacatgagctatgtgctatagaagttcccagaggaaaaaggaggctggtgtgagttataataatgtgggctaacatttgagcacctgtgtgtcatgcacaatgctaagcactttccacgattaacttccaacatccctatagaataagtcagtttacaggtaagtaagcaaatgaagaggctcagagaggtgaggcattctgcctaaattctactaaaccacagctggttagtaaagctgggattcaaactccagaacctgtgttcttagctttgtgctgactcatctgaggtttgcacaagtgtggtgacttgcccaaggtcatagagcatgccaatgattcgaatcccagtctgacatttatacaatcatggcgtttctaccccaggatttcttgaccttggcatatctggggccaggtaattcattgttgtggaggggactccctcgtgtagtgtatgtttagcggcatccctaacctctacccgttcaatgtcagtagcaactgacatccccacccaagttgtgacgacaaattgccaaatgtcagaatgttgacaaatgccccctggctggggggcaaaatcatgcccagttgagagctactggtctaccacaatctgctgcatctcctcagccttttcaccttaagaaactccctcaagtttgcccacaacaagccagtgacaaccagaagcaaagcccaggaatctcacggctgaataggaaatggaactgaggttaaactggtgactgatgtttcaccaagagagcaatggattaactggtaatg

SEQ ID NO: 86877 - DNA, 1022 bp, Homo sapiens
attcagctcacctctccgattacacagatgaagaaatcaagaccccaggagagtaagtggcttgtccaaggtcacatagtgaggtggagcagcactttgaagaggtgtctgttattagtgtaccccataggtactgattggcttggaaaatcccagttcatgtctgttgtcgcagcttgactatttatagggcattctttcactctcaaaaatgctcctgtttggataataaattatatggtcaccctatccattgtactacccagctcttcccccatcccgttactcttgacattaactatgctatggtactataaatcagatgtagggaaggttgggaatagggcaagcttgactgaagtgtttgtggttaaaggactttgctcaggatcctgtccttactggttgcgtttaagtatcccttccaccccaaagactatacctctcttgtcctcctctcagagagaaagcttaatacataatgtcacatttctctggcatagatacctaggtttctctgtcactgaatgctctacccacagaagtgcagttgcacttaaactgatgttagaaagaaatcatatttcctaaacctaatgctgtttaagtgaaacacatagttttcttacagtaaatttcttacagtaaaaattcagattttgtattgttggtgtatctttttttgttgttttgaatagatttcccttcatattttttttttatgtagttagaaatgtttttcctaggacatctcgtcctcagtcaagtaccagtgttaatagcctagtacctggggtcccagagttgatgccatgttgagaccagttgagtttactattccaaatgactgagagccagaatatgacgtagggtcttgccaggagggcaaggtgggaactatagacttaggcattggattgccacgtccctttccttttgctgttcaaatgcttagcagacctaaatgcctaggagcctttgtggaagaagaaatataactgagtcagttcaggttttcctcc

SEQ ID NO: 86878 - DNA, 1196 bp, Homo sapiens
ggaagcaagcagataccctaggcatccatcacaccccctaaccctgctgtgttactggcactgggctgtggcctccaatccctttcttcgtctcctttcatcatactttcccttcgtgccacataaatgtagggtggggttgcatcatatgcatgtttggcctgggcaaatccaaacatatattcagtcaaaatctgtgtcgatttctcaaaattaaaaacgctagggttatattttatagataagcatattatatttttccacagtggtgttttatccattatatgtaacactgatcagggaggtctgcacaaaaaaaaaaaatgctttaagagagttttaggggatactcaagagtgattttgactagattcagttttcgccttgggctctaactttagaagtaacccctgagtaagatgtcattccactgtaatgagatttcttaaaattccaaacctacgtattagtatgagtgaatacaggatgttccttctgcatggtgaggatatagaacatgtgtaccagattatggactctgcttctggtgtgggtagtaggtggagggtagccaggagggcttggggtgggtcatcacctcacaattttgagatggggttttattttgcagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctagggtaagaggagacttttaagtagccaagtcggttgttagcagataattactctaggtcagcctttatcaaccggagtccctcatctgaactacagaacacagaaaatgattgagtgactcttctcaaatctcctcaggatggtatgtgactagtatcattctagatgcagaggggagaagttaatttattacagtggtaacctttgagaagtggttctcttaagagtgtggccctgagcatctgggaacttgtagccgagcagtttctggggccctatcttagacctacaaaagaaactctggggttggggccaaaaatctggtttttttggttgttgttttttgtttgttttgagacggagtcttgctctgtcgcca

SEQ ID NO: 86879 - DNA, 1057 bp, Homo sapiens
gtgctcatctctatccagtccctgatgactgagaacccctatcacaatgagcccggctttgaacaggtaaggccagatgggcctggctctggggtgtagactattgtttttgtttgtttggttggttggtttttttgtttttttttttttttgagacagagtcttcctctgtcacctaggctgtagtgcagtggtgcaatctcagcttactgcaacctccgcctcccgggttcaagccattctgtctcagcctcccaagtagctgggactacaggcgtgtaccaccatgcctggctaatttttatatttttagtagagatggggtttcaccatattggccaggctggtctccagctcctgacctggtgatccgcctgcctcggcctcccagagtgctgggattacaggcgtgagccaccgcgcccagccagaatagtgttttaagagatctgcttgggaggttttttttgttttgttttgttttgttttgttttggacctagcacagccccatgtactacatttgttggtatagggaaaaaaagggaattgacacgtgttttttagtaatgaaattttttgccgaccactgtggctcacacctgtaatcccagcactttgggaggctgaggcaggcaggtggatcacctgaggtcaggagtttgagaccagcctggccaacctggtaaaaccccatctctactaaaaattaactggtcagaagtttgagaccagcctggccaacatggtgaaaacctgtctctactaaaaataaaagaaattagctgggtgtgatcacttgaaccctggaggcagaggttgcagtgagctgagatcacgccattacactccagcctgggtaaggagcgaaactcggtccccccacccccaaaaaaataataatggccaggcgcggtggctcacacctgtaatcccagcactttgggaggccgaggcgggcagatcacaaggtcagaagtttgagatcatcctggctaacacagtgaaacccagtctgtactaaaaatacaaaaaattagctgggtgtggtggcaggc

SEQ ID NO: 86880 - DNA, 1026 bp, Homo sapiens
cccaagctcaagcagtcctcccacctcagcctcccaagctgggacttacaggtgtgcaccaccacagctagtttttgttttgttttgttttttgagacagagtcttgctctgttgctcaggctagagcaatctcagctcattgcaacttcagcctcccaagtagttgggattacaggcatacgccatcatgcccagctaattttttgtgtttttagtagagacggggtttcaccatgttggccaggctagtcttgaactcctcacctcaagtgatctacctccctcggcctcccaaagtgctgggattacaggccctgttttgttttgtttggttgtagagatagggtcccactctattgcccaggcaactcctgggttcaggtgatcctcctcccttagcctccaaactgggaggctgagattattacaggtgtgagccactgcacccagcccatagtgttttgaagctaagatgcgttcagccctcccagaatcttagggattatatgaatcctctatttaaattctgttcccagccctgagggttgatcacagaaacagtagcttagagaaacaacatacctgtagtgtcacatgttgaaagattcctattcaaagatgataaccattgttcattctttgcctctactgggaaaagtgtgcttttgcttcccataagaactcaaaatttaggcttgttttaaggaaggaggctatcattgaccaaattgtagatagacagccaggtgcggtggcttatgcctataatcccagcactttgggaggcagaggtggacagatctcttgaggccaggagtccaagaccagcctggccaacatggtgaaaccccatctctactaaaaatacaaaaattagccaggcatgatggctcatgcctgtaatctcagctacttgggaagctgagggatgagaaatgcttgaacctgggaggcagaggttgcagtaaactgagattgcactactgcactccagcctgggcaacagaacaagattctgtctcaaa

SEQ ID NO: 86881 - DNA, 1730 bp, Homo sapiens
ggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggaggaagtgcctgtgggtgtgggagggcttgtgtaaaggacgaatgggatcatcttgtcaaccacacctcacctaggcctggaactgttagggagaaggaaagtgccatgaattgtctggaaaccgaagacttgcataacatggtggaagggcagggctgggtggggagagcaggacaagttttctcattggaaatggggtccatgctctggcagtcagtgacatcttagtttgagtggtttccaaaga

SEQ ID NO: 86882 - DNA, 1061 bp, Homo sapiens
ctagagcatgacaagggaagattctggacaattaattgatgggaagaaatgatgataatcataaactgctaataacctccattatttaaatattcagcccttgccctgcctcattctactcatcctccaatacagaaaagcccctcccttatttagttctgttttacgtcataaaggaaactgggccgggtgcggtggctcacccctgtaatcccagcacttagagaggctaaggtgggtggatcacctgaggtcgggagttcgagaccaaactcaggcctggccaacatggagaaaccccatctctactaaaaatacaaaattagctgggcgtggtggcacacacctgtaatcccagctactcgggaggctgaggcaggagaatcacttgaacccgggaggctgacattgtagtgagctgagatcacgccattgcactctggcctaggcaacgagtgaaactccatctcaaaaataataaaactgaacacatctaaatacctgatggggatttgggggaagatggcatatgcttaaggcatgatgagggatgggggcatggcaaacaagattttttaaaatctgtttttgaagaatccataaagtagtttcaaaagacatcaaagagtctggctacccaaagaaatctagttagttgtctgcatgtctgtctacctgactagactgtaagctccttgagagcaggaattttatcatctttatatgccccacagcctggcccagtgctttgcactgtagctgctcaataaatgtctgctgaacaagcacaggcctgagtagttcatccactggatagtctcagcaaaagacctgcataatggggagcacgagctgagaactgctccagacttgcctcacagactgtcccttgcacacacacacactcgaaggtgcaccagtacctctgccagctgcagcaccacggtgtgatccatattgagctcagctggaacagactgaatgaggtaagtgccgcccacagggatgatgccgaagccagtgccaagtgcctttagtttcttgatggctctgatcaggtc

SEQ ID NO: 86883 - DNA, 1300 bp, Homo sapiens
ctggggtagggggatgggtgggggcggggcgcttccctaggggccaggttcttgcaaagggggaaggggcctgtagagcttcagggacgctgccgcaccgccccagtttaccccgggggtgagttgagttccccaccctcaggcgggagattatcgggtttggccggagggccgaggggccctgtggcgtcgggggtctttccctgcagggtgggtgggggctgtcaccacgtggcttctcctttttttttttttttttttttccgctccattttttttcaagtcgattttatttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccggtaagaacacagccacctcccggaaaagccacaacgagagccccgaacaacggagacccgcaccttccggttcctctcccgccaactcctctcttcccgggcctgcggggtttggcctccgtacccaccctcgacctacccccttcgatgccccctccctcgctctgcgcctcccacccccgcgcagaaacattcgggatttcctcatccctttctcccagcctgagataaggagctctggcttcccccatccttcctccccaccgacggggcgggagcccccactggcagtagtggggggttgaatttagggacacggggatgacccctggctgggcgttatttccacgcccagcccctccctatccgccggtggacgcccccccagctggaaaaccccggctcccgttcctcagtcttaggcctttccaggcgtggaaggggtacccggaccgcctgcgatctgtccgcttcgcgtggggaatgcagccctccagcag

SEQ ID NO: 86884 - DNA, 5022 bp, Homo sapiens
cgctccgctcccccaggtccaccccttcccaaaccagccccgacaggtgaccgctccgtggcccaaagcccgtcttcctggccaacagagaaaaataaagtttcattctgcacactgcctcccgccccgcgccccactttctgaggaacggggagccctttctttcctggctccttcccacatctgggagctgtgtaggcagcgcacccacacaaatggcctcgcacctttcccaaatcgggattccagagcgatccactcaacaagcctcagtgatttaataaagcaaaaattaaaaaatgaataataacgaatttacagactccaccattcctagagcaacctttttcccatctggatgcggaagccactgcctggattcctaggaagatctcgaatcccagtaactcctgaattatcctagtgtcttttccccttcctcttcccacccccaacccctgttcaagctctcatggtaattttttttttttaatctttagggaaagtagaattacaaggaaaacgcttagagattgaacattcggtgcccaaaaaacaaaggtaggaaagagctcttttcggggggggtgggggggccgcgggggtgtgctgtgaagctgtgttcaggggtccatagcgtctccagtggaagaaacccattactggtctttcccacccccaactccggatgttgggggcagggagggaagattggccaagatcttgtaatgggtggtttacagcttgtaaaaaaaaaataaataagttggggctggggtaggctaaaagatgttacttgcagaattaaaggggaaagaaaatcaataggggagaaaccttgtggagtttgtttgttcaactcgtggggccgttttttgtgggggaaccttaaaatctttgaagagttcagactcatggcgatttctgcaacttcgtagcaggcctcattttctgtttttcccactctttccacaccataattcttaagtggattgcccttctcccgaagcgatgtggaatgagtttcccggcccccaaagaatccccttatgcttgtactttatttatatttctacaacaggcaaagactttttattttccatggaccccccacccccaatccctcatatctcacatcatccctctccccagctggattttccaaagaatatgccttggctgtactatccttttcgagcccccctacccccactccttcagcccattgttaccaggggaccatctggggtgagagctttgtgttgaggctgtgagctggggctctttggagggtctagaactccgtggatgaatggtgtgtgtgtgtgtgtgtgtgtgtgtgtgtgtgtgtgtgttcgtgtgtgttccaataccctctatcctctctcttcagcaaaatggggtacctccatcatacttaccgagaattcatggtggatttcaaatcttgcattgaactctgaaacctttccttgaactctggctgggaagtataagggcagagtctttctactttctcaaatcagactttaaacatgttgacagtgtagagtttgctctcatgtcccaagctggaaagcagcccccagtaaatctttgatcttcctcaccccccatttcagctgaaaacttggtacatttcaggatagtctctggccttttccgggtagatgggagatgatgactgctttttctgggggaccattaagagggcctagaaagtttaatgtgagataaaaatctgttcagttgcttagcttgatatttaagtaacttggaactattgtgtctatagatcaatatggcttgttactatgtttatagagcttgcgatttaacttcacatgtttgaaataccgtgttattggaaaggcaattagagttaggagtaaagaggcaataaaatgggaaggaagaaaagaagtcttatttgttattttgaaacattttctggagatgtgtctaaggaacatacactgacaccagcaggtttattgaaaaggatatggatatttgaactgaaagctgagtgttgatgaaaaatatccagaataagtggaattctaaaatatgtggattttttcttttgctcttgaggatggtttaaattttagggaataaagtgaaaagcaagagaaatagcaaaacgtgatgaaatggaactcaaaacatttatattttaattttcatggtgccctgtatttatgaatctttttccccaagccatctgcttgcttttaagtcatttctaggccctttttccctccaaaatgcattactgagggctcttttttgagttggaatggagagggggtttgtgagaagactgggtaaaaaaaaaaaatctgtccacacccatattaaattagatcttttatgtgttctccccttcctgaaataatttttttagcccaaacattgagtcagttgtgttttctttgctttttattttggttggtggtgagaaggcacttcatttttctagaatgaatcaatttttgaagtctcaagatttaaaaaagaaagtttgttttcattaagtcagtttgctctatcattttgtgtctttgaggaagtatgttgtggtatgtgtctttagtctgtgtctgaaaagtatttcgtcagttaggtttgttactgactttccatctcatggatgtatagaacaggaactagttaattatgactaatatattctaagcaaaatgaacaactatacaaataatattttgtgtatatatactcttgtattttccttatgaactcttcttgaggcattcagttccaaatgaactatgatttcaatttctaaaataattcataaaaacccaacaactaaatgttcctggttgttttgttttgttttttaagagggggaaatcaaacaaaagatatgctgtagcaatacctcttaatgtattttgttcttagtttgaatttatttgatacatataatttgtacctttttaagaactcaagaggccgaacactatgcatttcaactgaaaacagcagttagcttgaatttttaaaatgaggtgatactaatttcttagagatcaccatctcaaacccccttagtgttggaatttggttaacaatttgtgcttttttgttgagaatttgtatatgttcactgccagatactgagacaaaagagaaaaaccaaatgcatttaaaaacagttgtggaaagggcttgtatatgttttattctgagagacttaggagtagttgaggtaaagggggtaccattttagtgtgacttgattactttgagacatgatttgctttttaagggaattaaacctttgttacacttgccactgtggtgtgcctttttctagaggaatgtgacctaaagatagcatattcactgtcaactggtgtcatcaaaataaaaggtgttactgttaattaagaaaaaaatgaaagagatgcactgactcattttttttaaaggtgaaatgtgttcacattaaagaattctaagtttggtgatttctttaggcagattaatggtccttttcctctatgttgactaaaaatgaggtgggctaactcccttaagtacctattaaacaaaattagttttataaatcgttcataaaattgagaactcccaaaagaaagtgtccaaattttacagtttaattttttgaagttaacagctttaaaaatctgtgaagggatgtcttataaatggcaaaaaatattttaaatatattttaacaatgatttgttgaggctctgaagaaatcacttggatcactaaatgttttcaaaacaacctaaaaattgtcttcagaaatggatttgcacttaaggaaaaaagaaaacctaccttgtactttggggctgaaaatgaatgaagaggggttaaaaagggaatgaaaactactagagcgggagggttttcaggcacttttactttaatggttgtaattatgaattagtatccaagtcaaaaagaaagtttttaactcatacgaggtaaaagataacatgtgactactattcaacatggaagtttaaagtagaaacaattgattactcttttaaaaaggttttcttattaatattaggttagaattttttttttttttttgctttacataagtgaaaaaaatggttgaatgttaagtttttgtgcactgtttggaggaaaggtggaaactggggtacattctttccctattttaatttccacctaaaaattaaactttgcaaattcataaattagtttccttcactgctggtagaaatccttaactgttctcatttgggtggtcagtatttcaagatgagagttttgtaagggcagtggcaactgactgtcccttagaagaattgtaggtttctagaaccccttattttctgacccaaattaaaaagatgaaattttaccataatggtttctcagatggagaactttttagtaaaaagggggaagaactgcaagtcccatcactaatttattcaaagtattgttaattgttgaaaaggtaaagttttaatggcacagcttttggtggaaaaaaacataattatgtttcagagattaaatacatgacattagcaattggaagaaccttgattcaaaggttctgagcttctaatcttttaaaattaccttaatatgtatcattttaatctatgtgtgtgggtacttttaaggcttactttttaagagtgtatttatactatactttaatgtgtagcagccagttgacaaagatactattgaggtagtctactgagtatacaattttaaaacattttaaaattcagatctggtttagttgagtgagaagtggggaacagcaagtgctatttgttgaagtttaaaggttttgtgaagagttatttagtggttagatctgttgatttttgtgtgtggggtggtagtggtggtgatggggttgttagaataagtttatgaaccaaaggcatttgaagaacggacattttcccagctgttagaatttaaaataagtgtggttcgttccctatcctcttaaaa

SEQ ID NO: 86885 - DNA, 1072 bp, Homo sapiens
ccccgcgccagtcccagcccggcaatctcgtctcgctctgaggtggggccgcccgcctgccttctcttaacaagcccctgacagagaacatccgctggcctgggtctccgaggaggacttcccctctcagatccctgagaccccaggagatcccaggccgcttgtggtgcgccttagtcctgggaaccccagatcgcaaacctcgcagcagataccccacgagagggttccccctcaccggctgcgggctgcgggctgcagaccctttccagcacctgggctgcctcaggagctctccattctaaggcaaaaagccagtgggtaaatgtgaagtgaaaagaggcaagaagagaggaagagtaggtaaagggaaaataggatgagacagttggagagaaaatggaagtgcaagtagctgttcctctctcccagtagctggggtcttggcctgagaaatagaaccttaaagagttaagtgtcaatttaagtaacctgcaatctttacaaaatgagctgtttgtgtctgtccacaggtcctgaaggctgaccgaaacaataacagaggcagtaatagtagtcagaggttctatccatggattttgtttatcttgtaaaagagagacaacaggccttccagttgtccagggtctcagccagtcttcgactccatgttagtgtaaaacttctgcaccccatccatttccacctttcctctcctcccctatacctttttaaatgcctgtcaaaacaaaaagcagaaggaaaggtctctcaaacctgtactcaagaaagtgtatgcccatttggttaccgatagtttggttaaaaatgatcctgtaagataccacctgacacacaccatcgcaagggcaaggaggcaatgccagcaggaagctacgtagtccccaggtagtgacttcattctactaggagaacttggatggcccttcagattttgatcagaggagactatgtacttattactggatagaaggggggtcatcctactattaaaatttattgcagagcctgctttgtaagacctgcttactaccttgcagcacagtaggtt

SEQ ID NO: 86886 - DNA, 1056 bp, Homo sapiens
tgagtgaaatttgattggatagtttagtttagttgattggatatagttaggatctttaaggggagaaatcagagaattcagaaatatgtgtgtaatggttgtttgtgtggtctgacctctttggcaaagaggaacaaggaggaaaggaatcattcaaaattcttaaggctccaggagggaagaagtgctgttaggtcagagtcttaatgacctaccctaggtctctcactcatcctttactggggtctggaggaaaggtcttcctcccaggagaattcagtgtttaaaagcttgagctcaatttccgtaactgtaaagaagtggtcctaatagtagtacacaatagctcttattgttattattttgttgtagatattgacttctgtccctcctgccctagccattgtttgtcctcctttgaagctttacagttgtatcctaccctgccccatatagctgtggttagctccatgagtattagaactgatcaagtgtacagatgcctgaaaatgtgtccatgagaggttgtctttgaactgtgtgtgtgtcagcttgggctatatatctaaggcactaggaacagtgatggctaggcatgttgaaggggatctgtgcgtagggtgctttggtaactctacctgtatgttgaaaggaaaagccaccttttagtggagagagatgaagctcaccagggcaaccccacagagcccctagattatagattcccccagtacattctctgagacagaggcttggagagatgaggcgagcatggtggataatgctattaattgttctttaggggaaacaggccatttattctgttatcgtttatgccctgaacttggtccaggttcctagctgaaatttcacactttacggctactgtcaaaggtgtacatgtagagtagggacattggtgagaggggaactaactctgcatataaggtaggtgttgtaagaattcaggatgaaggggactgtaagaatcctcctgggggtctgaggaaggaagaaatgagagtgacctcccccatctgctgggatgggtatgtt

SEQ ID NO: 86887 - DNA, 1044 bp, Homo sapiens
ctctactaaaaatacaaaaattagctaggcatggtggctggcacctgtaatcccagctacttgggaggctgaggcaggagaattgcttgaacccaggaggcagaggttacagtgagcagagattgtgccattgcagtccagcctgggtgacaagagtgaaattccatctcaaaaaaaaaaaaaaaagtaaataaattgaagggcaaagataattcttcacagagagatatggctgttggtggctgcagccagtgtattccaaacaaggactagatgtactaggatgttggctgaggaagcagctagattcagaagaataatcttgttaagggtcttcctacaacttatttaaacttatttaaaatctagctgactgaggttatctatagggttttcttcctctctatatttattaccatttggttaagatatgctgctgctgttggctttttagaatagagtggagtgattgctgtccagaatgagctctgggtgtaggcaggaggtggaacagaatgatcttcacaaacctctaatatttctgtgagataatctttgttccactcttctaccctttccctcttgctggccatcttgaatgagtagtttcttttaaacttctaactaaaagaggaatgctgtctgtctaggcccaaactcctttgctctcttctcttaaaagccccatggttagcaactgtagcctgggagtgtgtgtggggtccttgcctcagtcactggctgtttgaaaaataacttaaaaaatatatatttacaatgaaatgccatgggagaaaacatttaacaagatgctgcagacgtctgggatagcttgcatattgctgcaaagattggtacttctgatgtattcattcatgcatgcaggcatgcattcatccagttatttttatctagtaagagtctactattgcatgatatgccctttgctaggtattagaaatacaatgaggaacaagtgaaagaccctgatcttacagtgcagatggaaggaaatacaatttttttttgtttctgttttttttg

SEQ ID NO: 86888 - DNA, 1002 bp, Homo sapiens
ttcagtgaggattcacagaaatgaggctctcagttggtagggcagccactcctgtttatttctcttcttgagcatctttgcttctgagcactgtgaggtgataaggctcaaaagatgagttctttctacaattataggagcatttattgagtatctgctcagctcacactgttacttcaccgaatttcccaaagaactctgaaggtattatcatcttcatcctacagaagaatctgaactaaggtcacaccttcaataagtaggagtgctggcatttcaaacccaggcatttctatttccaaagttgagctctcttagaaggtgtgaactctggaggttgaggcaggaaggttgcgtgagctcacgtgtttcacattataatgagctatgatggtgccattgcactccagcctgggtgacagaatgagaccctgttccaaaaaaaaaaaaacgttgggaacaggtgatcctccaatactcaggttgaggttttcttgagctttttttgcaggggctggggagtggggcgtaagcttagcagataaaatttctccttgctctgagcctccccaggcatttcatacctaccttgcattgtattttcctatcgccgttgagattttcagattatcttgagtggttgaagaaaattgatttttttttttttttttttgggagatagagtcttgctttgtcacccaggctgtagtgcagtggtgcaatctcggctcactacatacaacctccgcctcctgggttcaagtgattctcctgccttagcctcctgagtagatacaggcatgtgccaccacacctggcaaatttttgtacttttagtagagaaggggtttgccatgttggccaggctggtctcgaactcctgacctcaggcgatccgccctcctttgcctcccaaagtgctggaattacaggcatgagccaccgtgcccggccagttgaagaaaattgagatggatgggtccaaattttctccccttgtct

SEQ ID NO: 86889 - DNA, 1065 bp, Homo sapiens
ttcttgtcaaactatttccgagataggcgaattgagcaaagtattcatgctgaggttggcttgaccccaccgccacttagcaccttccacaagttgcttccttcctcccccagagcaagatgacattttgcatggtagggatttttggtgagcaccctttcaccccactaacaaatctccctgacagccatccagccgtatgatagggcacttagctcttctgcaagtgaaatcccgtgcccaaattagagccgcatgcagtaaaagccagttggcacgcacttaaccatacagaatatgggcacttttcctgcttctgacgtcggggctgttcaggcttctgctgtattaacacttgtcttcagaaagaaagcagtggagtttggtgcagtgagcacaagcagcctactagtcctgcctccaagttggcaagtctgtttccttctctgagcctcagtttctccatctgtgaaatgagggtgactgttcagcatcctctcaggcttcagaggcttacccctttcctttctgcctcaatgtatgaatctgatgtttttcaactggaacttcttggtgacagattaaggtgtgtgtattgtgtgtgtgcgtgcgcacgtgtgtgtgtgtgtgtgggatcatataagctgagtgattcccttctctcccctaaatatgggtagaagagccctccagaggagtgggaagaagggttcagcccagagtagctcttggtgacctgcttttccttcctacttttcccccaacaagtagtataggaaggaggcagtgcgtgtatgccacatacattaaaagaccttgctcacagggtgacagttgcattccagtggtgtcctcaccttccagtcccctcacactctggctttcttcgtggtggtggcatctgctctgcccagtcccacatctcccagtaggtcaatgttttctggcccctacccctgccagcctgccactcgacagcccgccagcccgcccgcccgcccccctgtcctcctgcccccccgcctgtcctcccgcctgtctggctgccctgcctctggatcagcc

SEQ ID NO: 86890 - DNA, 1666 bp, Homo sapiens
aatttgaattttctagtagcttccttgaaaggggaaaagttttttgcctttttattcaagttggagtatctgccaggtgtccttttctttcttctttttttttttttgaggtggaatctccctctgttgcccaggttcggagtgcagtggcatgatctgggctcactgcaacctctgcttcctagattcaagtgattcaagcagttctcctgcctcagcctctccagtagctgggactacaggcacgtgccactacgcccggctactttttgtattttttagtagagacagggtttcactgtgttggccaggctggtctcctgggctcaagtgatccgcccgcctcgccctcccaagatgctaggatttgcagttgtgatctaccgtgtctggcctgccagatgtcttcttgatctcaaaacgtggaaagctggagttggggattcattgattgggcctccagatttccctgctctgaggttatcctctcttttctctgcagtgaacaccgagagtgagacggcagtggtgaatgtcacctattccaaccgggagcagaccaggcagtgagtgggctgggaagtggggctgggtgcggtgggggggggttctgtgaagggtggtgtgagcctggtcccactttttcctcaggggggtctaggcaggctgggtccccatccagggttctgatattagcccaagccaaacctagaatcttccataaaaggtttcttcagggggtctccttcatgtccattgtttcagggatctcaaaggctcagaaacatcaagattgatagcaaaaatacatagaagggagggctccaaagccctcccagataagtgggaaatcccttgcagagaaaatgtcccctgctgataggtctctggttgctccaggaccttagagtcctttgccgtgttcatggcgccatctagtgataatgagggggaacttcggggttcaaaaaagattcctcaaccttgggatgctgggacattttattgcagtgatggtcgtaaacctagctggtgatagttgtggggtccttttagtcccatcgcacccacaattttagctcctagccctttgattgagcaattatgcgtctcactcactgttacagacagactatacattttgcgcattactcatttatattaatatccgagcccgttataggcttttgccacattttgctttgggctttcttgcttcttaacatgccgccttctccaatctaataatactatgtaaaatcctacctcttcttcaaatacctaccattttcttttagatacctcctgggctcagaattttctagaggttcctactgccccttgtggccactagggtttggctttaaagctcatgtcaacagttgttcattctctcctgcctattgttgctgtgttcttgttttttggagacaagtctcactctgccacccaggctggagtgcagtggcatgatatctgctcactgcaacctcaacctcctgggctcaagcaatcctcccacctcagcctcccaagtaggtgggactacagacatgcaccattatgcctggttcatttttgtatttttttgtagagacgaggtttcaccatgttgcccaagctggtctcgaacggctcaagtgatccgcttgccttggcctcccaa

SEQ ID NO: 86891 - DNA, 1747 bp, Homo sapiens
gtggctcatgcctctaatcccagcactttggaggctaggagttctagaccagcctgggcaacatagtgaaacctcacctctacagaaaatagaaaaatcagctggacgtggcggcctgtgcgtatagtcccagctactcggaaggctgagaagggaggatcgcatgagcccaggaggtcaaggctgtggtgagccttgatagtgccactgcattccagcctgggtgatagagtgagaccctgtctcaaaaaataaaacaaattggctttattgatgttcaattgatgtataataaatcatacatatttttaaagtatgcagtttgataagttttgagatgttttacttggaaatgccaagtctggggtggcatggtgattgagtcttcatgaagcccacaattgaaggaactcttgtcttccacttcttcctttgtcttcccaagggctgacgaggttcccctgaagatcctggcccataataactttgtagggcgtctcattggcaaggaaggacggaacctgaagaaggtagagcaagataccgagacaaaaatcaccatctcctcgtaaggctctcttctatttccctgtttatgagtgggggatgcatgggggccagggtcagtatttcatcatggaaccttgatatgtgctcttttaaaatgggtgctccttctgcctcttgaagaaaaacagtcgaagtggtaaagagcatttaaaaaatccctgtaaggactggatctgcccattcccactgccatatggggcaggggtgttgtaaggtgctgcctctacagtccacgtccaaccacttcacagccctctttccctgtggctcgtggacagcctgcagctaggagccagggattcagggctttaggcttgtctgtcactgtgagaagtgaccttggcccttttctgtctgtggtgggctgctcctgcaagcagtgtgcttcgtttcatcagagactaacctgtgggcaaagtaattgctcttgtccaaaaaggtataggacatggattatgtagaatcaatggggaaacttggaggcacaaccataatctgagattggatccattgctaacagaggagtttgagttaggtgttggcatctccctccatcttaccccctgccctggttacaaactgggaacaccaaagactggggttgcagagttatttgccagaagttgaataggctgcagaaatggtgggcctgtgactcagctggcctctcgtctttgttactgccggggcctggtcctggcctgccagtgaaaggacacaactctgctctttctgccaggttgcaagaccttaccctttacaaccctgagaggaccatcactgtgaagggggccatcgagaattgttgcagggccgagcaggaaataatgaagaaagttcgggaggcctatgagaatgatgtggctgccatgagcgtgagtgctgggtagtaccctctgcttatcctttcctgagtcttagcaacagcagcttgtggggtgcagggtgatggacatgtgccctgtgccgtgtggccttggagctttagttgatgcttttggacttcgactatcagaaatagtatttaaatagtatttaattagcaaggattcttcacctggttcctagagtaggggtccaatcttgggctttgagtcctgtgattccaagtatgtgtacaatttgtgtttgtgtgcactttattgaaatgagggggtccatcgttttcatctgattt

SEQ ID NO: 86892 - DNA, 1093 bp, Homo sapiens
aaagtactaggattataagcatgagccactgcacacaactcatctgatttttaaaggagacttggggttggggtacaggaccaaaaatgtttagaatcagagtcctagaagtccaatggagctctgtctccacgcctttttctcatatagggggttatagtatagtgtcatgggtctatcgtctgtctccagcagtctgaacagccagagaggaaggactcctgagggtgtacaactgtttggcatttctggttgcaattgctagccgttagtccagtgagaacatcatatcacttaaaattccacacccgaagtgtgtaggtgagagtgtatgaaaagcacagaataggcttttgtggaaaagtatgtaattcatgtttttggcccacttgcctctggggctactcgccttttatacagcgggggtcacacacaagcccctgtcagggtgtgctgactcttcctcctcatctttcttccccagctgcagtctcacctgatccctggcctgaacctggctgctgtaggtcttttcccagcttcatccagcgcagtcccgccgcctcccagcagcgttactggggctgctccctatagctcctttatggtaggtggaagatcttattacacgggatccctgggcccatatgtggcctcccttaagggggactcagcatgctctgggagttggatgcttggcaagtttgcagggagagggaaggaaggtctcagaggcatccctcctctccagtgctcctagccactggctctgaggctcccaaatgtctgcctagaatgctcccggggcatagacagcactgttcccttactctctcctggcctcttccctttagccctactgggcataggaagagctaaagagctcacagcatcccttggcagcccagggtggcggtttggtgcctgtactccttcctccttgaggatgcaaggcaggggagtggagggtttctgggccatgctacttgggccccctggtaacaacgcctcctatcctggcagcaggctcccgagcaggagatggtgcaggtgtttatccccgcccaggcagtgggcgccatcatcggcaaga

SEQ ID NO: 86893 - DNA, 1009 bp, Homo sapiens
agctttgagcaaaaaccttgattgttctccagtggaggtgcagtcactgccctctatccgttggtcatttcatttgtgtccttgcctgttggcaagactccactgaaacctctctgggagattggtaggtggagggggcaggaggccctacttagaaagtgtcattgaagccaatccttctaactgaccacctctgccctcctaataattctggtgtgaaggcgtaatgatgtgggcttcagggtctttgttcttcctcccctaagtcttcagaatgggtagttgggagtaagggtggtagaaggggaactggatgaagtggacatggtgggggtcttcccatagagggtccctcattgactagctttttgctttttagattgcaccacccgaaacacctgactccaaagttcgtatggttatcatcactggaccgccagaggcccaattcaaggttttggtctttattgttttccaagctgaacatggaggaattgaggttgggtatttcccctgaggtaggaaaaaggctgggtcagtttcccgttagctgtcaagtcctcatcacatctttaagccttccatgcaggataaagggctgcagagctattttcaaattgacatcaaactggatttctgttgacttcgtcttccctttttaaggtccacagaagaagatgggaaggaaagaagtctgagggcatcttatttgcactctgctgtcatttctaaggaaggcctttaatgccaaattctcatcttttatgtccccactaaatcctaaggttcttgaacttctgatcagacagccaaaaaatgaaccatcaactagcttaacctaacatatgtgaggatagaggactgggacagctctctgggccactggagagtcagacaggcctgccctctgtgtgacttgattagttgccattcagggccttgaaatgctggtcagtgccacgtccagattccataggtctggtttgtagcttgtgaattagattcctct

SEQ ID NO: 86894 - DNA, 1680 bp, Homo sapiens
gcctgtgggccagaaaatatgggctggagcttcctttttcccacttttctcttttgtcacagatatatgaaccactgattaacaattacctcctcttctcaggctcagggaagaatctatggcaaactcaaggaggagaacttctttggtcccaaggaggaagtgaagctggagacccacatacgtgtgccagcatcagcagctggccgggtcattggcaaaggtggaaaaacggtgagctgtgagggccaggttgaaagccctgggccttggtctccaatctcagcagctctctctggtctcctgtactgctcaacctcaggactcctgatttgctcatttacttgattctactccccaagctcaggtcctgactcttccaggttctccccactagtcaccctggctcctccctccaaccccacccatgctttcttgatggcaccctgagctcctctctggccacccccaggtgaacgagttgcagaatttgacggcagctgaggtggtagtaccaagagaccagacccctgatgagaacgaccaggtcatcgtgaaaatcatcggacatttctatgccagtcaggtacatatggtgctcccccattgagggagggctgcaggagcccagggagcagagaagcagagactctatagaggttgaccttcatgacgttgacaagtcctggggcctcagccacatctgcctgcctctaggctaggttattgccctctttcaggtgcagaagtgggatgtgtagatgacatattacctcttattactctctaggaaaagtgatttgacaagtttaatgtacatatattgtgtataacattatatatataaataacatatatatgaatatatattatatgtaaatatatatatatatgttctacgttagtccctccctaacccctttctgcactggttaagaaagaagattagttttgttcatggaataatgataacagtactaacaccctggattgatggcatttttgaaatgtagtccctctgcctttcgcagaatggctgttctctccctggtttctgctcttccaccctcccattcctttcccagaactcatcattgccgttcagcactcggacaggctccagagcatggaagggaaggccaatatcaggttcaaattttgctgaacctcagcaaggcaagcaaacaggtggttggcagctaatggtgttttcctaaagtcttaaatccatcattgttagaactggaaaggaactttggagactgttgatcacagttcctacaattcatagaagatatccagatcttagcaggcttgtggtctgctggggctgctagagcaattggggcaaactggctcttggttttttggcttccagtgcccatatagtatagcatcaagtatgaaggttttggatccagggagctttgacctcaaacttcacatacatagcctttctgctatgtgaccttggataagtaactttctctgataaccctttgagaagtattaacaagaggctttagttacatctcaactatatatatatataaaataacaaaaaagtattaataagagccataataataataatatctaagatttatcgatgcctttgtatacccagcactgttttatgtggcttatgtatattaactcatttaattcccacaacaattt

SEQ ID NO: 86895 - DNA, 1079 bp, Homo sapiens
gatacctccaaagatgcataaagccaggatatattaatattaaacactgaagcaattttagctgatcagaatgagaattaaatgaaaagctatgtaaaacatcaagccagggttgatggagttggacctcttattgacttacacattattttcccaacctagatcaacttcctctttttttttttttttttgtgacagggtctcgctctgccatccaggctggagggcagtggtgtgaccacagctcactgcagcctctacctcccaggctcaagtgatcctcccacctcaggccccccaagtagctgggactacaggcaggtaccaccacgctcagctaatttttgtatttttttgtagtgatgaggtttcaccatgtggcccaggctggtttcaaactcctaggctcaagtgatgtcactgcttcagcctcccaaagtgctgggattacaggcatgagccacaatgcccagcctcagctgcttctttaaccaggaaaggaagcactcatttatggaaaggagacattctggtcttcattctatgaagtgaatcccattttgcagtttatttcctttataaaactttattcttagggaagaaccttttaagaaggaaataataaaagattgggtattttgtccatttttacagtgaagcttatgtatttatgctttttgactaacccatatctggactttattttttatttttacttttttttttttttgagatggagtctcgctgtgttgtccagggtggagtgcagtggcacaatcttagttcactgcaacttccgcctcccctgttctagtgattctcctgcctcagccactcaagtagctgggattacaggcgcacgtcaccacgctcggctaatttttgtatttttaataaagatggggtttcaccgtgttggccagtctgctctcgaactcctgacctcaggtgattcacccgcctcagctccccaaagcgctaggattacaggcatgagccaccgtgcacctggccatatctagacatattattccttttcctggggtattaaaatgaagcgtggatttgtgatgatgtct

SEQ ID NO: 86896 - DNA, 5717 bp, Homo sapiens
ttatctttcttctgagtcctgtgtgacctgttctgtttattgcctgtgtctggacctgatgacctctcttccgtggaaggctgtctccttggaggtctcacacccactctcttgcctgttcttgctgcagatggctcaacggaagatccgagacatcctggcccaggttaagcagcagcatcagaagggacagagtaaccaggcccaggcacggaggaagtgaccagcccctccctgtcccttcgagtccaggacaacaacgggcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaacactgtctgcccctcggggtgtcagaaattctagcgcaaggcacttttaaacgtggattgtttaaagaagctctccaggccccaccaagagggtggatcacacctcagtgggaagaaaaataaaatttccttcaggttttaaaaacatgcagagaggtgttttaatcagccttaaaggatggttcatttcttgaccttaatgtttttccaatcttcttccccctacttgggtaattgattaaaatacctccatttacggcctctttctatatttacactaatttttttatctttattgctaccagaaaaaaatgcgaacgaatgcattgctttgcttacagtattgactcaagggaaaagaactgtcagtatctgtagattaattccaatcactccctaaccaataggtacaatacggaatgaagaagaggggaaaatggggagaaagatggttaaaatacataataatccacgtttaaaaggagcgcacttgtggctgatctatgccagatcaccatcttcaaattggcacaactgaaatttccccactctgttggggcttccccaccacattcatgtccctctcccgtgtaggtttcacattatgtccaggtgcacataggtggtattgaatgctcagcagggtaggggctgaccactgtccctgattcccatcgttctcaggcggattttatatttttttaaagtctattttaatgattggatatgagcactgggaaggggacgctaactccccttgataaagtctcggttccatggaggacttgagtggccccaaaggctgccacggtgccctcaccccagcccatgtgctcccataagggctggttcctagaggcaggggttgtggggcactcccagccacggcactgttaccttggtggtgggacttggaacccaaccctgagctcccgataaagctaaagtccatcatctggcaaattcagtaaattggagagtacttgcttctgtttgtatctgagaggaatttttaactgacggcttctgtctccatgaatcattatcagcatgatgaaaggtgtgtctaaaaaacaattcagaataccagcagcattgtacagcaaggggtaaataagcttaatttattaatttaccaggcttaattaagatcccatggagtgtttagcccttgtgggagacagaagccatcagttaaatgaggttaggcctctcctcctaatatactgattgacaatgcatattagccaggtaatgcactttagctaccctggacaatgctatcaagtgtgctgggaagggaggaaggcctctctacatatggaaaagcccatgcgtggagttcccctcctttcaacattgcaacaacagtaacaacaagacaaccgcaacatgtgggcgtagtcaggcaatgctgtgtgcgaagtaaactacctcaaggtatgaagttacctcagcaattattttcctttttgttccccccaaccccattaaaaaaatttttttttgatttttgtttttttgcagcttgctgatattttatataaaaaagaaaagcaaagcaaaagagaagctgatagtcttgaatattttatttttttaatgaaaagaaaaaacaagaaagttatgtttcataatttcttacaacatgagccagtaaccctttaggaactctctatggagaacaggcctggtgggaaaggctttgggggctgcccccttaggaggaggctagtgctaagagggaaggcccaggtttgagagagcccagaggggcagagcccagagccttgtttggccctgatctctgacttctagagccccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttttgttattgtttcatttcagttccgtcttgctattcttcctaatctatatccatagatctaaggggcaaacagatactagttaactgcccccacctctgtctccctgtcttctttagatcggtctgattgattttaaaagtggacccaaacttagggaattcttgatttagggtggctggtggcaaggaggggcaggggatatggggacgtgactgggacaggttcctgccttatcattttctccctaggacattcccttgtagcccccagaattgtctggcccaaattgaatagaagcagaaaaacatttagggataacatcaggccagtagaattaagcctctccacctgtcccaaccataaaaagggtctcccagctttccatctctggctctatatgctttatcccaaaacaaagcagataacgttcagacgtcggccatttagtaatttaaagcgaatttccagcagcaagcatgctttgatatctggttcagactatcatcaggaagaaaaaaaaatcccacagtacctgaaatgtgattgttgcagtgttcagtttccttgggggcctgctcccttcacaccttgagcccaagtccttttccgttggctgattcagctcccagaagagacgaggaagtgtgtggcaagggactggaaaacttcacttgcttggattaggcaaggctccactcattgttgatatttgcccagcaggaaaatcatgtaagttataccaccagaaagcaaaaggagcatggtttggtggttaaggtttagtgggatgaaggacctgtcttggtgggccgggccctcttgtgccccgtaggctaggtcttagggcaactccttgccctcctgctcagcacctccatttccccatccttggtgagataacaagctatcgcgaaaagcacttgggagatttggatgatttgagaagagtgacttaaaaaaaatgcttctgtgctctaagatatatatgtgtgtgtgtgtgctacatatatatttttaagaaaggaccatctctttaggatatatttttaaattctttgaaacacataaccaaaatggtttgattcactgactgactttgaagctgcatctgccagttacaccccaaatggctttaatcccctctcgggtctggttgccttttgcagtttgggttgtggactcagctcctgtgaggggtctggttaggagagagccatttttaaggacagggagttttatagcccttttctactttcctcccctcctcccagtccttatcaatcttttttcctttttcctgaccccctccttctggaggcagttgggagctatccttgtttatgcctcactattggcagaaaagaccccatttaaaacccagagaacactggagggggatgctctagttggttctgtgtccattttcctctgtgccaaagacagacagacagaggctgagagaggctgttcctgaatcaaagcaatagccagctttcgacacatacctggctgtctgaggaggaaggcctcctggaaactgggagctaagggcgaggcccttcccttcagaggctcctgggggattagggtgtggtgtttgccaagccaaggggtagggagccgagaaattggtctgtcggctcctggttgcactttggggaaggagaggaagtttggggctccaggtagctccctgttgtgggactgctctgtcccctgcccctactgcagagatagcactgccgagttcccttcaggcctggcagacgggcagtgaggaggggcctcagttagctctcaagggtgccttcccctcctcccaacccagacataccctctgccaaactgggaaccagcagtgctagtaactacctcacagagccccagagggcctgcttgagccttcttgctccacaggagaagctggtgcctctaggcaaccccttcctcccacctctcatcaggggtgggggttctcctttctttcccctgaagtgtttatggggagatcctagtggctttgccattcaaaccactcgactgtttgcctgtttcttgaaaaccagtagaagggaaacagcacagcctgtcacagtaattgcaggaagattgaagaaaaatcctcatcaatgccaggggacataaaagccatttcccttccaaatactcgacaatttagatgcagaacatttctctgtattcagacttagagtaacaccagctgaaaactgcagtttctttcctttggatacataaggcttctctatcggggtacgggacagggaggaggcctcatgtctgaagggggatttaggggcgagagccccagccctgaccctcggtcctgtgcaccgctttggggcacagtctgatggcgcctttgctggcgccttagtatggttgactccggatggacaaaagaaaaaaaattttttttcttgaatgaaatagcaggaagctcctcgggagcatgtgttttgattaaccgcaggtgatggatgctacgagtataaatggattaactacctcaatccttacagtaagattggaactaagggcagggactcatgcataagggtatgaatcccagccaggacaagtgagttgaggcttgtgccacaaaaggtttgtccttggggaacaggcaggcctgccaggatcccccccatatcgattgggctgggagggctggccatgaggtccccactttctgctttccttgcccatgtgtcacccctttggcctccagcttgtccctctctcactttctatagctttgttggaccagatggtgaggaaaggaatggcctcttcccttctagagggggctggctggagtgagacctggggcttggcctggaacccaccacacagccccaaagtcaggaagcctggggaaaccagagctgagacctcttcaacagggtttctttgagatcctacacctccattgggccctttttcagtcttcaatgggggcccagttggctctagaaggagaagaggtgaagcaggatcctttgccctgggggagtctgagggcgcggtccttggactcattcaggccgtctttgtagttgggggagttccactg

SEQ ID NO: 86897 - DNA, 1230 bp, Homo sapiens
ttttttcccccataaataagtttcactctttggcgattttcttcacttgtttaagataacgtgctagctattccaacaggtaacagctttcacagtctgcccctggcctgtctcaccccatcccccaccctattcctgccagtgagtccttcctgtgcttctctcccttctcccctcccagccagctgacttcagtcacccctgtcccccctcccctgccaataagctcccccaggaataaaggctttgttttggggatgcttaaatcttgactggcacttcccggctgtgggggctggggagccacttgtaacatttctgtgcagattttatgttagccactgctatgtaaaagcacgttcaaaatgaatttcagcagattatgtgttaccataatgaataaacgtcctctatcaccatttggagtctcccttttctccaggatcttgatcctggtccccaaaaccagagtgaatcaaaagagcttcctcccctgaggcaaagtggatttgtaagcagttctgaaacatcacttactcagaagagggaacgatgtattttgatgagtgcaaattgggaagagctggaggcctactgcttgggacagttttttttttttttttttttttaaatatgagtgctagcttattctgtaattgcggcaactttgaaaattgtattttactggaaatctgccagccatcaccacccgattttgattgtatccttcctcccatcctttaatctgttcattgctttgggggaggtggggcagctggctcacacgttggagtttgttctttgatggatgaacgaacactccagttttctttcccgtgaaggttgtttcagccacaaaccacttcattttgctgtttcaatttcaaaataaaaggaaacttatattgaaagacaagtatgtctgtgtctcagggtttttgggtctgggagctgagatgctcagcctcagcatgggagccctggttctcagggacctgagtcatccaaatgcaaagtaggcatttttcttaaatgtacagaggagtggtttttaaatggtgccctgctcttaattagctttgcatattgggaggggggcaggtcaggtgtttggaatgaggactccagcattaaagaagatgttgggacatcactgcagagaagtagctgtccaagaagtgacgagggtgtgtcactcttcctaacacctaccctaagaaaaaaacatgt

SEQ ID NO: 86898 - DNA, 1050 bp, Homo sapiens
gggaaagagtagcaaggagagagagaggtggggggaaagagagaggaagggtgggaagaagagagggagagagaaagagagagtggggagggagagagaaaggtgaggggagagaaggagggtgggaagaagagagggagagagaaggagagagtggggagtgagagagacagtggggggaagagggagggtgggaagaagagagggagagaaagagagagtggggagtgagagagaggtgggaggagagagagaggtgggggagagagggagggtgggaagaagagagaaagagagagtggagaggaagaaaggtaggggagagagggaaggtgggaagaagagagggagaaggagagagaaagagagagtggggagggagagagagtcaaggagaaagagggagagagggaaagaggagagagagaccaagaccctagctctggtagaatcatggagatgacagatttctctacatgtcaggaatctttgagatgtcagagacctcaagtcgcttataaggaccccaatcgatttccacatcggaaatgaggaaagatgggagcagtgtacagtggctcacgcctgtaatcccagcactttgggaagcctaggtgaaaggatctcttgagcccaggagttcgagaccaacctggccaacacagtgagaccccatctctacaaaaaaatttaaaaaattagcctggcattatggtgcatgcctgtagtcccagctactagggaggcagaggtgagagaatcacttgagcctttaaggttgaggctgccatgatcactgtgattgcaccactgcactccagcctaggtgacagagcaagactccatctcaaaaaaaatgaaaaataaaaaaatagaaatgagaggctgggtgtgatggctcacatctgtaaactttgggaggccaagataggcggatcacctaaggacaagagtttgagaccaacctgcccaacacggtgaaccctgcctctactaaaaatacaaaaaatagccgggtgtggtggtgcatgctggtaatcccacctactc

SEQ ID NO: 86899 - DNA, 1021 bp, Homo sapiens
aaaaggatcaggattgggttctgaaccaatttgaagaaaaatcaacacagatggaaacagcttacaaagtacagtcagtgaaaagcaataattataaaatatggtacttgggatgaggcatctttccctacctctacccccttcattcagtcattcatttattccacaaatgtttattagatgcctaatacgtgctggacattgatctggccactggggattcagcaatgagaaagacaggctctactctcacagaccctgctttctagtggagaaaccctgacaataaacaaatgatgatcttatataatgtcaggtggtgtgggcccttatactgtgaagcttgccctcagagctgtgactgtagtcagctggaagatcaactagcttctgtcataataagccttcccagcccataagccacctgattttgttccttctaaggattccagtgagggagttgggtgtataggaaggaaatcttattgtccaagtttccctttgaaacctcttagaatggaataaaactgcccaaatcatagaattgctattctttatcatcttgtatctctaactagatgtagatgttaacacagtttcttcatagatacagggtaggtaatcactcccacctgagtatatactaaataagtgctttcaaactttcaccatgaccccatagcaagaaatatttttaccactactttgctactcaatacatatatatatgagtttatttatataagtgaataaaaggttcaagaaaaatatatgtgctgcactttgatattttctatttttcttttttcttttttttttttttttttttttgagatggagtcttgctctgttgcccaagctggagggcagtggtgtgatctcagctcactgcaacctctgcctcctgggttcaagcgattctcctgcctcagcctcccgagtagctgggactataggcgcacgccatcatgcccagctaatttttgtatttttagtagagacggggtttcaccatgttggc

SEQ ID NO: 86900 - DNA, 3872 bp, Homo sapiens
agcaagtaaagtttgggttttaattttcctttgcctgaaccaagataggaaattacttaagagttttttttttttttttttttttttttttttaggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatagttctatacttttatactttctagacttttttatagactttatgatcagatctttttgtctcagaggataggttttgcaagattcaaaggaaaatcaaactccttggttgttccagctttgaagcttttgcttcagtaaatttgtttaaagaaccagatcacataccatttatcaaattctttacttaagtcagaatactttgcagacatacatatttggaaaacaaactgtttcttgttcactagatagaatctgtattgtagtaagaaactacttacaaggtggctttctttctgctttgttactctatgtattactcaataatatatgtatggtcacaggttcctggagttgttttatttctttatgacagacacatgagtatgcacctctctctaatcctctgatgtcactgcagcttcagtctctctcactctgtttttgagtgccttcaaaatgccagcatcctggaacattcttttcctgatctaaatcctacctctgactatttcattatccatgaatattggaattcacccatattccaatgggcttaactctacaaactagctaaaaccttggacaagaattttgaccgtatttctgttttgttcctccatgtcatttttaggttatatttttaacttttatttatatcttatttcttcacatatttcgtctctctgttgaaagattttatccttatttgactcttcactttttttactttcaccagaaatttgacgttcctttaaaattaaaggtcattgaatgtcttttgaacacctttttctcaactgaagtcttcctgaatgcctcccctttctgatgaaaggatcctgagtgctgctgttgctctgccctgttcccatgtgcccactcccttccgtacacattttgcaagactatactctttattttagtcaaattaatttaaaattgctccctgggtttctgctctctcatggccctgtccctcaaaaacttctgtttactttttctagctgttttcatctaatttgtttaaaatgtatgatggatccataatatatgaaggatgtaatgaaaaggaggttgcagtgttttatataatatgatcgagcacctccgtgatgaaacatttagcaattggctagtccttcacagccagagtggaagtttgtgctgtggacaggtctttttactcccttccagttctcctccaaaactggagaaaaaggaaaaaaaaaaagaactctttcaaatgaggagatttgattgcatttttttaggtgaatgaaagcttggagttgagcatttgggccttagtcagcatttttcctttctgacttaaaatctcatgtccttttccttaaagttaatagtactcaggtttttaagactaataaccacacaaggtgggtatctaagaaggcagctgttaatacattctccatctttcctgtctggcaacaggaaagatattattggtgagatagtgcaaaattgtgagaattggttatgtttgatgatgaataaattcaagatttttgaaggcttcactgctatttgggatgggaaggtgagtttacaaaatgaaaaaggtagatttttatgttacagaaatcagtaacgggtttcttgttgtgttaattacctttcacttgatttgccatgatgtttcttcctcattattgatctagaagtttgcctcttggatagtaactagtaacttagtatctactttaaaatttgtggcttttctcttcagggtcccaggccataaaacaacggagagctgtacttgcttgtcacttggaggaaccacatccttgagacagcctgctgtcttgtatgtcttcagtaggaaacttctgacacacacattcaagggagttcctgcccctgagaagtgttcccatagctttccagtcgcaggttactttcacactacgtcagcttctctggtgagatcagggatgttacatattacttgaaaatgatttcataggaagtgaggatggggcaagaaaggaggtagaagctgaattttgcttaacttcagaaggaaatctgatacttgccttggctagttctgatcaactaaagagcctgtgtctgtactggatgtgccaaagagtcaagttgtttctggaatatccagctcctctgaatgaacacagcttcctccctacctgtcttttatgggtgaaaagggaccgtctgatgagcatgatagacatcctgtacaggactcaagactgtttcattgcatttgaaagttggtgggaagtattttattctgctagagctcctaaccctcctagaaatatcttttcatgctctattaattcaattcattagtttaaaaagaaacagtgtgacataattttggtgtttacttcttaagttgtctccccaagggcatatatgtagcctctgaaaatgggatgatttcttctcaatcttccataaatttgaatatgcattttattcatttcttgacatgggctgtgtgactgttttccatcagcagttctggctttgtccacaagggagcaataaagtacgttagctttattctcaaccttctaaagaaagatcccacttttaaatctcttctggaatagcctcttagctcaaagcttattcatgtattttgattatttaagaaattttcccttattacaaagtccagtcgtcgttcatccctcatgatgccaagcaatgattgatgtgtgggtgtggagtccttgtgggtcaggcatcttaattaattagactttttacatattgatgatccccagattgaaagccaggaccttcccataggggcgcctttgtgtgctaaaggcagagcaggcaggcttctccactcctatctcctccgcaggccaccaccatcacatctataggaggaacaagagcactgggggaactctggagtatgagtaaggaaatgcttctcaccttctctgctccaaagagatatctgttacatcagggaacaagtcctctaggtcaggcacttcctcctgaccagtgcaacgggcactccaggttagaaactgtgtgtgctccctctctgtcagttacttgtctaagggctcctatccgtggtcatcagctctctggccatgagttctgtttgtgcttattgcagcagcatcttcacaacaaacaggtcagtaatcaacctgggaagggaaaagacgacagtaaatattaccccctgtagagccgggaggcatttacacctggaatggccttcttaactgatttctgcctggccacctcacccccagccaagtctgaacctgagcaataccaggcacagagaggtgtctacttgtaactccaacacttgacaaaaaacaaaactgaagctgtgattggtttaggcagcaagtggccaggtgcaacttgtttgtttttatttttgttttccccaacagtactgagatcacttgcacttttcctcatttcttaagaaaatccagtttgcttgccatgacttgtttagcgttaggtttacaaagcttgttgttgaatgttgaatatttgtccaaaggagtttgacaaaatagaag

SEQ ID NO: 86901 - DNA, 3545 bp, Homo sapiens
aggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatatcattatttcatggtcaagcctgtagtattaaaatgatttttttaaaagatgtaaactgtgcttagttaattggttatattttgttctgttttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctttctcaaattgagtcagataggctcattcggagttagatttttaaatttgaatgaagaaaagacaacaatttaaaggcatgtggcttcatttccacatatatttgtgactggattcttatttttagcaagaggggagatcgccacaaaaaaaactttagttcaaagaagactgtgcaaatcagttacctgtactttcatagtctaccatttacattaactgttctagattaatgactaagcatggccattaccataattacatcatttttttaaaaccacatttgttcgaagtatccttttctagtggttagaactgtccctataatttgattgtccctcatatactaaccgaaagcaaaatgctctgatgagatgcttataaactatgaattttttaattcttgaaatttttttcagtttttatgattgttgaatagatatgtatgtttagttccattattatttcactggaagttttaaattttgagaagatgaagcagagatagaaatccattgcagatatatgtatatttaccccatcttgcaggtttcagttagtaaaacacagaatgataggtcggttttaatgttttaaaaaaaaactaaaaaactaaagttagagaaacctttctgtttgagctactgtatagaaaagacaacttttattgcattgctggtccacatgataaatatttcaatgctgttctagactgtatgagaagtacttaatgaaaaaagggatacattacatttaagaattgtatcagctaattactgttttaaaaaaatcaactcatttggaattc

SEQ ID NO: 86902 - DNA, 1372 bp, Homo sapiens
cccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgc

SEQ ID NO: 86903 - DNA, 1038 bp, Homo sapiens
aaatgagggccaggtgtggtggctcacacctgtaatcccagcactttgggaggctgaggtgggcgaatcatgaggtcaggagattgagaccatcctggctaatacagtgaaaccctgcctctactaaaaatacaaaaaaaaaaaaaaaaaattagccaggcatggtggcgggcgcctgtagtcccagctactcgggaggctgaggcaggagaatggcatgaacctgagaggtggagcttgcagtgagctgagatcacaccactgcactccggcctgggtgactgagcgagactgtgtctcaggaaaaaacaaaaaaaaagaagactgcaaatgagagatgattagagaggtccaggaaggggatttgagcacataaaaaacctaaacatccatacattcagtaactgctcagggaatccattctgtctgtgagtagtgtctagtgtgcctaagaagtgattagtaaataatgtggagaggatttgctcatactagactaaaattcaaagattagggcctttggctgtgtttccatatggctgctaggtgtgaagaatactaactctgaagtcacagagcaggggagcttagaggttaatcaaacatgtgcttttaaagtattttattgtacaagtaaatcatatttaatttagaaaacaaactacatggccaggcgcagtggctcacacctgtaatctcagcactttgggaggctaaggtggatggatcagttgaagtcaggagtgtgagaccagcctgaccaatgtggtaaaacctgtctctactaaaaatacaaaaactagccaggtatggtggtgcatgcctgtagtcccagctacttgggaggctgaggcaggagaattgctcaaacccagaaggcggaggttgcagtgagccgagatcacaccactgcactccagcctgggtgacagaatgagaccctgtctcaaaaaaaaaaagataagcgtaaagaataaaacatcacccatgatcttattacctagagataatcactggtaacatttgttgtattttttt

SEQ ID NO: 86904 - DNA, 1320 bp, Homo sapiens
aggatcacttgagttcaagaccaacctaggcaatatagcgagacaccatctctattaaaaaccaaaaaaaattgaaaaaacccagagggaaaatactcatttgtccagccctttataattgtaaataaaatccttgctgatttgataggtgagaaatgatttcttatattaatttgcatttaattactaagtaagagtgaacatgtttatttgcttgtagttatcaacgtattttcttttctgaattgcttgtgccttttctgtgttcatctttccattacagtgtttgacttttttaatttcattaatgttgaaatactttcccctggtttgtctatctgccttttaatattattcagagtgtccaaactggaaaagcagctagatggtgaagttggacaaacctggctctgccagtcactagcagaattgtgtaacctctctagacctctgttttcttgatattaaataagaatgacagtaatacctaaagggtgcaggagaaatgctggttttagagaaggattagctttagagaaggaaggggatgcggataggtctctaaggctgaatgaaactacatttagagacagcagtgtgttttggtggggattaaggacattgtatgaactgacagtattggactgtttctttgcagttaaagagaaatgaggcagaccttatctaggaagggtgaccagccatcagtcagggtttactaggatgatgtggacatagggtgagttcaaaatagaatacctactgattcttcttataccaggcacagtgctatgtgcctagagacacaaggatgaattaagacctggtttctgctcttcaggagcttatagtctggtgaatggtaatgatggtgttgatgatgatgataatagcaggtaaaatgcattgagtactatgtgccagatactgttgtaagcactttaccagatactgttgtaagcactttaccagatactgttgtaagcactttaccagatactgttgtaagcactttacttgcgttttgtatcataataatctattaaggagattattatctttattttatttatttatttattttgaaacagagtctcgctgtgtcacccaggctggagtgcagtggtgtgatctcagctcactgcaacctccgcctcccaggttcaagcgattctccatctcaaaaaataataagataaaataaaatagaatttatggtaatggcaacgaatgagattaaagtgatagacaaagtagaacttggtgaattgactggatatcagtactatcaaaatagtattcaatcaccaagtttgaatg

SEQ ID NO: 86905 - DNA, 1686 bp, Homo sapiens
attgtttgaacccaagagatcgaggctgcagtgagctgtgattgtgtcactccagcctgggcaacagagcaagacctggtctcaaaaaacaaaacaaaccaaaaaaagagtaacacatacttattaaaatatatgggaaactatgaaaattgcaaacaaagtaaaatcataccaccaagagatcaccactcttaacattttggcatatacacattaaaaaaaattcttcagtttcttaacacacatatagaccaatactttgcataagtgtttatgtgttcatgtatatagtaaaaacaaatgttgggtctttatactctgttgtaacctgcttttaattttactgtattatgtcatcagcaatataactttaatggctatatatttcttataaatttgctataatattagctataatttattacatacatatatgtcaggcattatcttaagtgctttttctcaattaatgtaacctttgcaacaatcctataaagtgaaggatttttgttgttgtcgtttgtttgttttgagatggagtctcgctctgttgcccaggctggagtgcagtggtgcgatctcagctcactgcgacctctgcctcccatgttcaagcgattctcctgcttcaacctcctgagtagctgggattacaggctcatgctgccacgcccagcctattttttttttttttttgtatttttagtagagatgggggtttcactgtgttggccaggctggtcttgaactcctgacctcatgatctgcccgccttgacctcccaaagtgctgggattacaagcttgagccactgtgcctggccttttttttttttttttttttttttcttttgagacagagtctcactctgttgcccaggccagagtgcaatggcccgatctcggttcactgcaacctccacctcccaggttcaagtgattctcctgcctcagcctctcaagtagctgggattacaggcatgtgccaccacgcctagctaaatttttatttttagtagaaacggggtttcaccgtgttggccaggctctaaaactcctgacctcaggtgatccacccgcctcagcctcccaaactgctgggattacagacatgagccccacccctgagcccggccagtgaaggatgttttctccatttatttagccagttccctgctagacatttatgttatttctgtttccagtttttctactgttatagatagccacaggccaggcacagtggctcacacctgtaatctcagcacttcgggaggccaaggtgggtggatcacttgaggtcaggagttcgagaccagcctggccaacacagcagaacctgtctctactaaaaatacaaaaaattagccaagtgtggtggcgcatgcctgtaatcccagctactcaagaggctgaggcaggagaatcgcttgagcccacgacagggaggttgcagtgagctgagatcgcgccactgcattccagcctgggggacagagcaaaactccgtctcaaaaaaatagctacaatatcgtttatcacagtgttatcacagccataattatttacttaggataaatttttggaagtaggattattatagcaaagagatatatacatttttaagacttagtgtcatgtattatgaaatgccctccacatatactcccaccagctgtatgaaaat

SEQ ID NO: 86906 - DNA, 1429 bp, Homo sapiens
aggtggatcacaaggtcaatagttcaagaccagcctggccaagatggcaaaaccccgtctctactaaaaatacaaaaattagccaggtgtggtggcgggcgcctgtaatcccagctactcgggaggcttaggcaggggaatcacttgaacccaggcagcagaggttgcagtgagccaagattgcgtactgcactccagcctgggtgacagagtgagactccatctcaaaataataataattattattatttaagccctgtttcttgtgatttaaatgcatgctctaaaaaggaaatagtggtattacctgatttttttcctctttgcttttctttgtagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtg

SEQ ID NO: 86907 - DNA, 1051 bp, Homo sapiens
tattttattatttttttcagacagggtcttcttgctctgttgcccaggccagagtgcagtggtgcagttataactcactgtagcctcaaccttctgggttcatatgatcctcctgccttagcctcccaaagtgctaagactataggcatgagttttgttaattcatttctgaccatagatatgctggagaaactgaaagaaaagggggtagggagaagaaggaaagaggtagagaaaaatttaatttacaaactttgtctaagtaaatatatactacaggctgggtgcagcagctcacacctgtaatctcagcacttgggagtccaaggcaggaggatcatttgaggccaggagtttgagaccagcctgagcaacatagcaagacctctgtcttcaaaaaaagttaaatatatatcacaaggaaaggtaaaatctgctctgtgatgagagtttttagcctggggttttgggacccctagagaatccttggatggatttctgggaataggtggatcccttgaaattgtttgtaaaattgtgtgtgttccttttgggagagagaggatttgtatatttcaaaagaatcggagagggaacatacaggcttatgggaaggaaaaggcagaggtgtgttagcaatttgtctttttctgttggctatgttttgcatacattatgtttgggttaaaacttcctacctggtttcaaatatttttgttttagactatttattcatacctcttggtttaagactagttcagttaagatgttttcaaaatgttatatttatttatttattttgaggcaatgtccccaggctggagtgcagtggtgcgatctcagctcactgcaacctcagtctgctgtgttcaagcaactctcctgcctcagcctcccaagtagctgggattataggtgaccaccaccagctaaatttttgtattatcagtagagacagggttttgccacgctggccaagctggtcttgaactcctgacttcaggtgttggcctcccaaaatgctgggattacaggtgtgagccaccatgcc

SEQ ID NO: 86908 - DNA, 1034 bp, Homo sapiens
ttcatgtcttgctctgagaaaatttaagtatttagtgattcttgaaggagaaaaagctactgatcttgaggcagaataccattgtagataaggtagtacttgggtatctttcactctacacttaccaatgcaaagaatccctgctatggcaaaccatggcatccaaactcactgcattacatttgttttgttgtttttttttcttttttgagatggaattttgcactgtttccctggttggagtgcaatggtgtgatctcgactcactgcaacctctgcctcctggattcaagcaattctgctgtctcagcctcccgaatagctggcctggcaaatttttgtatttttagtagagacaaagtttcaccatattggccagggtggtcttgaactcctgacctcaggtgttcaatccttcccaaagtactgggattacaggcgtgagccactgcacctggccactgcattaaattgagtaattccttgaaacagtttagtttatggcagaggaggacggaattggcaatatgaagtagatatggatttttaaaaaatcactttttctcccagcttaaatggaactcttaagtgttccttccattagcaaatcacttttttaattctttttttgttttgttttctttttcattcagtttcattcagaagcataccacttattagaaaaaaagaaaaaatcctcaagcattctaggaaacaaaaatgcatagggataacttggcagttccataagaaaaaacacactaggatgagtgcagtgtgcatatctgtaatcccagaactttgggaggccatggcaggaggattgctacactcactacacttccctacctgtcccctctcattttaaagcaactccagacatcatattatttataaaaacttcctgagcatcattaagtattcagtcagtatgtgtatgtcccaattgactcataattgttttttcagtttgtttgaattagcgtcccaagaagtgattgggtaggtttgttttctttctctcccctccccct

SEQ ID NO: 86909 - DNA, 3251 bp, Homo sapiens
agtacattgtctggccctgagcaataaacaacaaagtagcttatgcatgtaaccttgtgttttgttctttgattaggataagttaggtatttgtaaattatcatttcctcgttttcctgtaaaaaggaaatgtatgtgagagtctttcagaaaaagttaaaactagagtcaaaataatttgtttagacttgaccaattggtaatgtatgttcctggcaccagattctaaatgtagcaaatttcaacagcaaagtccaaggtctgttttataatgcctatcctgaatctttatgcgttggctgaagttgatctgatctcttaaaagaaggctatatcattctcatagcggtgtacctgctccataaaaaggatttttttttcaactttgttaactgtgatttcatgtcttaatggggatggtgccatcaaaatcattcattttgaaattttgttttaatggaaggattttaattgtggttagggaattcagcctccatatatagaatctggaactgaggatgaactttgcaccattctatcaataagcaggtgataaatatcagctatttttgtttaaattactctgcacccagcttttgcctttcggtcgtattgcaatcaggagatatttattccagcttgtgatagtgttggaatgggtagtaattttaagcacagtaccggctctttaggagcttacgattctgccattatttttcacttaaaaaattctttgagaccttcctattctttgcatctggggggttctgagaagctaaggaatttatgatattaactggcactttggaaggcaagggagccttggaatcttgcctatagaacctgttccatacacctgaagaatagcatttattctactaattatgcagcataccctataagtttgaaagcatgctgaagttgcaaatattgccttttttattatctcataaacatgctgccagtgctttatattacacattatattttttgctcatgtcatgcctgaagttttactgtcggaaatcatttggctattctaaacccaaaccatttcaaagttgcaagtaggttacttttctttgtatatactttgtagtatactgacagaccattaaaatctcagaggacagtgtgcttccttgatttagtattgcagaacctcttctaaaccagtcacttacctagttaaacacccacacatcatagagcagctgatcatataacatatacggttgtgagaacagcattctctccctgccagattcagaacttggaagctggaaaacaattgcatagcagtgaaacacttaaggagtagtggtgccagcagttcactctcattaatacaaacagcttgctttagtttctccaacactcttcttcagacacccttcccttaggaggtttcagatcagcagctcctactcaagggaaacagcacctactttctgcagctgtggtctcaagatctgattcgtgacacccagaactgttgccatttctgttctaagtatgggaagtaatctcgtagtgtggtaagaaaatacttttcaagtctgtagaaaaaaaaagttgattagtaatgctactgatgtgattttgtttttgaatgtctgaagcctaacgaagaggtaaactagaatgtgaacttttgaagtcacccttttctcaggggttttagataattttaccaaaaaaatgtgactatactcttgaatttcatttcccttgttataaaaaagtcagctgagagacaacaacaaaaaaaagtggattgtcttgtattttgaaccatagcctttaaaacttgttattctaaagggcataactacacctccttgttgtgaagtcttaggtcttgtgctaccattttaggtgtgatatttttctcaggtgttgtcatcatttctgacaatcagcacttgaatttacttcgatagaggtgaactggtgctgcgtttagtgactttagctgaagaaggctcatggagatagatgatgctttggaggtaggcataactcgatttaaaacccccgctccactgtttactggtcttatgatattgaacaagtcactttgagctctctggcctcagtttcctcagcagcagaatggaatttgttatgaggattagagataatgtatgtaaactcctagcagttcctggcatatgatcatattagagactcaatacatgttaggatatggagcatgttggagtaaaactacagatcattttgtcttatgacaagatttagaagtctggcactgcgatctgcattttttcatttgtgcagatttgggatgaaaaaattgcaaatatttgacttggagcatacctaagtcttgcaggtgcaatgtgcttattggaactttgatttgttgctctatggctggcggaacttggtggggacagtaaaatctagctccaaattctacagtgctacccataggctgtgcttgttttaagcctattcagagcttatgtagtgaaaggggtattttaggacattaacgtatctcaatgggttctgtgtccagagttgaatcacgtgcaaagccttgtataaattttcatggttaatgcaagccataaagtgctttgtagaatcagtggcaatatcagttgcttattttagttatctgtttgtttatatagtagttatatttgatttttaaaaatacttatgaacattttatctaatacaatttcaattgtcttctgagatttttattataaactgctattggggctatagatttgagtgctttatgaatttttactttggcaagggaaggaaagaaaagtagagtgtctttacctgtcagattttatgaactctgctttaggcctgtagattatatatgtagttccttctcttgttttttagccagaaaggcagctttatggtaaagatgacattatcttttttttttttttgagacagagtctcgctctgttgcccaggctggagtgcagtggcatgatctcagctcactgcaacctccttctcctgggttcaagcaattctcctgcctcagcctcccaagtagctgggattacaggcatgcaccattatgcccagctaatttttttgtatttttagtaaagatggggtttcaccatattggtcaggctggtcttgaactcctgatcttgtgatctgcccacgtcagcctcccaaagtgctgggattacaggcgtgagccactgtgcccagcctctttttttttttttttttaaaac

SEQ ID NO: 86910 - DNA, 1034 bp, Homo sapiens
gcggcggcgcccccggcagcccttcctctccgccgcccgcggggccggcccgggctccgggggccggcgtaacccttcgccgaggcagctgcgtgcgctaggccggagcagcccccatccggctgggaggccccgggcgctgagctcctcaggcacccagcttgggctgggggcgccccgctcctgctctttcgcccccttcctcctggacccgggcttggctgcagttttgcagcgggtccgctcgccctgaggcctgaggggaggctggggcggcacgggttagcgggccgagaggaggtttgcaccggtcctcctgcgagcgttctcctgccctgcagctggtggcttgcacccactacctcccccgccttgcggttgcacccaaacctccaacccccgggagtattgtgccgccagtagataaaatgcgtctgatgtacacccgccaccggcagccccacactcaccccagtgggtaatgcagacctttctccacccccacctcctcctcccctccaatcaggctctgctgaagattcttagatccgagacaccaaaggtagtgacacccccgttacatctccacgtaacatgttcattgtcgagggatgtctccaatagaaatgataaatgcccctgcctcacctcgaagtctgtcttcaggattcgagaccttctctgaaaaggtccagctttgatcacaactagagcatccctcccccacaacacagacacactcatacactcactcacttcctgattgccgagcagcccctgtcaccgcggatccattgtcagaaatggcttttgccaatcaaaggaatgtgcttgtgcctttggagaagggtgctttccacatccacgttttcggggtgttcctgcgtgagtctgcctttgcccccagattgttcccgtgttcaagcatcattatcatagtgtatcccttacatgcatctcccgtggaccctcaggaacacctgagtgatgcttttttcccagttgattagatatggtgtgtgcaagtttctcct

SEQ ID NO: 86911 - DNA, 1636 bp, Homo sapiens
ctcctccctttgaaaccaggctcgctttgatgctggagaactaatcacccagagagagctggtctccaggcaggtgagcgacgaccttacagagcgagccgccacctttgggctcatcctggatgacgtgtccttggtaagatccttcgggagaccgaggaggggaaggggctgcagttctcgtttaggtgcctggctccatttctgggtagacgctattaggtcctcccttctgctttgctagatgtgagacttgaaaacacggaaacatgctgaggtgaggcagtctccgtgggtttttcagttgagggttcttttaccttccccctgccacacacatttttcttatgacctctggttgtatccagatagtctctaaccactaaatgttttaccttctccaaactgttacccagagagtgatgccttgttaaccctgtttgacacaggcagaaactgcctggtagagaccagagaacagctcgggtagtccttctccctagcacagacctcccagcctgactcctgggagcttcctaacactttacagtccgaagctcagtgaagtaagctctgggaaccccagtgaaaggtgatagagtgtaaacgaacggttggattcccccaggcctggtatagggggcaagggacatctctgaggcgtaagctatcctcttgagacactatagcttgtgtgtttatatgacattggatgtcataactcagaaagcaatgcaggcaggatagcgtttcaggttgaggagggtgaggggaaggggtcgtgtttctagattctctgggaaaaaccatttggagtgatttgttcgggcagtgaggtaaagtgtttcctgttcagttctcccgtgcattgctagggaaaggcactgcctcccccggcatctgtgcagctgtttaaacagccacttgacaacacccagtgctaacccctgggcactgctccaccttgctccgcctgctggaagtcctgggggcttggggctccctctgctggcaagaggccaggctgcagccattctgtgggcccttccctcgtaattaccgttaacctgaacaccttggctgtgagaaaacgctgagtaaaaacctaagggaaaagttggcattttactagactttaaccacatactccattctggggaaatgtgggctgaccacaagaaaccctatctaaggtgtgagaagaaaattaggtttcatggggaatttgctgccctcagctggcccttgtagaaataaattttattccttaattatacatttcatttttcatgtctcaggatcagattttcttacccaaactttgactaagaaactagaaatggatcaggcgaagtacaacagctgcagttagagttaggaggttaaaaattctggaagagaatgagaccaggatttactcttcaggagaagtttggagctgcttttttaaaaagcagaggttgggagagtggaggaaatgaaacaactagaatttgatggcaaaaccaatgctcttctcttgattctttttcaataaaaattaggatgaataagtaaattgctctaggctgggcattaggaattctgaggtcccttcccattgtttgtgctatctttagggacagtcccgtcagac

SEQ ID NO: 86912 - DNA, 1038 bp, Homo sapiens
cctggggcaacgtagcaagaccccatctctgcaaaaaatgaacaaaattagccgggcatggtggcacacttctgtggtcccagctacttgggaggttgaggtgagaagatcgcttgagcctgggaggtcgaggcttcagtgagctgagattgcaccactgcactccagcctgggtgacagagcaagaccctgtctccaaaaaaaaaaaaaggaaagaaaagaaactgaaaaaaaaaaaaagcagaagaattgatagtacactttccaagctataaagcattatttattaggtatccttcaatggatgatttagcactttcaggaatggggaaataaatagccaggttgaaaagtgactgttgtgtgtcagagagggccttctctgaggatttggcatcaagtttgattgtattttgtttttatccccttaggtgtgagagggtccagcagaaggaaacatggctgccaaagtgtttgagtccattggcaagtttggcctggccttagctgttgcaggaggcgtggtgaactctgccttatataatggtgaggcatggagggacagtgggtcactgcactttcctaggagttttctgttggtctgcatagcccatgtgacactcttgatggtagctgccgtcagtgaatgtgtttgtggccaagagggctcacctcctgccatttcataccacaggactgcattgttatcagagcccctgacctttcagtcataggttctctcagagcctgtattcaaaaagagcttcccagcccacttcctagttggatgtgtccagtggcttctgtcaaggtgaagtgaagccgcaccacccaaatgctgccgcacagtgtctggatttccctggctatctgaaatggagatctcatttgttctcctctgcttgcatgtggaataacagcaaaggctgcagatctgtttgggtgaccttgtcctgaacaggaacttttgctgtgctgaattcgggtagtttcagagaaagtatctttgagatgcattgcccagcttttaacagtgta

SEQ ID NO: 86913 - DNA, 1102 bp, Homo sapiens
gatccttcaccaatgttacatgaggaaaaaaacaaaagcaaaacaaatgaaaaactgaaatcagaatcactaatattatcaagtagggaaacaaataaattaaaatctagcagccatcagcaagagtacagcaaagacaatgctgtaaaaagaaacaaagaaaattgctagaaaactgtatgcatcataatctttcaaaccagcaaaatatgcttctgcataaaatggaacaacagaattttttttcctgtaaagtatagaaatgccaagttgttttctgactattgtggataggtaaaatctgtatgtaattaatggtaattctactgaactattacagagtgggccaggaacacatttatggattctggagatgtgtactgtaattctttgattgggatagtgtaaactctagccaaaaaaaaaaaaaaaaaaaaaaaaaaaagaacacagaagtacaagacaaaggcgaatgagacttctcttatatctgagtaacatttagatggaaatcaaatttaaatgcagtccactctgctttttgaagaggctttggttcagctcccaaatctcgattgcttgacgcagtctcctatgagaatactcagaaggtgtcttcttaaacaacaaacctatttttagtggtggagccgctcttagtagctgtgtctgcgtgggactgataaccaatcactatctttggaggaagtcctaacctttccttgtataccctccctatatgtgtaacagcttctctgttttcacattcagtagtccatattgctatcttatcacctttagctctaacattaacaacagcgccacatacatcatcactgtagtcatcaaaagattctccaataaggcacagaagtgtctctagccaaaagcgatcgaggtcacttcgtctctgctgtttgttcaatgtaattagccatcgtcctccccgtttgtttttctcatcttcccacataggctcaataccatccttaaaaagtgagtagtcacagccaggcattaaattactagacaactggatatggttgtacagagcccaaaagtcttcaacagtatcaaacttggagatcagccacaagtttgc

SEQ ID NO: 86914 - DNA, 1102 bp, Homo sapiens
ttaaagacagagaattctacaaacagcaagagcaggccaggcatggtaagtcatacctataatcccagcactgtgggaggccaaggaagggggatcccttgagctcaagagtttaagaccgagatcgatctaagatggcgaccgtcgaaccggaaaccacccctactcctaatcccccgactacagaaaaggagaaaacggaatctaatcaggaggttgctaacccagaacactatattaaacatcccctacagaacagatgggcactctggttttttaaaaatgataaaagcaaaacttggcaagcaaacttgtggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatctaaatgttactcagatataagagaagtctcattcgcctttgtcttgtacttctgtgttcttttttttttttttttttttttttttttggctagagtttacactatcccaatcaaagaattacagtacacatctccagaatccataaatgtgttcctggcccactctgtaatagttcagtagaattaccattaattacat

SEQ ID NO: 86915 - DNA, 1092 bp, Homo sapiens
ctctcttttcccccgacattgcaccctcgctttaaaagataaacttgttcagatttcccattccaactggccaagcgaactacctcctgtctcttccccacctcctcaccccttctcccttctctcccagcctccccttccctagcctctctctgcattctgaggctggggctggggcaatcgagaggcttcaatagcatgaattcagcccccagcccgggctatatttagcctggtagctcagacactggacaaagccacttccaagaggctggtggggacagagttgagaggaggctgcccttcctgcccctttcccttcctgatatggataccccttggttgccctcctggggttaccaggaatgctgttcacagggcatgggctaggactttgtgtgcactgcatgctatttctagatcatccgctgggaagggagttctgagccccctgccccagcctgaacgagcacattctgcagtgttctcctttcacttcctgcccatgcatcagagtcacttgggagctttcaaagctatggatgcccaggccccacccctaaagattctgatttaattggtctggggtgaggccctggcatctttctttttctttttaaaacctcccctaggctacttgaatgcactgccaggatggcagaccatggttctagatccttaccactcaaagtgtggttcctggatcagcggcatcggcatggtggggaaggcagggcttggcttgttggaaatgcacattcctaggccccatcccagcctgctgaatcagaatcttccttttaacaaggtccccaggggattccagtgcaggctgaagtttgagaatcactgctgtagagcctcacactgtcacgggcaagactccagatctgtgtctccaagggttttggtcaggctggagcagtgaagggccctggtgctcaccctgcctgtctccgctttcttcttaggacaagattgtggtttcttgggatttatatcctgtgggggatggctgggtccatttctcccaggcccagatggagccaatctaaattctcaagtttcggttagctgagagtgtcttacgtg

SEQ ID NO: 86916 - DNA, 1017 bp, Homo sapiens
tggcgtctccaatggggagcccattagtcctgcttagggcagcacctaagtactgtggctgataaatataacatgagcccatcgattagaatcctcctagtcctacagcagctcggctccctaatggctcccctcccctcagcacactgactacccacctctcaccccccaccccaggctgattttctggtttacttgaggctgtggggcaaacatgagaggagcagaagtgaggtgatgggtgcaacacccagagcccagtcaaaggggccactgcttggagacaggctggactggtctgggccctgaggcagcctggaagcccctcggtcagttaggggcagctaggggaggagccgcctgtgagttcccggggccccggccctgcggtaggacatggagcaaggaaggcagagggcccctactttctgtgaggcgcaagacacagcacctgcccttgggggcccttgggggctctcctggtaactcctcagagaaacctgcagtgatgccagctctggccctgtcaccacgccctcttctccctggcatctcctgcccaagcccccgctgcacctgtcccagcccagccaaccctctctgtcttcatttcacccgtctccagggcgtccacatttcctcatcagatcagggttctgagggcaggggctgtgtctcctgcatcagcttagggcccctaaggggtagggactgcttccccagggtgggggctctggaagtcatgaggcttttccccccaaaccaccaaatttggactgagaactgcatagggtagggtctgccgcaccccccgcccccaccataaggtaatcaaaccaattaggccttcagacttgttaaccatcagtgctgggtggaagctgagacagcagagtgagacagctctgctacacctccccccagcctgaaacccctcgaggctctggcctgctgctcgaagacgtctggaagggccttggcaagaggtgcaggaagagctcctgcctgggcaccaga

SEQ ID NO: 86917 - DNA, 1285 bp, Homo sapiens
ctgtgcttgggccagcaattggtcactatttgaaaacagagtttgccccatagcaagcagccccacagagactggatgtggagggtgtggaggagggtgccagttagagcagtgaatcccgccacagtcccactgctgctgtactctcgcaggggtctggtctttgggttttgggagcctagcgcttgctacctctttacttttgagatggtcctccccaggcacaccccagagaagagaagtgggaggcttcagtcccttgcttacatgcttacagggtggagggaaggtgtctctggtgggaaggagaaggatgaagaggaaggaaagggaagacagaagtgtccatgaaaaactcagtagaaaggctcatgagaggcaggatattggctatttggggaggcacctctagaaaatgactcaccctcccttggttcttgagtggccccagggaggcatcaccatctccctttttagcatccctcccatgggaagggagaaggaaaaagacatctactgtccaggcagagccagtcagactcctctgagcaatcctggagggcttccaggaggagatgagctttatagaagccacaggctacctgggagggagatagtacaggcagagaatcatagggagagaggaccacatcccagggtaatagctgagaagcaggagacagcaaaataaggaaaggcagcgtgaccagagtggagggggcattgcaagggaggcaggaatcaccctgttgtattaacaggtctggttgtgtcactctctgctcagaaccgtgcagaggctctcatcccactcagaaaaaccacaaaccatcctccctgctctcctctcctatgcccctcactgccactcccactgctgaggccatgttggccttcttcccagtctgcatcgcatcgcatgcttcttaggctgttcctctgtctggaacctccttccctacccagctccactctcactctctcccttcctgcaaagctctgctcaagtcttgccttctgacgttgttatgtaaaactgcaacacttccctagccccattcttggccctcctgacttccttcaccttgcttttttcccctagtcacggaacttataactttctaacatcccccatgatttatttactctctcccacgagaaagcaagctccgcagggcaagaataatggtctgttgttttgttgacgtgtcagcacaagagacaggtcctgacacatagtaggtgttcaacaaaaattggttcaatagctaagaggggtagaggc

SEQ ID NO: 86918 - DNA, 1034 bp, Homo sapiens
gacaccccagtttagcatggtgcccggctggcaggagggctcttttcctcttttgcagactgttgatgcagcctcctaagtaccctctctgcctcccatcttggctcctccagtccaccctacagtcttcctaagacactgactgatcggatcctctgactctgctgaaatgcctcagggactctccacagctacagcaatgacttcccaagagtgccctggggcacaacagtcccaagagatgctcctgaagaaacagcttagggccaaaataaatgtagaaaatgctctttactgaagctccccagcccttggagattcacatgccctatgagcataatcagggatctgagaagtcctgcaaggttagcatgcagccaggttagcatatttgatacagttttccgaagctttttccatcacaggcaatctttttgcaagcaatgtctacaaacagcccaagacatagtcccacagaacatactttgggaagcagtgagctgcatggtagagcctgaagttcagtcggggaggggaagggcagcggttgtgtgatgagtccctgcccaagggaacatggtctgtgggagactgagatggctcagggtgcaaaagggaaggtgctggctgtgtgcagacatgacagagacttgtgggtcaggaaagtccatcagcagctctcctctctgccttcagtctcttcatctagacacagatgtcctgggcacgtgtgtgtttctagacctggcacatcctgagtgaatcttggcctcttaatgaacccagcagcctcctgctgcagagtcgctgagatgctgtgcagttatgacatatcctcccaccacaaaagaacattccagcttgtccaggggatggtcacggaggccagtgctccaccggatccccagcagcaggagccttctgtggtagaaaaagcatgggcatcggaggccgagtccgggattcccatcctgatccatcactgactaggtgctgtggggccttgggtaagtcactcaatctctctaagcctg

SEQ ID NO: 86919 - DNA, 1069 bp, Homo sapiens
cttagcaaatggagtttgggataggtttcagctctacttgccccgttggctgggagccctgtgcaagctacaacctgtccaaccattcatgacatccctgttggtaggccctccgctgggcctctggccaccttccccatgtggtatatccttgggattccaggagttgctgtaaccccaggatgaactttgcagaaggtcagcagctgaagctctgacctcacacccccagcagcctgcacgggcacactgtccctcacttgcctttcccctgtcagctttgatgttcctaacgcctccctggtgagctcatcccagcccaggtggttctaatagaaggcagtgggaggagggtgtttgattccccggaagaaccccccccaacccaccccagctttctcttgccagtctgaccctccgatctccctccatccaggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagtgagtagagggtggcgggcaggaggaggggagaagaatgggagggaggagaggggtgaaagggaggggcgctggggagaagcatgcccagtagaggccttataagaccaccactgtaaggtcatcagaagtgggtctgacccagtgtaggaggcgcttctcccagattcgagaagctgagaatggagaagggaagtgtgcagagggaggaggggaaccccatgggggatctccaaggggtgcccattcccagctctggagaaggcagaggcttggtagaagagtgtggctgggcagggaggagtagctgatgctaagaccagctaaaaatatcatctgcactgcaaaatcaatggctgccacttatccccggtgtgtttgggggaagggagaggaggatcaaatcctggctgccctgaaggctgaccttgggggatcctgggggtgtggctgttcctccctacaggccaactcttctccagctttgacca

SEQ ID NO: 86920 - DNA, 1049 bp, Homo sapiens
caggaggtggaatagaattccaggaccatagccccagatggaagggagcttagagactgtctctcttaatagccccattagataaataaggaaatcaaggttctgagagaaaagggggctgggccagagtcacccagcaagtcagtggcgaagctgaaggagatgcagctctgtgggcccacaggccttgctctttagcatcatgacatcatgcacgcaatcccagctgtgcataacagctgggcacaagagcacctggagccagggcggggacacaggaagaacacggcagtgggttagagctaaaagggaggagtgggggaagtgggtcctcactcctgtggccttttctcccagagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtaagagagggcacggtggcgacagagaggggagatgtttgccctcaaggaagactttgctgtgaccttgacctgaaaacatacacacccttttaactcaaccccaaaccaagctcatcctcactcatcatctgccgccccactccagggtgcagcaggtcagcaggaggtgaggggagaggatccacctgtcctgtcctgtcctctcctgccctgtcctggctccagcccctcccactcccatgccgcaccactccctgactccccacccccaactgcttgtgtcctcatccccaacctccttcaccccacagtcacctgcgtgtgcatatgtctcttccccttcgcttgtcacactgggaatgctgtggcacccacatccaggaatccaggatgtgcacgaactcccagaaggcattttaaagctttaaatgcattt

SEQ ID NO: 86921 - DNA, 1083 bp, Homo sapiens
ctctgccatgattaattgctgggggggaagagaggagggatggggatagggattgggctggagtgacaggaggaagggacaacgagtccccccaggtgccttcacttcctggtgccccacccaggaccttgtcttggccccaggcctccagatggggaggagcactgcctcggcccttcttgggtctcaccccagtgcccactgttggggaaaggagttcaggggtaggacctgactctcctctggtttctctgcagccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcg

SEQ ID NO: 86922 - DNA, 1058 bp, Homo sapiens
tcaggaaaaaacagtcctttgcagggttgtctagagctgggagaaatccccacaggtcacagtcgaagtcaattccttcttgccgcattcccacactggcccacttttcttcatcacaaccttctgggcccagccaaccccatgtttgcagggaaggggaggatgggggagcattcctccacgtgtaagcccttgaagacagacgccagctccagcctcggtcggcagtccttggcccgccaaacccgggggcgagtgaagacggccgagcagacctcaattccctccgatgcttctctggcagctgccccgggcagtatccagtctcagcccaagagaaaaaactcatggagaaaagtgagatttctcctcctgtgtgtgtgtgtgcgtgtgtctgtgtgttgcaaggtgaggggtccttggtccctgacccctaggctgattctaggggccagtgttagctccgggtccatgtcgggatggagggcagcagactggagccatgccactgatgtcacacaggcatgcctgagagggacaggcagagggaagcagcaccctttccacgaaccccaaacctgactccatcatggaccaggccctaggcaagcatcccatctccacgggtgggcaggcagtggggaaggggtgggggtctggagacagcgtggaaggcaaagctgacttggcttcaagccatttcccagaaggtcacctgccaccctcccctcgccctcaggcaaacctgaggcccctcatttagagaaggcggtgccagcctgcacttggcctccccgttgctgtctggctttgggcgaatcatggcctctccctgggcctcactgacctatatccaaaatgaggggggtgggctgagcttcgaaaacccctcccagctctgacaagcctccgatcctcttcatcttaggctggggtggggggcaagaggggctgagggagggttgaggccactgggatgccacccttgttccccaagttcacagtgtagagtccatggctctggttcctcgattcctccctctgagtctctggggcct

SEQ ID NO: 86923 - DNA, 1038 bp, Homo sapiens
accttcttttcatgtctaagaaaacagacatccatggaagtgaggtggcatgcccaaggtcacagagattacatttccagccactgagcaaacaattgctgagcatctaggaggccccagacactgtgctaggctaagcctagtatggaaggtaggatttctgttctattaactcagtctaatggaggaggcagaaataaaccagagagcccgtagaactgaggactaaaaagaagccattgaatttagcagtaaggaggtcaagggttaccttcgagcagtttcagtcaaatggtggaggcaggagccaagcctgacaaggaggtgagaaaacatagattgagaataagctcctctttccagaagtttgaaagggagagaggaaggggatctctcctactcttcaggatttgtatctcaatctagtcaacacatttgtttttgtctagaagtaatggtgtacaggttgtcctataaacgatggacactttagtaagtggtatttgttatgaaagccatgttgtagaacaactgtagctttaagttgagaagaaattgccttcaacccttacacaattttgagaaggatttcttaaagacatgtttttatactttttttttttttctttttttgagacggagtttcactcttgttgcccaggctggattgcaatggcgcgatctcggttcaccacaacctctgcctcctgggttcaagcaattctcctgcctcaggctcccgagtagctgagattacaggcatgcgccaccatgcctggctaattttgtgtttttagtagagactgggtttctccattttggtcaggctggtcttgaactcccgacctcaggtgatccgcctgcctcagcctcccaaagtgctgggattacaggcatgagctaccacgcccagctgacatgtttctttactttttaacctattcatcttccaagtaaacatttgcttcagaccttcaaatgttttcatgggccagtggtttggttcttggtgtgctataaaggtacaccattcagttc

SEQ ID NO: 86924 - DNA, 1918 bp, Homo sapiens
cagatcatacaactattgaatgccagatcttctaatggagtatcctgaagattacgtaattaactggaggaagttccatttctgaaatgtttaggtacaaaactgaaagtaaagcttccttcctgtgggaatagcaagaacaaagctctggaaaggtgcctctgctggcctgttcttcagaggttccagaaggacaaaccaggcttcagatttgctttcctcttcattcacagacagctgtgggttgggatgctggtgagttcagggactatgccctcaggaggacagcagtcctggcacctagcttctgtcaggatgaaggtctcttctgggatcttcaatatttatggaatttccaacttgggctttactgtgggtacaaagctgttgggatttcaggtacaggtaaagctactggatgcttctgtcattatttcattctttctggacatgtttgtttttgttttaaatgatacagttgaagccatctggttatgacaacatcagagccccagcatactgttcataaacctcccactgccaccacccccctcccttagctcccccacatctgaaatttaattcaagttaactccacaatctggggcatgagctgtcactgcagagatgtccgtgccagtgaagcagttggagatttcaattccacgaggatatggcttatttatcaaaacagtatttcgggcaagtagtttcgcagaaccattggagttgcagtttcagttccacatagaatatctggcatcatccccatctccccttcccctgtgttgtcagcttaccccatatatccgaccacctatggaaaattttccccattccctatgtaaagattaaagctctttgcattgttactaggcatctcaaacacctttgtgggttttaacaatttgggtaagagatgctcctcttttctttttcactgttaaagccttttaggtcttgaagagctttctcttgtattttttttaattccagccaggcacattgagatctttcttaggccggaagatccctggcttgaccacagctctgcacattcatctttaaatctggtgtaaatctattgtgggatctccatattgtatgagcctgtgcagatgaaaggaaacagcttgtatgtttatgagcagaacaacaaacagagggggagttgagctgcactttgaaactgactgttgctttgttcttgctcttcaactcctataaaagaacaactaaatccccccaaaatgactgtatcaaagcctttggtttatctttgtcaaagacaaattctgggctggagcccaaccttattttccacaactaattatctttttaatcagcctgagccctgtatgtttcctttatctcttgacttgtcactgaactctgccctacatcatttagattcatttctaatggcttgctgactaatctaacattcaggtgagtatcgttgggctgctctttatgtacgtgtatgcacaaggtgaatgcgttttccttcttttaatttcagaggtgaccgcgccatgttggggcctttgacccaatagatggacacctcatggagacagtgagcaggaaagcaaatgtaggatgatcagtatttgggataatgagttgggagaaccagaagctttgacctccggatgagaacaggaacttgaatgttgttgactgatgggatctttatgctgctgagccattagcaagatgatccctccccctctgtaaatcctatagttgctggagtagaaagtggcatctggaatactgtttggtcttgatttctgcagctctaggaaaaaaagaattttagacttgagggaattcagtgcaagcaactgaaatgattaaggagttgaaggggatcaactccaggggagaaatgttacgaagataaaatatgtgt

SEQ ID NO: 86925 - DNA, 2083 bp, Homo sapiens
gatattaaccattgaatgaagtatggttatcctcccctcttttttgataatcaagtaggccccaggctctgatctgccctgtggttaaaggctggtgagtggcaaagccaggcagaagctcagggcttctggccgagggagcccatgctcctttttatgactagcatcaccggtgaatataaggaacataggcagtgttgggggcctggggaacattctgctttttgtttttgagaatatagtggctcaaagtcttggttttcagatgacgacagccacaggcaagtcaccagtctgctcattgtctaacaagcaaattcttatgcatattaagggttcttctgtttcttgcattgacaccctttatacctaacagtggaaaattaggctatctaggtggctgttgaattcatcccttgctcactccctttggtaacccatttctccacatttctcctagtcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaaggg

SEQ ID NO: 86926 - DNA, 1061 bp, Homo sapiens
tcttcaaaattatgagagaattaatagcttaatagtagaataaattgtacttcatgacacatttcaatttgagaagtgttcaagtgtggaaataaaaatgcagatcttagaatcaaagacatatgatgattacctaaaataattcggtcagtgattcccaaaataaggtgaaatatcaacagatattaggttggtgggaaagtcttatgaaaaatactgagtttaaccaagacaaatagttgctatcttactgcaggatttctcagaacatgtagcatattaatgttactgtgaattttctaacaggaattatgatagacagcatttctccaatttagttaaccctggaatcctttttctcaaggatcacctgcaagattagtggtccccaaaacgcacattgggaaacggactttcattgtttaggtacatcagagagagaactcaatggtctgcccttctaggccctgcggtctgtggaaacatgacctgtggggaagggtgaaagaattggtgtttaccctgtgggagcttttcctgtgttggcggacaagtagagttggcgtgaggatgggagaagggcgtagatcctgccagcagtagaccctgtgagaaagagggttatctgccaaaagcacctccttttcctgctgtgatgctgcaatacccattggagggaaaagtgggctctggtctaaggacacaagagccttccagggtttgctcatgggatagtctcctacctccctttgtgcctgaggacagaggaaagtgcctgtgtttatagtggaggttttatctttattgatcagcttttggagtgtatgtggaggatggggcaggtaaatgccatcagtgctcctgatgaagaagattggaataataaccgtatctttcttgtcacttttcaagactttatgagtacaatgaagcaatgtgaaaattccatacccttccagtctacctcaattctgaccaggggaaacttgcttttaatggagacagtaagaaaatattcactgcaagctctgggaaagtagaagacacaatccaataactgc

SEQ ID NO: 86927 - DNA, 1024 bp, Homo sapiens
agacatgtctgtttagccaggtatctagagtcagatgatttcccactttagctgcagattcattttcctaattacttttttcttactaaaatggagtatgagtccctaaactccttctgagagcagagagaagtggtgtagaagtattatgggtaaagcagattgacttattaaatgaggctgatcatccacacagttttgggtgagggtatttagacatatatgtttttactcagaaaactgaggaaaagaaaggtgaaaaaatcgaagagttgttttgctgttatgtttaagaaaacaaagatggaacatgtgatggacgaaaaggctattataatcaagccgggcaaagaaattttccattaatgttaggttttaaatgatacaaagttctctcctcactagagcttaaaatcatgaaaatagtttagtttagggattttgttctgttggaatgtttctcatattcagtttttctggcatagaatcgagttgaaatcaatgatgtggagcctgaagtttttaaggaaatgatgtgcttcatttacacggggaaggctccaaacctcgacaaaatggctgatgatttgctggcagctgctgacaaggtaagataagaatagaaaaataatcaggactaggagttattgtgacttcttgtgtttcatgaacaggattctatgttgcattgtgggtaaaatgagcatatatcttggtttggccaagacggtcctggtttacacatattattccaacacaattattaatagcacactttttattctcaaaagtgtcctgttttgaatagtaaactatatgatcacctaactatgggaaagaaggataagtttgacttctacctctcctcttttttccatctcaaatttaaccacagtgatagtaaagattcaaataatactaacatttggattgtgctttataatttacaaaatgtttttgagtttattaatgtatttaaactttatcagtaaaacagccctttgtatccatgtggactcaacca

SEQ ID NO: 86928 - DNA, 2132 bp, Homo sapiens
acttcctcaactcttgcttcttacctcacctgcattctcagtggaggtgttcttcctcgtggacaaagcagactttttttctacctctgctctgttttatatcccatcttgccttctcagaaaccttactctaccggttatacccttgctatctatctagtatcttcactatctctctgttattgcctcttcaccttcagcctgtacaggctccaagcttctccctctagttattctctctctcttttccccagaactgagtttcttgagttagcatattcactttctacttcctttcctcccacttatcctcagttcacctccatgctatgaaagcagtttttcaaaattacatgatctactggttcctaaatttgaaggactttagttcatatactaggactcctctctcctgattctctggttgcttctgatgtgtggtctccttacttcttcctcaccaatccctttatacattggtgagccctgaggatctgcttcagttccgttttcattccacttcttctccctgagtgatttcatttattcccgttgcatcagctgctgcctatttaccgaggaccctcaagacctggctgctttggacccttccttctttatgaaaagcaccgggcctttagtctttaatttctgaaatatatttatttagttctctatggtctgtaacccttctgaaataagaacaatgagaattgatatcctttcggtagaaattaaaatactgaagttcagagggttaagtgatttgcccaagaatatgtggttagaaaatggcagagctaggccgggtgcagtggctcatgcctataatcccagcactttgggaggcataggtgtgcagatgacttgaggtcaggagttcgacaccagcctggccaacatggtaaaaccccatctctactaaaaatacaaaaattagccaggcgtggtggtgggtacctgtaattccagctacttgggaggctgaggcaggagaattgcttgaactcaggaggcagacgttgcaatgagccaagatcatgccactgcactccactctagcctaggcaacagagcaagacttttgtctcagaaagaaaaaaaaaaaaatggcagagctaaaattagtgctttctgacataaactataggccaaaatttccagttctctgttagctcaaaacctttctactatatattttgtccattctttcactcttaggtaatcgttggatctcagctttcaccagaacccctgatttatttgacaacatgaacaaatttgagttcttagccattctattacttttcgtggttgagattattatttttcatggtgttcattggactagaatgagcatgagttggagcactgtttctcaaccttccaaccttcattatccctgcctctaaggagaaaaactaaatttaaattctccctgatgagagaaataaaatactaaggaagaagattttatcaggtagggttgtgctttaaagggacacaaatcattataatatctaaagtttctttccccccccacctctttggggcaatatcatctctgttaggaatgcatagcttagaaaaacagacagtttgccataggtgagcatgcgcttcatctggttagtggatgccattgagcccagttcttgaccttcttcctgtgcagtccctggaggtgcagaaagtatggtgtcagttccaacaaaaacataggtattagaacaccctgcttgatcataagggaccttccatttgaaccccaaatctatacagagaacatagcattatcatccaacatagataagtaattttcttgaaatgtgaatggttggagtagagccgataagttattttggaagtagtggtttcttattttcctttatgtattataattagttacttattgttataatatatgaagaaaggaattttgtaattctgatgtaaattgaggtagagacctttcctatagcagtaggataggttagaaaatgatctctccctcatgactggcaacaaccaagagatttcactgtgatagccttatctgcttgtttctctttgactttgtagctcgttctccggtttttagtgccatgtttgaacatgaaatggaggagagc

SEQ ID NO: 86929 - DNA, 1054 bp, Homo sapiens
gctaggtttagttctgttttcttcatttcatgttacaaggggagagaagcagtgcccagggagtcaggaaatttttcctaacattgtgcagcaaactagtgcgagggtcatgtcagctccctattttctatctctagtccgctgcactacactaagtggagctgaatgccattcacccaaggaagcacaaactcgggtcccaagttttcttgacagagcatttactttggtaatgaaagagagagacataagagtcaggagtggtggcccacccctgtggttcccagctactcctgaggctgatgcaagaggatcacttgagcccaggagatcgaggttgtggtgtgctatgatcgtgcttgtgagtagccattgcactcctacctggacaacataattagtccctgtctgttaaaaaataaataaataaataaataaatagagacatgaaggcatgtttaaattccattttaaattttctctttaataatttggtccacagaaaatcttcatgaaatagttcagcttctattgacccttttctccaattatttatattgaaaacaaatagccattagcaataaagaagcattgtattccaactttaccatatatgcctttgacaggtagataatcccagaacctctttgtcatgttgtaactaaagatgaaatatgaaataacataaatgtgaaatatccagacactaattaactttattttaattttttaagagatgggatcttgatcttgcccaggctggagtgcagttgcttaatcatagctcactataacctgtaatcccagcactttcggaggccaaggtaggaggatcattcaagcccagaagttcgagaccagcctgggcaacatagtgagaccctgtctctacaaaaaaattaaaaattagccaggtatgatggcacgtgcctgtagtcctagctacttgggagggtgaagcaggaggattgcttaagcccaggagttggaggctacagtgagctgtgatcacaccgctaccactgcactccagcctgggcaacagagggagacc

SEQ ID NO: 86930 - DNA, 1593 bp, Homo sapiens
tggcaaactagtgagtgttcttctaaaagaggtgctggctactcagctccagctaactatagctatgcatgagtaagggctgacccttgccagattttctgatttttcaagaaaagcaagaaatctagattttaacataaaaatctctttacttttaaattgcctgcttttaaacaagaaaggggatttatttgcttatgtaactgtattgacagggtataggatgggtttgaaggtagcttgatccagcaagccagtagttagagtaagaacaccatctctgccctggccctgttctccacgctcttggacatctcaggtctggcttctcttgtgcttaagggataactggcagtaccaatgggtataatctactacatgctagcaaaagtctttgagctttctctgaactgtgtggccaggaatatgtcgtacatgcaccaattgttttacgtttgcattccctgaaccaatccctggagcagggaaaatatgatccaggagtgaggatcagtctcattcagactatgtgtcatcttgcctgaggagcaggcagttgaggatacaaccatatacccactgcaaagaccaaaacgcaagtctctgaaccaccagttttgacctctgataacccaccaaaagttattttttcattcatttagtattttttggctatatattgtgcattttactactaagtgttgagagagatgtttattcttagacattgtatttaaatcctcatcattagcaaggtgtatagtaatgtatgtagcatatgcactccctagagagacactggattgggccacctgtttgagagaggtgcaataatacagataaggcttaaggatacatatgacctgtgtattgcatgtggtagaagcagtgcctgaaacccatgcatttgactaatgacatttacaacttagttgaacctattctgtctgaattttgttttgatctctccgtaacagattggcatctctaacactatttagaagtctggcctggaattctgtgctgcgtaatgataatttacttttgtctgtgcttccttcatattgcctcttttattttagtcttagaatattgttgccagattggtaaaatatctataaaagattatgtatattattatctataaaagattattcacactttttttttttttttttttgagacagagtctcactctatcgcccaggctggagtgcagtggcacgatctcggctcactgcaacctctgcctcctgggttaaagtgattctcctgcctcagcctccagagaagcagggattacaggtgcccactagcacgcctggtatttttagtagagacaggattacaccatgttggtcaggccattctcgaacttaagtgatctgcctgccttggcctcccaaagtgctgggattacaggcataagccaccgtgcctggtccacacatttcttttttttttctttttcttttttgagatggagtttcgttcttgttacccaggctggagcgtagtggtgtgatctcagctcactgcaacctctgcctcccaggttcaagcgattctcctgcctcagcctcctgagtagct

SEQ ID NO: 86931 - DNA, 1034 bp, Homo sapiens
ggtttcaccattttggccaggctggtctcaaactcctcacctcaggtgatccacccacctcggcctcccaaagcgctgggattttaggcgtgagccaccgtgcctggccactattacacatttgttaagggaaaatatgtttgtatcaactttttagaagtcttaactctgactcattaatattaataagtgcataaacctgaaacttgttagtaaaataaactttgttaatttgacatacaaggggagaaacattctgggttttttttttttctttttttttgtgctatagagttactgtctaatctttcaagcacgggaatctaaaagaaaacattaattcagtcatttattaaataagtatttgtagccttccatgtgccagacactgtctgggtgcagcagcaaaacagacaagaacctgtcttggtagagtttattttccagttagagaagacagattgtaaaaagatacaggatggtagatgactttatgcgctatagaaaaaaaaatgatgaagcaggaataggattgtggttgttaacggagggaattgctttttttttttttttttttttttttttggagacagagtcttgctctgtcatccaggctggagtgcagtaatgcaatctctgctcactgcaacctccacctcccaggttcaagcgattctcctgcctcagcctcctgagtagctgggactacaggtgtgtgccaccacgcccagctgatttttgtgtttttagtagagacggggtttcaccatattggccaggctggtcttgaactcctgacctcaagtgatccacccgcctcggcatatcaaagtgctggtattacaggcgtgagccaccacgctcagccaggaattcatttttaagggtatcagggaagacctcacagagatggtgacaaggaaagtcttagcaatggtgaaggagtgtgccctgagaacatctaggggaagacttattcagacagaaaatgacacgtacaatgctccaaggcaggaatgggcttattctgagga

SEQ ID NO: 86932 - DNA, 1009 bp, Homo sapiens
tttcatcatgttggccaggctggtctggaactcctgacctcaagtgatctgcccaccttggcctcccaaagtgctgggattaaaggcatgagccaccacgcctggcctaggttgttcctctactgtgaatcttgaggttatggtttccactagactatagtgctcaactatagtggcctattttaagtggccttataattcctaaccaaagtgacttgtgaaacagaggaccctggataaatttaaatgttataaagatgataaaatgtacaggtaagtttgattttgctctcttatttggcaattagagctttattcctagccataatacagaaaggaaaggcagcaaaatatggttagtactttttatgtgttttttcccctttatttgacctttgggctgtggagtgggagcatcttttcctttaagaagtgaaaaatataaatatgccagaggcttgctagcagttgaaagcaactgttggtcagtgagataatggaaggaaaaaaaaacaacaacaggttggagatgggaaacgtcaaggaagaaggaggaaaaacatgtttgaaagaaggggaaaaaaagcttaagtgaattcaagaaggcaaaaaagccttaagtgttctttttataatctgtctttgagtttcaggtactaaaatttgagatgattaaaagagagattggttcttagaggaataaataaaattaaggcaaagtataaggatttatggtctttatgaagatatgtcagattactgtggacattatttttatttaagatgtgctttctggctgggcgcggtgactcatgcctgtaatcccagcactttgggaggccgaggtgggcagatcacaaggtcaggagttcgagacccgcctcaccaacatgccccatctctactaaaaacaaaaaaaaaattagttgggtgtggtggcacgtgcctgtaatcccagctacttaggaggctgaggcaggagaattgcttgaatctgggaggcagaggt

SEQ ID NO: 86933 - DNA, 1046 bp, Homo sapiens
attccggaaataaagacacctttcacatcttaagaatcagagtcaaattatgtctgtgctgttttaatcagtaaagatttggttgaattgaaaataaaaggttacaggagccaagaacaaatagagttgcaaatttatctttgtaactccatatccttaggaggaatccagtttgtatagccactttaattttgttgtgaatatagactgagcagtggaattgagtagcttgacagttgacttaatttgaacagtcacattagataagactggaaagctaggttgagggaagtcaattttgtgtgtgttttctggttttgtttctagtatcgtttctgataatgaggagaatttggtggcccatttggaccctacttaatggtaactatagtgcctcaccaatatctttcttgtgctattccaatttatcaatcattattggacccaatatcctgaattacagtctgattatttttcaccaatcttttatctttcatttacccacactgaaattcttgagcccaacatctctttttttcctcacataactgtggggagatagtatgatagctaggtactgttctaaactccgctgctggcttcctgtgtgtattattaacacattgggcaagccactaagctgctttggggttcagttccttgatctgtaaaatgaaataatttgactggatattattaagtccttttatatctccagagctattttattcctttattcaccagacttttcttgtgaagcaccttctctgtgctaggcacaatacaggatgttctgggtacaaacttcttgcccacaaagagtatttagaacttccatcactttattcaaatcagcttagtcttttactctggaaaaatttagtattagcaagttttgtcaatttttactatcactgtataaggtatttgttaaaattgctggtattacttagatcttcatctccaaaaatactcatatctctactttttgtttttctacttatttatttattattgttattattatttttgaaacggagtcttgc

SEQ ID NO: 86934 - DNA, 1037 bp, Homo sapiens
cctcccaaagtgctgggattacaggcgtgagccactgcgcctggcctaaatcagttttattcgtatagcaactgttttcttctttccatctgataagttgttttttaagtaccaattcctagatctcactagacctataaaagagaattttggaatagggaaaaacatacagagaattaaaattctgggcatcctacgttaattggcagctaatgggttcttagtaacatttgttaactgccaagaaagtgacactaggaatttagagtatactggggcagttaggaaatgcttcagaacaaggtaggacttgacttggacctggaagggtagtattcagataggaggtagaacatttctggctttcggggtggtatgaataaatttgagaaaggcatatggttgtatgtatgagctgacaaacaggctagagtcaactaattggagaggagggtttgtgttgtggtgtagtggagaggtttttatgggagttatgtcccagaggactgattttatttttagtacatctgaagttgtgtagtatgcaagtgtaagataaagcagtatctagatgtggcctaattttaagcaaactggatacattgaagtctctttttacaagaaatactggagaaaggttctttatatgtggattatttaaataatgatcttcccaatacttaaatatttattttactttgtagttctctatagatagactagttgcaacttttgtggatctcagattcttttgtaatatcaaagagttcagacaaggtggtttctgaagttctttctggcacagagattattacataacttttaagaatacctggctgggcacggtggctcacacctgtggtcacagcactttgggaggctgaggcaggtggatcacctaaggtcaggagttcgagaccagcctgaccaacatggagaaaccccgtctctactaaaaatacaaaaaattagccgggcatggtggcgcatgcctgtaatcctagctactcaggaggctgaggcaggagaatcacttg

SEQ ID NO: 86935 - DNA, 2467 bp, Homo sapiens
gcgtgagccactgcgcctggccagaataaattattaaggaaaataatggggagattaaatttaggtggaggagtcagggaaggcctttctggggcattaaatattaattgggtaccagttatgtgccagatgctattctaaatgctggagacaaaaacagacaaaaatccctactctcatggagcttatattcaggcagcaaacaagataaataaaatatatggtttattggaaagtgataagtttcaaggagaaaaatacgacccgaaaaagggatagatagagaatgttggggtgggagtaggtgttgtgattttagatagaatggccagggaagacctcactaactcacatcaaaggtaatgcttgagtaaatatctgtagaagatgcaggagagaactagcactctagacaaaagaaatagcaaaaaccatgaggtatgtatgtgcctgccatactcaaggaaccagcaaggaggccagcatgactggagttaagtgaacaagagagaaagtagtagaaatgaggtcagagaggttggtggaagtccaaatgttgtagagcagtggttctcactcttagctgtttgttagaatcacctggggaactttttctactcctggtgcctgggctgcacccataccacttaagtaagaatctctgcaggtgggacttagtggcagaagagatggagagaagtggatggatttgagaagtatgttaaagaaagaattcatttaattatagattgagtgtgggggttgaggaagaggaaagtgtcaagaatgactcccaggtttctggctgaagcaactggatgggtagacgtgtcactgagatgagggtgggagataggaatgggaggagtaggtgtggaatttggagggaagatcagaaatcaggagttcaattttagacatgttaaatttgagatgcgaatgaggctaagtataaatatgttaagtaggcagatatatgagtggagcttgaaatgaaatcagagcttgaggtaatacaattttatatcatccgcttgttgatggtcttgaaagtatctaaataacatcatgtaggacaaacttaatggtgaaagaactggagatatggaaactagcctactctactaatctgaacaagaattggtgctaatttgaatcaggatagtgtcagtggctctagaaaaatataagtaggttggaggtttaaggactgaggagcctgtgtgtaacggaggtggacaataggcaaggaatgaaagataactttgagatataaagcctaggtgaatgatccgtccattagcagatacgaagctgtcggaggagctggtttgggaaaacaggtagtgattggctttggttgtattgatgtttaggagaggctgcctagcaggcaggcagttgggtctattgcactgagttttggaagagtagatgaggttcaaaacgtagatcaagaaatagattttcgtacattgaaaatgaaacactttcatttgcataaaattgattcaccatgggagcagcaacatttatgaaaatagcaacatccccagatttattctgacctgttaggatctctgtgatgtggtccttacctgtttcttttagtgttttcctttgatgaccgtgttcaagctatactgcccttctttctattcttccagcatacccagctaggtcctcctttgggcttttgcactttttattttctcattttaactcttctctccttcttagtagagggataagagggctgagaaaaattcagaagttggtgtctgggaagtggagaaagttgcaagcagatctttgctaaggtgtgggagcatggatgagcacatgaagtagaatggctgtgggagcccttgacgttgacatttggtcaacacaaagacacagagtaccatgttggtctcagtgtatcccagtactcaaatctgttgaccagagatgctacagcagtggtagttcttctccgcttggttgtctgatgatggtggtggtgatggtccacctttgaaatatgacttgactcattgctatctgtcctgccaccgccgatggaaacatcttctgcataggtgagaaactcccttcagtgaaagctatgggtaaattatttcagaaacttgctggcttgaagaaacaacatgaaaacagcagggaagttccttgcagtccactttgacatattgttaggaattacttctcattaggagcacctatgtggctctttattggtggtgttagtagtaaaagggagtaatgcactccacatgaatccttaaaaagagatttaaaaatcaacatggtattttttcagaataaaagtatttgcttttgctgattatgaaataatttgtggaaaaaaatagaaaagtataaagaaaaaagtaaaaaattaccccaaatcccaccatacagagttaactacagttaacgttttctgaacatcttattgggc

SEQ ID NO: 86936 - DNA, 1056 bp, Homo sapiens
tatttttagtagagatggggtttcaccgtgttagccaggatggtctcgatctcctgaccttgtgatccacctgcctcggcctcccaaagtgctgcgattacaggcgtgagccaccctgcccagccaatttttgtgttttgaatagaaatggggtttcaccatattggccaggctggcctcaaactcctgacctcaagtgatcctcccgcctctgcttcccaaagtcctgggattacaggcatgagccactgtgcctggcctaaattataatttctactaaaaaattgaggtaaattcttaattttttttctttaacacttttctgagtaaggaaatggtacaatatcatctctaatggtggtaaatgagtttttttcactctcattgttttagtgtcatggattttagtttattctgttttaccaacattaccttctttttgatgctcacactgtcctgtatttggcctgtgggagccctttaagcttgagctatgagtgcttccttgctttctgtcacaagaagttcctagctcactttgtatttttcccgtcctagatgcagaacccttacccttaacctttatgtatatgacattttcttccctttcagtaaattatgaggttggtgcaaaagtaattgcggttttgtcatttaatggtaaaaacctcaattacttttgcaccaacctctaacaggttatttgtctaccatatggagcttctggaaccaaattctaaaaactaaaggtgctttaattttaacttgatgtacctagtgtttgactcgcttctgtgtcactggcattgctggattctggatgttagaactcacagcttccttgtcttgaatattcttcgtgaaaggcagtatctctgaagagagcattgaccaccccgttgtccccacctctcatgagcaaacttgtttttttctaagatgaaaggcacacagaataaaatttagaagttgaaattgtgtgtttctaagctttgggatgtggcggttttattattatataaaaacatctgtgcgtctatgcacaagtatgtcttc

SEQ ID NO: 86937 - DNA, 2153 bp, Homo sapiens
gccttactttcaattctctttagtttgtattctttgatgttcttctctcaaggcttttttggctgccactgttaactccaaaaccgcatgttcttgggccttaaagtatatgtatttttcacttccccttttaaccctggcccttacagggttctgctgtcttttgtgctgtttcctgttgccatggttacagttagaaccaagagatgacacacagggaacagagaaatttggggtgcatatatcttcctgggaaagagctggaaactcacctttttttccttagaggtagaagttattgtaagactaccccacccttaggtttggggtagttgttatccatttagtactttattgatttctcgttttagagctcttcatagtagctagtttggtatttggagatgtttactgtttcctatgtccatacttagatattacttaggtagtatctagaagtgaaactattgtagtaagtgtccgtcttctcagtaggtttcggccattgggatgcttagattttttcttttttccttttttttttgagatcgagtcttgctctgtcacccaggctggagtgcagtggcgcgatctcagctcactgccacctttgcctcctgggttcaagcgattcttctgcctcagcctcccgagtagctgggattacaggtgagtgccaccatgcctggctaatttgtattttttgtagagttgaggttttgccatgttggccaagctggtctcgaactcctgacctcaagtgatccacccccgccttggcctcccaaagtgctgggattacaggtgcgagccactgtgcccggcctgattttttctagaaacattttgtctagttgaattcactgaagcctcatttaaaattttgatggcgtgcaatgcttttagattaagacgaatattgttaaataattcgtactggtgcagagccttttttaaaaaatcattgtttaaaatgggttaacacatgtacatacatatgaaacaaaattcaaaaggtacacagagagtgaagtctttcttttcttaccatcctctttttatccatgagttccccttcccaaaggcaacagtcttgtttattcatcccgagacagtatatccttttacaagcatatacacctatatattcttcacattttttgtttttgtttgttttacacaataagacactatgctcattctgcactttgcttttctcactttatttatcttggtgatcattccatgtagtaaatacagtccctcttcctttttgaaagatggcagataattccattgtgtagatgtaccatcattcagccaacacttattggacatttaggttgtttccagtgatacaattaattccttgtatgtacttattctgtgtacatgggtgtctgttggtttaaattcctagtggaagcgctggatcaatggatgtgcatttgtaatgttgttaggtattactaaatgctttccacagaggttgtatgaatttatattcctgccagcagtgtgagtctgcctgttttctcaccaacactattatcaaaatttttgatcatttgtgcagtcttttatctaagattttaaagctcattatgtagtttgttaagcttcatttcactgaagagttgtgtataaatacctcactgttttgcagattggggaggggtcatggaggattttgtttgaaaaataatgtcatgagaataaagtcatatgtctggataatagcaaatccatgacaatgctaggaagacataaaaaacctatattccaatttcttcctttaactcttagatgctagtttctctgttagtattctgtaaacctgtaaatgatttatgatctccttttgatagctctgactttaaattgtttatccaagtaaactgctgttattctggtgagaaattgaaaagctaatctagttagttgaggtctgctctcttggtacagaatactggtactagcattttttaagtctgctgatagcagaatacttcactatgagcttcaaataaatagaaaataattaaatatgtctgtgcctgaagagagcttacagtcttgttggaaaacctagaagaaatggataactttctggacacatgtagtctaccaagattgaaccatgaagaaataga

SEQ ID NO: 86938 - DNA, 1006 bp, Homo sapiens
aaaatattttactgacagggctggcttttaaaaaatgagttaatacatataagagtcgttggtactccataaactgcttgcagacctaaatcgctgttgtgaaatgcctttaactgttccgttgcccactccgacccttggcttgttacgcctctatttggtcctcgcacctcgcagcgggctcccgcgccctgcgcgcgaccccctccaagttcccgcctctttttactcaggcccctccttcctctcaaatccccgggccctgacttggccccgagacgcatgcgcactaggaaagataggcggagtcttgagggaggaggagcagggaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcaggtgagtggggggaggagagtcgagggagggggttgtcctgtcggagtggggggggggcacctccctgaagaggtgactgacccccactgtccccccaccccccgccacacacatatactctcctcagtcccatttcctacacccggattacgtggcctgcgaatgccagagccgaatcagccgtcccttctccctatctcaagcattcagaagacacaaacgcgccccctgccttcagcccccccatcatttcccagccccatcccccttgccaaatactgagctgtcgcctgcggcgagatgggtgactgcgcatgcgcgagtgtgaacgcgctcgggctgcttcttcgctgccccgggggcgcatgcgcatcgcggtgttgcagggacctgcgggataaagagccgg

SEQ ID NO: 86939 - DNA, 1042 bp, Homo sapiens
gtgacctgtggttggtccctaggtatgtccctgagacacaaactagaactccaggctccctgaattcaagttgcgttttggacctgtgccctctgagggaggaaagtgaagcccccactgggagaccctttgcctctgtctggccccgcttatcagtggaacagtttgcaggttttatgagtagtgctggtcattttccccggatgccctggcagagaaattgtcctgagtctctgtggaatcattcagcccttcccactaaaaacacaccagctgtctttgggaacagtaatctcatatatttatagagcgccttctttcccaaagctctttagtacgtgacattttatccttagaacactcctgggaagaggttgggccagaaaccagtctccccatatttggaagagggagcctgaaacccaccaaaatgcatcagctgaaggtcgcgttgcactgccccacaggagggcaggagcctcctatttcacttcccactttccagggtcagggaaccctaaccctcagtgggctaaactagtggtttccagctgtttggattttctgaaagttcccagtagaattttcaaataatttggaggtatgctggcttttaatttttttcaagtaaggacatttaaaaaaaatcaaatatcaccattgtggtttaaaaagttttgtttttttttctgagacaaagtctggctctgttgcccagactggagtgcagtggtgcgatcatggcttgctgcaacctccacttcctgggctcaagccaacctcccacctcagcctcttgagtagatgcgtctacaggtgcatgccacaacacctggctaatttttgtaattttggagagacggggttttgctatgttgcccaggctggtctcaaactcctgagctcaagggatccacctgcctcagcctcccagagtgctgggattacaagcatgagccaccactcttggcctaactcagaagattttaggaaaagctatccaacctcacaaaaaaggacccttcttccaaagaaattacga

SEQ ID NO: 86940 - DNA, 1037 bp, Homo sapiens
ttgcctaggctggccttaaactcctgggctcaaatgatcctcctgcctcagtctcccaaaatgctgggattgcaggtgtgagtcaccacattcagccatagcctagaagttttgactcttaaatttcttttagtcttgctgtattatatatgtatctatatctatctgtatctctatatagatatatttatatagatacagatatctgtaataactagtatcctggtgccattctcttgtctctgaggaagttacataaaaccagtgttctgacatgtattttatttaaagcccccattttggagatacaaggccgactaccccaccccaccacaatcattggtaagtttcatttccccccataaggctaagcccattttcttccttttcataggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttgtgttctgtctttttcttaggcctggtgcagtggctcacacctgtaatcccagcactctgggaggctaaggcagca

SEQ ID NO: 86941 - DNA, 1052 bp, Homo sapiens
ccacatgatgctgaacatcaacctttggtcgacattgctgctgggaatgggtgagagccagttctgctgttcttcccatgtatcaccagagggcaggctgccctcatccttttgatccctctagctgttagttgcccagaccaagggcctgaattagttccaagatgcccttttgttcaagcccttgagaaaccttcctggaaaaacctgcaccagcaggatttgtttgctacttgttactggcacaatgaaggagagtcgtgtgtcagttgtcatgggaagacactcagtagtaaaacacagggaggtacctgggaactttccctttcatgagggaaatgagacacacgtagtgctcacaggaaacagagttagctgtacactgaagacagttcaaatgtgaatgatttgctttgaaatcagtgcttcctaacttttcaaatttgggcacatgtagaaagtattttttatacagcacactggggttaatggtggaggctgctgatggctgaaggtgactaatgcgaggggcttccttgagctaaggatgtgtgggtcagcatctctacagcatctgaggatttctgcttgtaatcactttggtagaagtaactcattaactttcaagcctttctcacaaaattctctttagtttctctaatcagagaaaaatatgagaagaatcaatgatgagacgatgcaaacccacaccatacactttcccgcgtcccacctcccttgcagttctttaacaggccatgtgcaggagtgtctgtgtgtgtgtgtgtgtgtgtgtgtgtgcgcacattttgtgtgcacaaaatgcgccgtacatttgttgacatgtcttctcaggaatcctgttcactggggagctctgggagttcttgagctttgctgaaaggtaccctgccatcatctataacatcctgctctttgggctgaccagtgccctgggtcaggtgagtgcttgaaaggggatggcttggcttccctactctggcagctggttccctaagaaagactggcctggctggaagaagagggtggca

SEQ ID NO: 86942 - DNA, 2119 bp, Homo sapiens
agtcgctgacgctgggcagcagctagacggcgctgaagctccagtaaggaatttggcattaggacccagcagaagcctggccgcccgccgcggaaaagactattggatttgctctgccgaccacacctcctcccgccccgcctacctgtccgtcttcgcacagcgcagccaattggtggcctccacatccttatacgtcattattctacgcccaggtggctctaggacaccctgtggtgctctgggtcgcagttgtcctcagagttgcctgattggaaaaatctccagggcgagggatcagtctcgaggctgccggttcccctggccctcagggatggagccaaggtcccagggcgggttttctttcctaggaagtggttgctgggttctgaggagtttcccccttggcagccatgagccggcagttctggtagtgactgctgggccctgctggacagcggtcgcatgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagatgtgagcgaccccgggggcgggccgacagtctctccccagcctgtgacagggatcccgggccttctgcctctggacccgggctttcctcttgtcctcctgcccggctgtcgccctcttagcaccctactacttttgcagctatggctgagcctacccagaattccagaactccaggattattttctggattcttcggacttggttattttcttttcttagctgtttttccccgcttggttctaagggcctgcgttttacaggctgagacttctattcctcaaacaggacccgagtcggcccccttttggtactcccagatgcttgcaaacaacctattcgtcctcggccttggtgccatagccgaaataccgtctcctcctgcctggggtacctgatttcactatctcgttctgcatgtttcctctccgtctttttcgggtattcttttcttaggctttggaatcagtaggctgggatgtctagtttctagatccagtaaaatcagccccttttgcaaatgagcctagtggtccttaacaaactctgcctacatccagagaggcaagataattttaaagttttcagtggctcgggatatattagatgacagtgagtgaaatacactaatttctccctcttttctcatgcatttcatttctagaacaagaggaaagtatggggaaggagccaagcaggagacgttcacctttgccttaactttggtcttcattcaatgtgtgatcaatgctgtgtttgccaagatctgtgagtacccagatagtaatttgttgggtaccccaccaccccaagttccctcagtatgctgggcattaagcattgattcaaccttaaaggctaactcatgatctccaccccattttgtacttacacagcctctctgtgaagtctgtaaaactaatgactttgaagtggagtaaaatattatttccccaatttttatcagcttctgagttagaaatgttcagagaatgggtcttctatattccaaatccccattgaaaatacttaaaacatttttttctttccctttgagtttcttttgtgtgtcagcttcaagcatgctttgagcattctctctttgttccctggggactagcagcagagctgactggtcccttgaactgaatgaggcccccacctccaccctgcatgtggtcttttgttgggcttaggtagaattggaaagatgaataattttcagagatttcccagtgtaacaggacagaaatagcttgtgtcttgtttgacagacaagttcctttcatgtggcttcagctttgcttagtggtccatcctagccccaccaggtttctcttgtttttttttttttttcttttcttttctttttttttttttttttttgtcttctcccagtgatccagttttttgacactgccagggtggatc

SEQ ID NO: 86943 - DNA, 1031 bp, Homo sapiens
ttgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccaggtaatgaagctctctcctgatgggataagggataaggatggggcgggagagctggctgaggaggcctttggtcttcctcaagtcattgcgatgatttgtcttgggttttggtcgtacatattatccatgtaatgttttatcttcttaagacagagtttccttttgtcacccaggctggagtgcagtggtgcgatcttggctcactgcaacctctgcctcccgggttcaagtgattctcgtgcctcatcctcccaagtggctgggattacaggtgcctgctaccacgccctgctaatttaccaccgtttttctttgtaaacttatatggaaatgagtttgcattccacctgcctggtggaagagagaagtcaatctgggtttttcagtttagctttgagtatttgtgtcggggtaatcaacagctgactttagagtttattctagctttttaaaaaatgagatttaggctgggcgcagtggctcacgcctataatctcagcacttttggaggcctaggcaggcggatcacctgaggtcaagagtttgaaaccagcctggctaacatggtgaaaccccgtctctactaaaaatacaaaaattagctgggcgtggtggtgggtgcctgcagtcccagctacttgggaggctgaggcgggagaatcgcttgaaccttggagggagaggttgcagtgagctgagatcacgccattgcattccatcctgggtgacagagcaagactccatctcaaaaaaataaaaaaaataaaaaatgagatttaccttgctaaaattaaaccaaggccaacattctattgagtttgtatttcccaaagaagtggccaaaaagtatgctga

SEQ ID NO: 86944 - DNA, 1049 bp, Homo sapiens
ccttggagaaatcagttcacctgtctacatgggggtgtgtcataggccctgcatcaccttggaagctcagccctctcttccataagagaattcatgagcttgtgggggtgcacatacccataacagaaatcagagtacagtttcaatcatggttgtcctcttgtaggattttttgtctttgaacttccctaatgtttgtttttccttcaccttacttaaaacactacctaagagctgactgggcttcatgatttctttcctacttgatggaaatcagattcctgtgagaagtgaagattcaaagggtttatgcctgtcctttgagtttaaaacagccctccagaaacccatcactcccaaataaccatggagtaaggatttttttttttagagataggggctaggctatgtgctatttatgctattcttgcaaaggccatgtagatcccaaaggaaagtatgttccaatcagtaactgctagtgttttgttttaaggatgttgaaatcctgcagaactcctcttcagagaattcagataaaaggtgaaaagttcacaccacttccttttcttctaactgcagcttaagaattgaacaaatgtctaagtaactgctgtctactctttttatatacacacatagactttgggttcaccctttttctccttactgttacaaagagccaatgtattccttattttttttcccacaatgacatctccagaagggtttctcttggcctgtctctccagctgcctacagatatggtctgcatcttgggaagtcggacacacagccagaaatgctttcagtggctctcacttaagctgtacacttaaatatggagtcagtaattaattgagagcctggctgagaagtttttcatgtgtgtacaaatatcgtcgctccttttttcatttggggtagtcttattggtagggataacatgggatattatcatttttcttctttctttctaatgtagtttctttagtttcttctacctgttaaggatagctattgaaagaagtgttgtttaaagaagtgtt

SEQ ID NO: 86945 - DNA, 1010 bp, Homo sapiens
gggtttggtttacaaagtgatgccaggtatacgcctaggccagagagctttcttctgctacgtaccagtcgattgtttgtacccaccgccttgtgagtgagcaggttgcgtggttcagtgcagcacattgtatcaagtaggtcaggagttacaacttcatgcacaaagagatggctcatttttagtcagtgaaaacctttcattaaccacagggcccaaggaggggtggatctggtaatcattgctaagcagacagagctagaggttcagacactgccgcttgtgtgccggcccctttcctctcacaccaaaccacatgttatgcacctgtttgtactccttgaaggcccttgaattattcttgtcatttttgcttactgatgttttcccccagctgtcagagttgggggtaagtgaatgaatgtgtcccactcaaattcttaacatagagaaaacattttcctgaaaatctttagttttagagtgcatcctttatctgaaatgcctacctgtaggtaccttagacttaattaatcctgaccatggttaagttgtcatcaaaatattttttttcaggggcccagctagttgtatgaaatagatccatgagcacttactatattgttaccccagcttatatacttagattttttgtccttaggcagtgatgaagttatacacactgcccccaccattctcttgattcctcaggctctttcctcctctaacgtaagtttccggtagtggccaaccagaatcagggcaagatgcaggaggatgcgaagaggctgccctcaaattcctgttgggttgtctgaagcttagaggtgtgtgttggagctgctgtgcaaatggcaatgctgtctgctcagagaggaccatcataactgagcctggaccttctagttcttggaggtttggttaggacttattggtaattaatgtaccaatgtttccctggatcaattttttgcttcatgaggttaagcctttttacttaagtataaaag

SEQ ID NO: 86946 - DNA, 1096 bp, Homo sapiens
tttccctttcaaaagtgacattgtttcgccttgtctagtcagctatattccttatttttctcaaacctcttgagtcccttctgccgtatactggaaattgtgtgcctgcctttttaagagtaggcacctcacgtttcaagttcaagtgcaatggaactcaccctgcagcttgaacagatttgagtgtttttgcagagggaggaccagggcagatggggagtgtcatgctcaataaatacttgttggattgagttgctgggaaggcagcagagtggggagagtaagccacacctcccccaggctcactcagaatggtctttcccacttctggtccccacatactgttccccctctataatacctctcttcagctacttacaaggcaaaaccccccgaagtgttagtattctctctttctttaaatcactggtctcctattcatcctggtcattgggcttgaagcccagttggtggcaaagacgtggcatttccatagatgtcattgctaggcctgtaggttcttttcccaacacacttatagctagagggtgagcttgggcagttaccaggtcgatccatggaaacagccaatgtgtaggattttgttatgattttgttaaaaagccagactgcctggctttaggctttgaagtggatatggtgagaggccaaggagaccaagatgaatgctaactgtcttttcactccaggtagatttttgccaacttcctagtagtgttctgtgtagcaagaagatggaggaaaacaaaatctggatcagtggcttttctaggccaaggaggagaattatctgttggccctaggatggcttcagaggtgtgatcaggctgaaagcgcccctctcccaagccagccaccatcctgtgatagcaggcactgctatttcttctcccaccaaccaccagatagggaagtgcaagaaagagatgcttgttaccacttcgcaggccctggacacttacactgttgtccacagagtctgtgttccttgccttgaaggctgccaaccatgtgtctggtggcttagtgaaaatggcttttttttttttttttttttttgagacggagtttcact

SEQ ID NO: 86947 - DNA, 1050 bp, Homo sapiens
tgtatttttattagagacgggggtttcaccatgttggccaggctggtctccaacatctgacctcaggtgatccacctgccttggccacccaaagtgctgggattacaggcgtgagccaccacacctggccctggagcccttttaaagcagtggaaaggaaaactttgggtgtcgctcccagttcagagcaaaggtagatgctcactagagagtgagttagtgagagtggacagtctcttcttgggttagtaagctctgccatcctttgagatgcatgttacccttctttgtcacagaagtgggaacagggaagagtggaagcaaagaaaggatgggtgggaaatctggtcagtttccccccttcgtctaggttcaatcttcacagagggctccattatttggtttgcagggtatgaattaaccaaacattagccaaatctactcacattattaggtcaaaaacaaatcctgatctcagggaagagttgtggatgatatttgaaatttctaagttatctgtgcccccattttctccagtcgtgtggagctcatgaaggggccgttgttgttggcaacagctggatggtgggaggttctcgtaacagctggctgctagtgttcgggctcagcttgtggtccccaccaaacctcctggtttggaaaactctgcctggcactgtgctttcccctcagggtcactacaaagctgaatgccaagccttgcagtcatttaaatgcttcccctcaggcccacatatgccttgatcgacccttactgtgtgggagcactgcagctaatcaagggtggctttaatgaacttaaaagaatgctatccaagtatttcataatagaaaaacttcaagtccaggccctgggggacctggaactgaagtccaggccatgtacagacatttaccctgccctgctcaggcatacaggtttgtggatttgctcaggagcccccgagagttgctgggggggtggaggacagatggagtgcctttagctcagctctgcctacacattagcagtttgagctcccagctccc

SEQ ID NO: 86948 - DNA, 1071 bp, Homo sapiens
gaaagccctcagcaaactggtccgtgtggctactggtgccagaaacagcctggagattagaagagatttccaaccgttctatgccaaggcatcatcttgctataatgaggcctgggggtgcagttaaaaccctttaagagctacaattccccttctaaaacctgtgattgaggcagcttctgtttgggaagcattaaaacaccagacacttcctagcccaacactgctaactgttgcttttgacagctttgccagcaccaggcacatacatggtcagcaaaatgcactgctgaagcatctggctcttaaatgttatcaccagtgatgacatccttgaatttggggactagctgcttaactgctttatctctttggtacccaaaggagtgtgagtccatgtgttcttcggtattttggatagcaaaggattatatagtacgagaaggtctcacttatataacatagagctaagagatcttaaaccatttgaggtcagtgtcagaggggtgagaacaacagtgggctgtgatggcaagaggactttgttctctcacattctagacatagatagatctttagaaagttgcaagcagtaatgcaaaactttcatagtgatggtgctaatttgggtgttaccacagtggttggtgggctttaatagccaagagaacactatgcctttattttctgctgaattcagtttattttgaatggtgtgatgggcatcagggccacactattccttgatcttagaagaactgttagagcatcttcctccagattcttagatgactcacatagagccttcctgctaaaggattcaggcttttgggtgtggcatcttctgaggggcaggtctggttatggagttcttactgacactatcacgtttgactctagctcaagtgttctgactagacctgcctgggcttaccgttactccacagacagtttggagcccttttattttatttatttatttatttatttatttatttatttatttattttatttttttttttttttgagacagtctcgctttgtcacccaggatggagcgcaatggcacg

SEQ ID NO: 86949 - DNA, 1929 bp, Homo sapiens
tctctatttaaggcaaactagcccatacatagttcagacccacatccttggacatcttagtcttgctcttgccaactgaggttactgagcccaatccaatctcagaagttaagaacgattttcttgctagtctggaaattacatgaggatgagtggacatccagtcattgtattatgtgcctagccttgccagcagatgtcactacaccaaaccacattttccaaagatatgactggaaggaaaggactggctttagaaaggctgagtccaacaattgtgaccctcttctccaatggcttccattaatacccctggaaaactatcaaggatatgtatatatccatggttcccaacagtcctgaggcctaaacttagcaggtcaagacccaagtctctgggcagagtcagagttcttatccagggaccttctccagattgggtggggagcacagctgctgtaggaagggcggcaggccatttaaatggggggtacacatgatagagttatctaggaaaaagagccatagtcttggggctgttccaaatgtcatgcagagctgagatctcaggcaaagcactccacccaccctccaccctgcccctttgtccacatgggtgggggctatcccttgcctgagggctgtaggctagggctgatccatgggttctgggggctccccagtgacagccaggcatagccacaccatgtcaggatgctgggaagttcctagcagcttagaccgtcatgactgttctccttccagacaactgtaagtagcattagtaatctgggagaaagaaccattggcagctcttctttaaagaccttcattccatgtgcctatccatggaggggtaaagacagaaatccttccctggccttcagtgtcctgcctggtctgtcttctggctaactcttcaggcccatctcacacaaacctgcttccttctcagtgccgcagcttcactggccttcctgcaattccttaggagtgtgcaggtttcttccttctcaggacctttgcacatgctctttactctgcctggaatgttcttcccccatattcttctttgcctattttcactaatccttcagatctcagctcaaataccattttctcaggaaaccttttcctgaaccctccaggctagatcaaggcccccactgccatgctcttattgcacactgtgcttttcttcatagcacttgtctcagtttgtaattatacatttatgtgtgtgttatttggattctttactttctgtctccccaacacacaccccagactgtaagttccatgagggcagtgtccattttacttaccattgcattctcaggacctggcagagtgcatggcacttagtaggcattcaataactattggatgtatgcatgaatggcaagtgggtaaatgaaggaagttagaaaacatagtgttactcttgtacacacatttatatagtatttgcatgtgaaatatagcgcctaattctggtcactctacctgcaaaggaagatatatcagagtcggggaaagtaatctgaattgatctaaatggagactactataccaggcaaaatgttaaaagattgtgaaaagatagaggctgaaatcatgatccatgtatatgaaaatataaaggagatacatgcagatttgttttcaaaatcccaaaagtcaacactaagggtcattttttaaaaaacagactgtggattctccagaggagggaccatgtgttatttatctgcatatctccagcacctagcatgatgcctggcacttaatagggactcaagaaatgtgttctgaactatttttgttgttagcttaaaagaggtagacttgggtggaaggataaataaggtagtatgcaattattcacttgggaaaccccagaggcaaaaaaagaaaagtatgaatagg

SEQ ID NO: 86950 - DNA, 1067 bp, Homo sapiens
atgttggctcactgcaacctccgcctcccgggttcaagcgattctcctgcctcagtctctctagtagctgggattacaggcggattccatgacgcccagctaatttttgtatgtttaatagagacgggatttcaccatgttggtcagggtggtttcgaactcctgacctcaggtgatccacccgcctcggcctcccaaagtactgggattacaggcatgagccaccacgcccggccggtggtatgtatgtaaaggctcaccaaatgcaggaataatattggtgccttgaaatagggccacagtcctctttcttaatttcccaaataccgggagttacttgaaaatgtacatttttttagtaacctgtttggcggcaaacctgtcttaatctgtcctgaggctacttatggtttttgtgtgtctcatttagtgtgactgtttatattttttgctgcagaaatactattatgttttgttattgggtggtatttgcaggatacatgcaaagtactccccttctaaaaatccaaaacaattacaaattctaaacacaactggccctcagggttttgaataaataattgggacttacagtgtgaatctttgtattgttttcagtaaatattttttcctttctggttttgtaaagggtatagtgttagtgcttaattgataaaagttatctttatggctaagaaagaactcctcaggaggataataattgacaaatccttgctcattgaaaagatggttttgaaaacaactgtttttgaatacccatgagtcttcatgtgcaagctgcctttttggaagatagatggctttcatgtggagaaacgtcaaggatagatggcatacgcactaacaattttcatctttttctgcttaaattcttttgggattagagttgtggtccatgatattttgagatagtgtatggtttttaaaaaatgtgatagcttttcatggagacattgaacaaaagctactctaagttaaatgaggtccagcaccaacgattttctcactacagtggacctttttttgtgatattgatctccaaatgg

SEQ ID NO: 86951 - DNA, 1057 bp, Homo sapiens
cttatttaggtttgaacttggggttttcagtgtcacagcttgttttattttcaatgttaatgcaaactctcagaccaaatgcttctgtgctaatatctggatctatggtattacagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaaggtaaaaaaaccttcatttttccttaccactcctcacatctggctgactggcccatcacattattttcctagttaatgtggaaactggccccttggcttggtgtagatgacagtgcaccagatgattggtaaaatgtagagtgaatgcagagttgtcaggtctttaacaatgcctctgtggggggctactatccaatctgtagacccaaaggaactgcggatggtataatggatagagacacacgtatgtcttgagtcatttgtttgtttgtttgtttgtttttttagatcgcagtgtctccatcagtaaaattggaatgttatcccttcactttctgtttgaatgtttgaggcttagggacttgaagtccagatggtatctgatttatggtggcttgatttaatttttttttttaactttacagtggtgctaaaacaatatgcattcagtggaaacttttagaattttgaatttcggtcttttcctgggccagtgatatgtgggccaaatattttctcatgttgctgagtggtggcaatgagccataataactccagtcagtgagccgtaactcccagtcagccatttgatcatgagggtaaaccagtactcttcagtgtactgtctttaataaattatatgcaatattcaacactttattaaaaataggctttgtgttagatgattgtgcacaattgtaggctaatgtaagtggtttgagcctatttaaagtaggctaggctaagctatgatgctcggtaggttaggtgtatagcggttttttttattttct

SEQ ID NO: 86952 - DNA, 2114 bp, Homo sapiens
tgttttatggtgggttagaaaaagggaagaatgagaggatgcagttaatatttataaagcactctgtaccacggatcatgttaagtgcttcacatgcattatctcacctattcctcaccacagtgttatgaggaatgtgctactagtattttccttttcaataggtcaggaaacaggcttggagaaaataacttgcccaagatgccacagctagttggtatggtggagtggagttgaatcaagttcagtcctaattccagaacctaaacttattaatgctgtactacattacatctgtatacctgagctaggctcttttgcttatattttatttaattaaatagatattttaaggatttgttggattttgtgaaatatgaagaggaggaggagcgatattctgataaattatatggataggaagtaaaacagatttccatcttttttctttattttcttttaaaattgggatcagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagaggtgagtgggtatggtatgacttagacctattacagagcatctgggtgaaattctttttaaggagggcttggggccactgcaggtagatgcctaatacttcagctagatgaatgctgtttgcttgcttcctttcttatgtctttttttttttttttgagacggagtctcgctctattgcccaggctggagtgcagtggtgcaatcttggctcactgcaagctctgcctcccgggttcacgccattctcctgcctcagcctcctgagtagctgggactacaggcgcctgccaccacgccaggctaattttttgtatttttagtagagacggggtttcactgtgttagtcaggatggtctcgatctcctgacctcgtgatccacccgcctcagcctcccaaagtgctgggattacaggtataagccaccatgcccagcctcctttcttatacattgctgaggacagtttgatatcagaatattctcaaggtccagagtagctggagtatattaaatcgtacctgtaataggaaaaagagactgggcccttcttaaccacatttgaaaagggcttgaagcagacttttcttatagccatacttctcagtccatttatctccaaatttcttaatgcagaggtcacagactggtgaactacttctagctgtccgcatggttggttggtttgcttgcacagtgtttaaaattttttaaatttgttgctagtatttgaaaacacaatgatttcatataaaaacctggattaatagtttattttaaacaatgaaaagatctgggaacactgggcggccaatcacccatagtaataattggctggagttgaatagtagttgtcccctttagatggacaatgagctgtctctttggccttgctgagcccctgtaggcatttggtttgcaattcctgatttagagtctggaatttcaagattgaattgttagactacaaacaggctcactcaagactctaagtccattcacatcttacaccaagcctgttcagtgtcatccagaaagataatcactgtcacttatcttctgtcctgtgtatctcctggaagggaagtgggatagtaatgttttaaaaacgtatttccatctagttttgattatccatgattagcaactcaggagaaatacagataggtgtaatagatgaagtacaaatttaattttaatcagaatttaaagttgcacaaaatggatggtgtagaagtgcctcttcattttccatttagccatctagcagatgaatagctgaaagttactggttaaatcatagaaaaagaacctgggaagcccataaactctgaatagtaaacttctaaataaatgaactccactcataacttctaccaattgcttttgctttagaaactaaaaatacagctgatcatgatgagtcaccgcctcgaactccaactggaaatgcgccttcttctga

SEQ ID NO: 86953 - DNA, 1019 bp, Homo sapiens
tgagatgatatatttttattacatttagaaccctaagtggaaagattagacaaattccccacatttattaacagctctagtgtttttgaagaacctgcatatacatgattgctcttgagtttcccaggacacccttgcgatcagtgatgttacatttgtattcagtcatatatttctgtagctgcatgtgccaaatacaggtatctgaggattcagtgaataaaagactgcatttaaggagctcatgttctcacagggggaggcaacataaaccttcaaattaataagtaaataattttgtgtagtgataaatattgtgaggaaaaaaagacgaatgatatagagagagtctgtttcgggggtgagggtagggatagcactgcttttcccaggatggtcctggaagacattcctgaggagatggcatttgatctgggacgtgaatgatggcaaagaagcagttgtgtaaagatctagaagaaaagatatcttaagtagaagcaacagcaagtgcagaggccatgaggcgcggctaaactgatgggtttgagaggctgaatgaaagtaggccgtgtatggctggatccagatcataaaggaccttgtggaccttggcacaggagtatatttttgttctgatagaatgagaagcatttggggggctttaacaaaggcatgacaggatttcaggcacgcttttgaaaactgaagacttgttaacgtggagaatggagtgtgggggcaagagttgatgcagggtatagggtgcttgggaaactgcatggaagttcaggcagtagttggtggactggactagctttgtatcggcagcaattctaagactaggttggattcaggatacgttttagaggggagcaacccgttaggcttgctgattgatttgatgtgaggtgtgagaaaagagaagaatctaggataacattcaagttgttgactggatcagctatttagacagtattgccatttattaatactgggaagatttggggtagagcaga

SEQ ID NO: 86954 - DNA, 1121 bp, Homo sapiens
agaaaggatgctgtctcacaggcaagatgacaacaacaggcatgcaaccaggcaccaggtatgggccttgttaaagcactggccattcatagtttgaggtccgtttcttggatctcctctataattgtcttcaggcatgtctgtgcctcatttcctgtggtatatcttccagatgtaaacttagaatcatgtttgtttttcaaacagtaaattttcataaaacaaacacttctacctcatgaatgaaggaatcatgctatctacagtagtagtaatagtagtagcagtagtagtagtagataattctgattatttgaaagattacacttgctgcttcatttcctcacttcgcatcctttaagactattgtagctttcaaacctctccactctgctagcacctttccaaggccaccagtgacttttccccagcatttgacacttgctgactgtgttatttgtcttctacttatctcttcccttggtttgtagggagcatcctggcttggtcctaaacctcctcctgcctctctgaacattcctgccacattggttcacttacttccttgttcttccctaaatgcctttggtcttcactcttcctgttttcctgcctggaacgctatacctgtaccaagaacagatggtattttctttcaaggcccgtgcagttctcagctgttggaggaatttttcccaaattctctcccaccgttaaggaatttcttccttatgtattcccattgtagtgctctcaaaatgttagcctttgtgacatattatattttgttcatcatttaggtgtctgtttttgcagttagattatagttggatagcagagatatatggtgatgaggaagaagtttgactttggagccaaacagatgtgaatttgaatactgattatttaactctagctatgttgtcccgggcaggtcaactaacctatttctttgttaataagaagaggtgaataatgcctacctggcaggggagtcagctaaattatgtatgtaaagtacctatacccagtgcttggcaggtaaaaagcactccataagtggtaactacacttttcttcgttgtctatcttaggtttaatttaatttaatttatttattt

SEQ ID NO: 86955 - DNA, 1056 bp, Homo sapiens
aataatacaaatgaataaaataaaattgccatatgatttgcattgtggctagaaaatttctggcatttttttctctttaaaatttttttacatgttttggtaccttcttttttttttttgtttttgtgccagagtctcgctctgtctcccaggctggagtgcagtggcatgactggctcactgcaacctctgcctcccaggttcaggtgattctcccacctcagcctcccgagtagctgggattacaggcgtgcaccaccatgcctggctaatttttgtatttttaatagagatgaggattcaccatgttgtccaggctggtcttgaactcctgatctcaggtggtctgcctgccttggcctcccaaagtgctgagattacaggcgtgagctactgtgccgggccttggcactttcattttgaagcttagctttataaggagttttctctcagttttctcctttttccttttaggcaccaacggagagacagcttcgatataaggaaaaagtggctgaactcaggaagaaaagaaattctggactgagcaaagaacagaaagagaaatatatggtgagggaaagttaaatatttaatgagcatgaactcctgctatcacatttgattccttttgctttctgagcttctgcctttcagatttgccatttagtattctccacatgtgaataccaattgactcttctatggcacttagagtttatttcatcccccaaaactgaattgttgagagtggaaacaggaggtcttgggaaaatgaaatacaattagaatttaaattttaaaaaatttgatcctctagttgttcataaattttactttcatcttaaagggttaaatttacccgctagaacacatgccatggcactggaaatgtctgtatgaagaaaaatattcaagcttaatagtagtctgcttattttaatggaaaaatagatttcctccatgattaaaaggtattaattgggtgaatattctgtaatagaccttcttgtagtattttaacatttttttctaactttagaagtaatgtacatt

SEQ ID NO: 86956 - DNA, 1065 bp, Homo sapiens
tgatttttcatgtagctctctttagtgtaaattctcatggatagaagccaaatctgtctgatttttttcatagcctagcgtggtggcatgcacacacacttttaaaaacaaagataatatttatttttttaaaaaggagtttcgctctgtctcccaggctggagtgcagtagtgcgatctcggttcaccgcagcctctgcctcttgggcgattcttctgccttagcctcccaagtagctgggattacaattgtttgccaccacaccttgctaattgttgtatttttagtagagatggggttttgccatttcggccaggctggtctcgaactcctggccttaagtgacctgcctgcctcagcctcccaaagtgttgggattacaggagccactgtgccctgtctaaaagcaaagataataaattctgatcctcctttgacttttgatttcttggcaataggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggtgagttgtcttgggttcctctgccttgaccatgatggcaataagctgtaggatctctagattttgccatagcgatggcatctgttcaggcaccttctcagtggtcctcagcagtgggatgaaggcataggaaatgacaggccacagcttaaggcggggtatagagcctgaggtatggcttgtgctgggtgccacccaaagcagctgagggcccttacccacatcctgtcatgtacatcttcttgtcttttgttcttgctgcctactgctcttcatttcctccttggaatatgaattacctctgcccacaggttttgtgtgtcccaaactagatgaaaatacagacttcattaggcacagcagagacagcatggctcaccttcatatccctagcaactagtgtggacaactgat

SEQ ID NO: 86957 - DNA, 1327 bp, Homo sapiens
ttgtgagtgggttttctaatctgaacaaagaaggccatcatggttaggtggtaatgagaagttatgggtaaaggtgagagtaaagtacttagccaccctaagctgctggaaataagctgcttaagaatttcctgttggcttgaggcatttggtaataagcaagcgtattgttatttatttggcctttatgtagtgggtgattttaatctcctgggctaaagtagtgccagaatgtaatccagaatacttgttccagattgctataaaagtgtcataaatatattcaaatgactttggaagcctttgttttatggaaataaaatctctgttttgctgtatgttctcagcttgtccaactgtccggtagctcagttaaccacatttgacctgtcattccttttcccttttgaggagcagtcttgttgggaggctttggttccctgatgtgaatttcattgtcttgcaggccaaatgtgtgtggaaacacccacctggtgatgagatatatcgcaaaggttcaatctctgtgtttgaagtggatggcaagaaaaacaaggtaaaaagtggtgactttagaaaggagttgaaatgttgtatattcacaggtttcagaaggcatatgttttttctccatcacaccttgtgaaggacatagaactcttctcttgccaaaatacacaatgtgtttcattaataattatggtatgtttgtgaattttaggcctttatctgtttaggaatcagtggcccacacatgaactctgtttctctgcttccagatctactgccaaaacctgtgcctgttggccaaactttttctggaccacaagacattatattatgatgtggagcccttcctgttctatgttatgacagaggcggacaacactggctgtcacctgattggatatttttctaaggtaagcaggatctggagattaagaagccaatggccagagcagggtgatccatgttcgcagttgggggctcaaatcactgacaggaagaagctgtactctgggcaatgatgacaccccttccttaaattaaaaaaaaaaaaaaggcaaacccatgtatcaaagattgtttaatgaaaatgcagtttttattaaaagcttctggttcattcatttctagaattgtggactggagctgcctattaataactggccagagccctccctagtaactcacaagcccacatcttgtagtcaaaccagttctgctggctttgcctgcctctatgttattagcttaaaaccaggaatatactctttttgcctgattgtttagctgggctccttctagcacagtgccttcagtgata

SEQ ID NO: 86958 - DNA, 1144 bp, Homo sapiens
cttcttgccctactctgtggctgtcaggagcccagagtcagcctccttaaaatgacactggaggtctcaactagggaaatcctgggatgattaatggctttggccatgataaagggtgtggttataacagctgtgagcctggcagccactccttgggactggttagccagatgttttgcaagcagccttattttgcatctgtggaagtgctgaaacctttggtttcaaatcctcatgacgtgttcatctgtttgctcttgattttaggaaaagaattcattcctcaactacaacgtctcctgtatccttactatgcctcagtacatgagacagggctatggcaagatgcttattgatttcagtaagtgaaactgctaagtcattagttccacaaggcagggaccatgtgaatattgtttgtctttttgtcctgtggtctctgcaattcctggaatatagtgaaggtacatggatatttagtaaatgaatgaacaagtaggaaaaacctgaacattgtcattctgcctaatacacattgaacattgaaggagtacaggactcctccttaatgagtaggaggtacagaggatgataaagtaagctctttaggattatcccagtttgagacttttaaacagcacatacatgcatgaggcttaaaatctggtccttgatgctagggatttcacttttgtagggacttgtctagaggtaatccatgtacccaatggaccctgtgcataatatactctgccctcattaattgtggattctgtctttgtgaatttgcttactcactaaattttatttgtaaccccaaaatcaatcttaacatttttgtggtcattcgtgaacatgcacagagcagcaaaaagtaagagtcatggatgcacacattcccagctgacttcagagttttcagctcttacactgtaaacaagttcattttcagtctgggaatgccacatggttttcgccttctgttgattttaaatggcccctatgagtagtactgatgtgtctggtgttcctaatctcaggaatacctggggtaccttacaggggttaggtagctttcttcaggtgaattagagagttgctggcagtgagttcaatgttaatgatatcaacagtgtatattaaa

SEQ ID NO: 86959 - DNA, 3973 bp, Homo sapiens
actacccacagttttgggcctccactgggagttttggaacacattccctgtgaataagaggggactcctgtgtcatgtaaatgcaaatacacattcttccccttttgtttatacaaaggcagtatactatagttaaccacacagtattccattgaatgactaaatcctaatggagtggactgtgcttcttaaaccttcttccatgttggcacacagttttttgctattaggataagatcgagtgttgctagaaaaagtctgtatttgttccctggcaggttatttgctttccaaagtcgaagaaaaagttggctccccagaacgtccactctcagatctggggcttataagctatcgcagttactggaaagaagtacttctccgctacctgcataattttcaaggcaaagagatttctatcaaaggttggtttttgactccttggaatggttgattgttacccaagaagttaactctactgggtattgtgtttcccctgaatgtgagaacggaaggcccactgaatatggaccactgcggagaccctcactaaagctgcctaggaatccaaagcatttggcccctgggaatggttattaattggcttctcaaatccagagttgccaacactttaattcttataaaagtcaagaagcaaaacttcagatcgtttggttcatctttctgagaaagacatccctgtgtatttatgcaagggtggaacaatttagtttgatctatatttgatcctgatttctaaggggccaagagtagcttcttgctgtaatatccttttgtggttatttggactggtcaaatgaatactttgtaaactccttctaaacagattgggttgagtacagaagattctgtccatttggatttcctttaagggaaagtagaccttggttgggggcaaaggggtgggaacctgcactttggccaggttgtcagtacttcttctgtttcagaaatcagtcaggagacggctgtgaatcctgtggacattgtcagcactctgcaagcccttcagatgctcaaatactggaagggaaaacacctagttttaaagagacaggtaaggttctcatcaggggcttgctcattgctggatgtccttcaagacttagcagagcaaagtatgggccttaagactggagaaccttcccttaaaggagttgggctacacgccccttttactgggtctcatttctgtagctggcagtgatgcctgtgttgccttatccttatcagaaggttttgataagctcctgtctcaaatttggatgacacaagttaagcagctccagttaagcagctttatgttgtacagcatttctgtcatttgatgtttttcttaggtgggaggaaattgcccatctgtagaggaatcttcacaaatgctgtctcaactcaaactcacatctaattttttaaattatttcatatatacaataaaggtcggtgagcgatgattttcatttctcactgagggtaaagtaggaagaatggattagataggaaagcagtttataagtcaaaatatagtattttttttgataccctaatatgttgttaaacctttggcaattccttcttggcggttagttattttggaatctatgtaaaggcacttgagttgaaagtatgtaatcctttttcccattgttctccctcaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaagtctgtttcatctgggggctctcatttatatatgaaaatgatgcacacgatctgctactaatagtaaatgcacttgggatttgctttccctagcagtaaactgttgagggatgtggtttgtggctatggaatgtttttccctgtgatacaggctgtctgtaaagatcaagggagtgctcactctgaacttctctagatggtggcacaaatttgatctgcctcactttggttccagctaatcagtatacgtagcaatgattagtcagtattacccattctttcactaagtgccattttccactgattttaggggcaaaggaaccaataggaaattaggatatatgggggtacagttgatgcctgtaggagatgggaacagacattccttctcatctccaagctcattcaccagtattgagcagtgtcacctctaattattgactctctcgcaggttgaaattattctttttgaaaatagctgcattttcatgtaagatatacccagcacaggaaaagggtggctgagcactaacctccgtatggtggaaaggaggaggctgggaattgtatgtgctggaatggtttcactcactgtgac

SEQ ID NO: 86960 - DNA, 1026 bp, Homo sapiens
actactttgctgaatgatagtatgtgatgtgtgctaggacttctagaagccaccctttgctttgctgttcattgggatcatggaatcggacctcagctggttttgcctcagcactttctttcacaaaattatgtgtgactgcctcctccagactgtttcctgctgataggggcagtttaatagccttcttcctgtgtggtatctgcaacaaaatcccaatgaatgtcaccaagaaggaaacaaaggattgcccagcgatgagaaatgtccctggtgccaaaacatcagtttgcccctaacctcttgtgcaatacctttaagtccaggtcatgttgttaccatttgggggtttgcggatttgtttacttgtgcccaagaatggagaaaataacctgtactattgtacaactctggctccatggctcctcacaaatgttccatgtgagatataaacatctttatcctcgacaagtcatgttcattccaagaaaccagtctttgttcttaattggacatttgtttctgcaaacagcttaccatacattcaattccaaagttatcagaaacctacactcttatctcacaaatttagaggtgtggtagatcatctccaaagatggccaccaacagttgctctcatcctctgtgcacgtgctatttccaataaggtctatttttttctacagtgagggctgaacttgtgacttgttttgactaataggatatggaagtgatattttggcagcttccacttttgctcttgaaaataagctgacacgtttccaaacgagaagcttgggctaaattactgaatggtgagagacgatgcataggagaaccaaggtgctctagtcacagcactaaaagcccagacttgtgtctcttgaaggtttcaaccccgccagactcccagctgaacgcaccctcatgagtggcccttgctggtaccacatgacactaaagacatctagctgagtcctgttaacccagagaattatgagaatactgttttaaccacacgttttg

SEQ ID NO: 86961 - DNA, 1040 bp, Homo sapiens
ctgccctctgctgtgcaccagagaaggagccattcactggtcactcatttattgagtgcctactgtgtgctaggcacaggatacagagtgtgcgagtctcctcactgctgtgcagtgagatgccaactctgagtgtgagggagggcagagtcagtgcagcttgctacggcgaagctgtgcatttatgcaggactgctgcttgacactgagagtccaggaagaagcccagtgggttcagtgtgggccttgtgtgaagtgccagcgatgaggacaggagacacagagaagagagttggcctgccggcttgtcagctgtgacatccaggtaggaagaagcggcaccgtgtcctctgggaagtctgtggtgggggcttttactctgaaccttgggcctcatcctctctgcctggggagagtttggtatatgaaccatggttagtcgggggtcttgtctggctcctccacccttagaagtcttccctagttgcattgaaggccttcatcttcctaacccctctctcctttctggagatatctagggcaatgggattacaggctcatctgtcatatcttccattattcaattgctaatgtctccagagcatggatggagcccaccctcagttaccctctttaaaggtggggaaggctatccaagagtcctgggaacatggcgggtgacatggactaggaagcaggagacacagtttagtcctggctctgttatcggctcactgtgtgactttgggccagtagctttccatctctgaaaaatgatgactgactcctagtattcctgcccacaccatgcatggaggaacattcatctctatttgttattgaggtgacttccatggctattgaatggaatgagtcgagcaggtgttctttcaggggtgctagggaggcgaggggtccagaagtctgcagctccggtggaagaggttaggcactagggaaggcagactggagctcagtgtctgtgacctgccggggcgcccactgcccgctcacttgagctgtgacctttccccaacctg

SEQ ID NO: 86962 - DNA, 1042 bp, Homo sapiens
tcctagccctgctgccctctcctcactgcacacacttccaggttcagacaaaccggaaaggaaacccaccatgcaggactgtccatgtgatggctcttcccgtggctccatttctaagcgcctccgaggacctcatcgtggcccaggaccgcaagccaaggccaccccagtgtccttaccatcctgggaatgggaggagtcaggcccagccttgtcctgtctgcccccctggaagccttccctgagcactggcctcttatttacccgtctttgtctctggcttgttggtatctgtcccttgtctgattagggaacgcctgaggtcaggatctttgcctccccaatcagattgtcaggcaggagtgggggtagtgcagatgctgggtcatttctacatgtgagaccaaatagtggtcctgtttaagttgatccccttgaaagaaaattctggaaaagctcctcagatgcacagatacacagaatcagaccttgggcaaagtgtgtagttgtgcttttgaagctgtgcaaccttggacaaactacttgacttctctgtgcctcagtttccttatttgtgaaatgaggggtagtcatgataccttccccatgaggttgatgggaggattgagttaatatttataaagcatttcagacagtgccagagatataccgtgtgttaaataagtatttcttacacacacacacacacacacagacacacacacacacacacacacacacacacacacttcggaggtctgccaggccagggctcatagccttgaatctacccatggtagagagtcagacaacttgccttgcagactgcctgctctcccagcagccatgcaggggatcttctgcctctgcactgccgattatcccctgccctcgtcagagcctctccccaaaagtacctccaaggccacaattacccaggtctctgcttcagtgctgagtgtctgttcctctccaccatcacctgccacagtgcacacggacagctccatcaggagaagcagggcgaggcaaggcagcatgg

SEQ ID NO: 86963 - DNA, 1066 bp, Homo sapiens
ttctgagtctgactcttctgcagactcggatgcgccctctggcaagtcatctcccatctgctggaaacttccctactgtgaatcccacatgtatttgatggtcaccttgaattcagccatctcatacccaaaaagcttcgggacacaagcctgctctggggtcagcacacctcatagttggacagcagggtcaccacacctctcttgagggcagtgggcagggccagctgcgtgagctgtggctccatggagtgggggaactgctccaggggccctgagtccaggcttgcagtgaaagctgctttgttaccagctcgggcgtagtccatttctgtgtatttcgtaaaccattcattcacttcctcctttgtgcggttggtgaacaggagacccacttcacccctcaaccttttgctgacgtggtgcaggttatctttgttctcatcaggtgggctctgacccagggccaccatcatcaccttgtttttgccaaagaacatccagctgtgctttcaggtgttctggatgtccctcagcctgttgttcctcatgttggccacagagaagatgaaaaggtactgtaggtgtccacacatttccaaagctcttctatcaggttttgtttcaattccaagcctttcttggcagttttggttaaggagactttcttgtcacacttggatttgggcattgcactgaatccacgtggaagaaccatttttaataggtaacttgcaaatagcatggggcatctggaggggcagccatctgcctgctggagccggggagggcagatctgggctgagactggaagtatgagctggcacttgcccctcatacagtgactagggaaggagaggtcgtctgagacctgggaaaagcacagcaaaatgtgtgttctgggattccccacctccccacggtccagggctgtgtgaagacagcagggaaccctggagtctcaggcagaggaagcctttgtgggtcatgctctggggtccagcagcaaatgggcaatgaagcaagccgcccctaaacagtgtggggtccaggacaagagtacaag

SEQ ID NO: 86964 - DNA, 1028 bp, Homo sapiens
tgccaccctggccccctgccagcctccctggccaggaagcttcaccccttctcccaggaacacttccccagggtgaggtctgagctgttgtcttgaagtataggcaaggtcccacccccttcccagcacccgcaggcagtacattcctgactcccagtgggtggagataccccaggccctggcatgcccaggccctgcactgccctgccctgcccagcccactccctgtagcccacactcacaggtcccaggcagaagctacaggcgtggctgttgcttggcacttccagactggcaggaggcccagagcccaagttctgagctgggagctgtagagtgatagagttgctggggccaaatggtggggcacctgggaggtgcctgccacccgagaaggccagggccatcaggattgagcaggggctcctggcagaacatttagaggctgcagggaggtgatgtggggagaaaatctgctaaaactgagttctcaaactggggtgcaccagattccaccagatggtgtgttgtgggcagaggaatctacctttttaacaaagatccccggggtttctgatggcccaaggcttgtcctctaagatggcatttcagggccaacccctgcctctttctgctccagccacccctctggtatgggacgggttgccagggtcctaagcatccttgcaggaacttgctgtctgcatccccaaagatggattctgggcaggctgggagcaaggcaagagccctttccctccccacctgctgcccacccactgggaactctgctctggggccacattgtccaaagtgtcaggtacttatcccaacccctacctgtgtgcctgtcttaaggtaactggggaaggatgttggacatcacccaggtcgcttaggggcccaggtctccaagatctgagtctccacatggcttcaggaggaaaaacccagcgttctgacaacccagtcccctaagttctcccctctgaacccccagaatttgaactctctgccaggattcctca

SEQ ID NO: 86965 - DNA, 1050 bp, Homo sapiens
gtggggcttggggagtctgaacccggacccacctccgtccctatccccaggctcctggctggtgccccccgggagctcgctgtgcccgatggctacaccaaccggactggtgctgtgtacctgtgcccactcactgcccacaaggatgactgtgagcggatgaacatcacagtgaaaagtgaggggaaggggctggggaggggtgctgggtcagaggtctggcaggggggtaccgcagagagaatggcctggaggagatagaaggcttgttcacacggcttctagtcgcttcttgtccagctgggaagagggtgccctagaggagagtggggctggatgggattggtagagctcagaataatgacgagctggagaaggggagttgggagggctgccctgtgggtggagggcccaagcgggacccactcctgccctctggagactttgggcactgaagtatgggtgaggtgctctgattcatgatccttccggtgcccacagatgaccctggccatcacattattgaggacatgtggcttggagtgactgtggccagccagggccctgcaggcagagttctggtaagtgggtgctcagtgttggctcctccacctctacccggctctcccctcatctccagagctgggaggaaagaagagggcagcaggggggtccacggcgcgtgtgtgctggggcctgcacacatgtcccttcctgtggctgtgtgtccctcgctctctgcactcctggggagggggtgagtatcctgtgctctcccaaacccccgcacggcctgagttctctgactcatccacttcctccgcatgcctacactgggtgctcagccttcgtgggaacaagccgagggagccgagggaactgcaaggaggagaaagggcagagagggccccaggcagctcagcgctggctggcgctccttcctgggaggctgactgccggaagaggcccagccctgctgaccccggctcacccagctctggtctgggggctaatcaaatgtgtcacctcctgcccacattctatagtggc

SEQ ID NO: 86966 - DNA, 1050 bp, Homo sapiens
tgatggagacccttggggtggggatggggccaaagggcttattacctccaaggaaagtgaggagtgtgggagctcttggctcagcccacctctgggaaaaggggtccctgagtagggagcaaggtcagtccctctctgggacatcagggtggaaggggagagctcaacctggagaccctgtggatggggaggtgaagggacttttgaggaggagaagccctgtctctcctcttggagggtcaggatagtaggaagtcgcaatttggcgaccggactggagggagttcagcctaactgtcaggttttcagggtggggggcgggtccagctcttctctggggttcagggtggtgtgaggattcagctggggcagggagcagtgcagggccgggctcagctcaccctctctccccaggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtgagtggggctggcgcctggactggaagaccaggggccagaagggcggtggggcgagagggcactggggggggtggtgcggccttcacacctccggccaccccccaggtccagttccagaaggagtgcgggcctgacaacaagtgtgagagcaacttgcagatgcgggcagccttcgtgtcagagcagcagcagaagctgagcaggtggctgtgggccgccggccgcgttaatcggccaagggtgggacggggcctcattaactggcagggtgggggcggggcctcatggcaaggcgagcccagggacagggctttagcgggaacaggtgggatggtcagaaacggggctttctcctccaggtgcgactagaggacggggcctggctgtcccaagatgggcttttctcacctaggagaccccaggggcggggcctagttgatccgggagtgccctgggggcggggctcttggctgagtcctgggc

SEQ ID NO: 86967 - DNA, 1052 bp, Homo sapiens
tgggagagggagaggcctggcactccttcctggtggctcaaactctggatgctaatgttctttctcttctccctccaactccagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttct

SEQ ID NO: 86968 - DNA, 1034 bp, Homo sapiens
ccctgctcactcagcttctgtgtggccgtctgtgacagtcacctgtcttgaatctgggcccccgcacctcccacatctccccagtctgcacagatctcacctgtcggatgtctctctgtcacctttcctccatcttccctctcttctgtagctcccaaacccccaatttctacctttctcctggtgttgtccaacttgtcagcacctccctgttagaaaacttgagactcaaaggagccgtggggcctgctctgacttcctggcccctgagcggaactcctctctctgcccaagcctccctcccgcattcatgattgccccattcaccccacacacacttcttacctcagtgtcccctcccacatgtcccctcccagctctgggacccctgccatgtgaccccagctccacacccttccctccctgcatcagtccctgcagctccaggaggcccctgccagcctcctcatcctcactgccttcctgccccgctgcaggctggctttggttatgggctccccatttcccgcctctacgccaagtacttccagggagacctgcagctcttctccatggaaggctttgggaccgatgctgtcatctatctcaaggtgagggcccttcccgcagagcccagctggagaagagctttgctgataggacctgggcagccttggccagctgcgagctttcctttccatccccccagtccttccctggccccagactctgagaatccaagcaaagctacagttcctcaacctgaagaaccctcaacccccagacacgcactgcttgtcagggaatttaggggagtctgtggtctatgattaagacccctgtgctgggaacccttgacttgttagacccagaaggaaggggacaccctaggtcttgccattcagttcagaggagaagactgaggcccggagtccgtgacttgctcagggtcacacagcccagcctcctccccctccctctccctcccttagagggagctgcttgcttgaatgggcaggagcgggacacaggag

SEQ ID NO: 86969 - DNA, 1055 bp, Homo sapiens
acatagtacccacagaccccctcacccagacacatagagacacccactctacacagacacagtcacagagacaatggacctgtgcttcacattacactcgaggctatcagcctggatatgcagacccactctgcacccatctgctctgaaacacacaggcatggccatcgatcagaccacctggtctaggaagagtgtcacagggcatgcatattctcatctgggcaagtaacacagaggtgctgatgccgaccccagatggagacacgtggcacacacacacacacacacacacacacacacacacacacacacgtagtatacacagatgcttacacaagcatgtcaggtgccagcaccctcacaggcatgcagatatacagacttcatattaaaagtctgtatggggcctctgctgggacctagactataggagtcccagtacctatggggcttctgccgtggtggggagagacagatctataggggtcttgcagacatgggagtgtgtgtaccctcccacatgggggtatgcaggagaggaggccagggtttggatggctggggcagaagcaggggcattcctggcagggagaggagctccatggagcttggagtctggctttgaggggaggccagtcaggaggtggcagcatgcctgtcggggagaggtggaggcagggctggactgccaggatgggctctggcttgcagtatcctgcctcccctctaaagactctggccttggtcctacagatagcatggggtatgtggccattgggatttttcggaaagccactgcctacaaagtgggagggcatgaaagtgggcagtgctgggaggcaggcaaactggttaggggcccagacagtgtcctggcaggggtaggccaggactgctcagagtataggcagagggtctggaaaggaagggtaggtgagcgctgcatttccggggtcagagtgacaggccatgttcctgaggtgtatgcagagtatgaaagggaggggcacgccaaaggtctgttagtgcattctacttacagacatcctctg

SEQ ID NO: 86970 - DNA, 1032 bp, Homo sapiens
tcttctccatcctctctcccctcctcctcttcccctcttctgctcagcctgttccttcctctctgtgtctgtctttgtgtcccctctcgcctgtctggctctctgggtcctatctctcactttccctctatctgggtgtctgggttcctgagttggacgtttctccaggattccccttctgtgcctatggcagaccatgctcacgctggttggagctacagagagaatagcagtgcgggtctgccaaggctgggtccctttctgtcttgaccctgggctccagaactataagggcctttgttttgctcagagctggggtctcaggggactgggtgaggcctcatctcagggctatcatggggaggcatggggtgggtaactcagcctgcctcctcggcctcctcatgccagttctgcacttgtcctcctgccggcctctctgaccagctgcctccctccccaggtgttcagcacttactccaacgaggattacgatcgtcgcaacgaggatgtggatcccatggcagcctctgctgagtacgagctggagaagcgtgtggagaggttggagctgttccctgtggagctggagaagggtgagaggccaggaggccacgtcacttgcgcacagctggggttgacccgggtctcatctctggcaccagctcctgccctgtgccctcaggggctcccacagacttgctgggcctctccctctgactcaggcccttggtgaccttccccgctcctcccttgtcagcacccagagcaaacagggcctccaacccaggccaagccacacccccaccaccccggtcatggaaccacatttgcacattcagttaacaggtctctgtagggtactgtgtgctaggtcctgggctctgtgttggggacacagtggtgggctcctggggagatggatgggggaggcagacatggaaggcacagtcacatctaatctcacccttaggcgctggaataggggctggggaaggtaaggaggggccactgtaaaagcgtttaacaggt

SEQ ID NO: 86971 - DNA, 1329 bp, Homo sapiens
caaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccc

SEQ ID NO: 86972 - DNA, 1488 bp, Homo sapiens
agtgggcaaagagaggaagaatcctgaacaaacaatctgatctagctttggcctctctgctccccaatccgtcctcccctggctcagcggctgggaggagctatggcatgtcctatggaaagaggctgaggctggctctatgagccgtggggccagagccagcagggagggtggtgggcctctcctccagagctggggttgttcgggcttctggcagcctttctcaaaccatttcccccactccagggtccccctggctctgctggtgctcctggcaaagatggactcaacggtctccctggccccattgggccccctggtcctcgcggtcgcactggtgatgctggtcctgttgtatgtagcccctcatcccctctgctcatggccctccagcccccaaagcacttggatgccggtaatccccactctcttccctctctgtgcagggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggtgagggcctgccctagcctctccctccctcctactcctgccatgccagggtccccatgcccatatgtgcccctaccatatggtgctggctgctccctttccctgactccatcttgccctgccctaccacaggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccaggtgcgtgagctggacctcagagccagtgttaggagatgggctagcccagtgctcagaagggacatgaagtcctggagtaggtctctgctaagggtgatggacagagctgggctgggaggcaggggtctcaggtccctgatagtggttcagacacaggctgccgatgggcaggtggtgcctcctctcgatataacggtgcattgggcagctctctgaggaccctggacagggaggccaggcaggactagaggttcccgcatagcggctcactcttccctctctcccctcccctgcagttcgagtatggcggccagggctccgaccctgccgatgtggccatccagctgaccttcctgcgcctgatgtccaccgaggcctcccagaacatcacctaccactgcaagaacagcgtggcctacatggaccagcagactgg

SEQ ID NO: 86973 - DNA, 1074 bp, Homo sapiens
ctcctgtctctaccacgcaagccactccccacgagcctgccctcccgatggggcccctcctattctccccccgccctccccctctcaccctgtggtttttatttcacttggcttcagcgccaatgggctgaggttggagttggaagccaccgcggactaaagctttgtttaaattcctgagaactggaaagagttacagcctccctggccaggcgcctcggcgctgtcacccgcgctgatgaggagcaggcgagcttttaaggatttgaggaaagaagaacggggggaggggcgggaagtgaaaaatccaagtgtgcctcttagacccgggggaaaggtggttaagctgggggttgcagtcactactgacaacgcccctcttccgcctgtcccagtcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcaggtgcggctgcgctcggggcctggggcctggggcctggggcctggggcctggggctggggctgggggtggtcggcgctcgctggccctccgtgctggaggcctctgccgacgggagcagcattagcaaaccttggctctaacgcgcgtctcttcgtcccctagagtcacccaccgaccaagaaaccaccggcgtcgaggtaatctcctgccctcgaattttgcccctgcgcggcccgtgactcctcacagtcctcccttctctaacctggcctcttgtttcttctcccccaatcccacagggacccaagggagacactggcccccgaggcccaagggtaagcgttgcactctgggctgtggggggctgcaggtgggcatggctctcggccccacgctcaccccggccccgccctctccccctgcagggacccgcaggcccccctggccgagatggcatccctggacagcctggacttcccggacc

SEQ ID NO: 86974 - DNA, 1035 bp, Homo sapiens
agggtcctgggagctgcgcgagctgttagggtgcatcttaggaagatttctgggcaggctgtggaggatgggttggaaggtaatcagaacggaggtggagtgacctcttagaaggctgccacagaggcccaggtgagaggtgatggtagccaggcccaggccagtggcagccaggtggaaagaggtggccagactgataagagatttaaaaggcagaagccagaggacttggtgactgatgggcagaaggatgggggccagtgatctgctcaggctggctcctgggcttctgaagaatgaatgaacgaatgaatgaatgaatgaacaaacgaactgggaaacagcaccagatctgaaagccccaggtttcagcttgatcgtcgggctggggagtttgctgctgcacttgcatttggtacacctgcagggcatccaagtggaggtgcccatgagatggctggacgcatggaggtgccctggagaaggtggagagagaggaagccggcacagcctgcaaagaggccagagaatgagtagccagagcccctgaagcctcacaggaggaggtcttagacaaggcacagccaacagtgccaatggcaagagatgaagcaggtgaggcccaagaagggacatgtgttctagggacccagaggcttctccctgtcccccagcctttccttctgtctgtcccccagcccttgcccacccctctacgctccctcccccggtctttcccctatagtactctttctctcgatctcctcctcgtctctcagaccagaaggctcaacatctttctaagggaaacttcgtgctactcccaccccactggggtcctggttgccctccctagcttctgaaatcaccccccacacccccaacaaccaccacatacacctttcaccagagactcacccagcgcttccagaagctggggcaaagaggagcacacacgaccacctgcctactgagcagctcacacttcctccaatggagccaccacaaggtaccggcctccagggcaactgcagg

SEQ ID NO: 86975 - DNA, 2119 bp, Homo sapiens
aagcacttgcaggagttcctggcacatgctcagctgtcagtaaataaataactcttattatcccagcactgtgcattgggaatacgattcattcattcattcattcattccacaaataggtgtgaagtcctactttgtactagacactgtgctaatactggggatacaaaaataaaatagatgaggtctctgccctcatggacaggtaatctacagagagaaacagacagcgaaaaggaatttaatagaattacaaaggggttggcttagatcagggggtcaggaaaggcttctcacaggaagaggtgggcaggagagttcaggcagaaggcctgaggagaatgggcttagctgggcacccttgaggaatggacaggagggtgtggtgctttccctgaaagaaggttccattctgtgcggctgaaaggaccagagcaaggggcaagggttttattctaagtgcagtgggagagcactgaaggggtttaagcagcacaggattcagtgtgcatttaagacgtgcactctgcccatctatggagaggctgagagtggatcccagggatggtcacgaacctccagagagccactttatagtttccaaagcttccacaaacaccatctcaccacttgttttaaatgcagcccgagaagtcaaaggaggtggggtatggggggagcatttctgtgttcaccctttctgtgactcagagaaggattctaaggtggagctacagagccaggaagtggcagaggattttaatcgcctccttggaggagaggaaggagcctctgaggccagaatgtatcccagccagaagtcagaggaccattccctaccctcagtcatcagaagggctcctgacctcaggggctgctgggggcagcctgtgaggggcacaaggctggggctgtgatgacgatgctccttggacatgcctggaagggatggaggtgggggctgactgcccaccagggcctctgctccctcactgctgcctcctcatcccccagcctcctctgggattgtccttctcagggtcagccagctcccactgcagtgcagggaccaacatgcccatctcctcccacatcctggcccccaccacagccaacctggccccgtgcctcatgccctgccctcctgaccagcttcctaactcactgatactggcttccactcggagagcctacagctctctgccatctacccacctaagcttgggaatgtctttctctgcttgtgctctgtagccagctcacatgtcaccaggctgatgcacactcagctcagtggggctgcatttacctttcctagggattccccagcctgtggtgccctccccagtgtgggtagagaatagggtctgctgcctcctcttgcaggtatctcttctcggatgggaatgggcgcccccagctcccactggccacctttaagagatcagagggcaaccgggcactgtggctcatgcctgtaatctcagcactttgggaggccaaggtgggagaagcgcttgagtccaggagttcgagaccagcttggataacatagcaagactatctctattaaaataaataaaataaaaagatcagaaggctggctgggtgctaggcacagagggcatggatgtaggcatggggctctggcctgaaggtagctgtcagcctgacagcatgaggttcctgatgtgcccatactggtagtgggtagggtgtgggtagggtagtgggtaggttgggggaagtcctggggaggtgaggagcacagagaacccaacccagccgagtccaagatgtccaggatcttgggtctctcttgacttcacgtttgactaatttcctcctcccatctgagtaatcataatgataaagatagcagcattgggccaggtatggtggctcacgcctgtaatcccagcactttgggaggctgaggcgggcagatcacttgaggtcaggaatttgagaccagcctggccaatatggtaaagcccagtctttactaaaaatacaaaaagttgccaggcatggtggcacatacctgtaatcccagctacttgggaggctgaggcacgagaatcgcttgaacctgggaggcaaaggttgcagtgagctg

SEQ ID NO: 86976 - DNA, 1049 bp, Homo sapiens
tgaaactctgtctctactaaaaatacaaaaaattagccaggcatggtggtgcgaacctgtaatcccggctacgtgggaggctgaggcacaagaatcgcttgaacccaagaggcagaggttggagtgagccgagattgcaccactgcactccagcctgggcaatagagtgagactgcctcagaaaaacaaacacttactgagtgtgtactacagccagacactctcctaggtgctacgactatgtcagtgaacaaaacaggaaaaaagccctgcccttggggaacttacaatcttctgaggagaaagacaaattaaaaaaacagtataaataaatagtaggatgagaggaaatattgtgcgatggtgaaaagcagaggaggagggagggctggcactgtaaatccagtggtctgggtggccctactgagaagatgccatctgaacaaagaattgaaggaggcaaggagtgtgagcagtggggctatctgggggagggtttgccaggcacaggggatagtgggtgcaagggttggagccaggagtgccaggggggatgaggggacgcagagaaaaccactgtggctgcaggagagtgagcatgacaaattcccagatgaggtcagagaggcctgggtggagaagggggcatccagacagctcatggagcctctgtaggctcctgtaagggccttggtttttatcctaagaggggaagccactggaggtttggagcaggggagtggtgaaatgggattttaagagttgtaacagaaacaccagctgctgtgatgagaacggaatttaggggaacaagagtaggagctggaagaccagggaatccaggcagggatagtgagggaggtgttgagaagggatggcattccacatgtattctgaaggtggccccgatgggatttactgatggagtggatgtggggtgtgagggaaagagagtcaaagatgactcctggctgggcgcagtggctcacatctgtaatcccagcactttgggaggccagggcaggtggatcacgaggtcaggagttcaa

SEQ ID NO: 86977 - DNA, 1880 bp, Homo sapiens
tcctcaggggcctctggtgctcaccaccccagacatcagccaggggtagggcacatggccagccagcaatcaggcagagaagaaaagccagaaggtccgctctgggccagtgactgagcaactatctcatgtggctgcctgtcaccccattccttcaccaggaccaatgaggagctggtggcattcctatccaagaaccgggacaagaatttcctcaagtcacatggccgggacaactccaggtgagggggtggggaaggaggccctggccccagagtcttgtcccaacccctcccacacagttgggctcggtggctccagccctgggtttcaaagcctccacaccagtcacaggttgaggagtgttggttgccaggcgggtgaaagagcttagaccccaccctgcaggatccccagccatggcctctctgctgcccacaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgaggtgggtagcccagcaggcatgaaggccagggagggcgtgggttgggctgcctgcagctcaccttccactctcccttgctgcttgcagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcaggtgcttgcccgaggccccaaggcccctggctaggtcttctcccctggcttttcaccaggaaaatggcagggtgggccagtaagagaatctggggggccacggcctgcagcaaccctcaggggtctggggctacaacagcagcaggaaaagccgcaggaggctgagctctaggcagtgctgaggggccagccccaccatgccctctggggcttccagagcccttcaccctccttgcctctcccactccagcaagtctccagacccaccttcttcgcccggaagttcgagtcgactgtgaaccaggaggtgctggaaatcctggacttccacctgtatggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtgagacccccttctgacatacagcaggcccttggggtgtggtgccctagggggaggccaaccagagagtgacgtcccctgcccacaacaaggccccagtctgaagcagggaaaaatgcaaataccgaaaagacggctagagccaggcatgcaggtgctgtgggggtgagatctggggaaaggaagtgcctggggatgggactccccagagccccctccctgggactccaggccaagtcaggtgtgctgatggcatctccctttctccctgctggcaccttaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgc

SEQ ID NO: 86978 - DNA, 1035 bp, Homo sapiens
gcatgaagagctgaagtgcccgagtacaggcttctgagggctctaggagccaccaatgatggtcaagaaagggtatgggacacaaaccagactgttcccttttctaaagtgccttgaacccactgctttactgcatcctaaagttgggaatctaaggcttactgccttgattttataaaactcagttttataggcacagaaagtcccttggattagcccaaggtcattcagcaagctgtgactcagaagtagggctgtgacaggaactggggtacccagacccaactcctgggtctggcctccacggagtctgttgcagggggtgtgcttactgcctgctctgcacccacagatgatgccagctggctgcacgcagggccaccccacaacgagtacatggagcagagtttccagggcctgagtagcatcctgaacctgcctcagccggagctcgcggaggaggctgcccagcggcacacacagctcacaggccctgcgctcgaggcctggacagacagggaactgagcagcttctggtccgtggctggactgtgtgccataggcccctctccctgcccctccctggagccctgcagactgaccagctggagctctctgtcccccgaccccaaatcagagctggggcctgtcaaagcagacgggcgactcaggtagcagggccccagccagtacccgtggaggacccgggaaattgcaccttacagacagtggaggggtgtcccctcccacaggcaagaaccagaggcccaggctgcacacccatttcagccatcaagaacccacacagacggcagggaaggtggacacagtatgaactactgctgatgtctctgttggggatcagagggctggcgggaacgcgagaagggcaccagcagcattccacacccagctcttcctcaccttcctgtctagtttgaatttcttttttttctttttttttttttttttttaatttaaaaaggaaaatgggtggttgggagagaaactagaacagaagatgtgcaatagggc

SEQ ID NO: 86979 - DNA, 1011 bp, Homo sapiens
tctccagtcttcatcccatccttcccctcccctgcgttctttttagtccccttaaccacgctaggtcccttgcctggcttcagaaccccagcacacactttttcccccatcccaggtggcaggcccagggagcctcacttgtatcccttgggactctcggctcctttccactggctggacctcggtgtggcatcccatggtgctgaagtagggaggcgggcagccctgggatcatgaagcacagctcaaggtgaagctcagggtcagtgtgcaagacagcagattccaaaccctttatttccctccatgcccctttctccatccctttaatcctctccacctgggccaaggcacaaagctcagaccctcagcatttctgaaatgcactagggtgtaaagagaatccactcctttctggccagtagctcattctgtcactgtctggtagccaggtctcatgacctttggtgggaaagtcagagaaaaccacctcctgtccctacccctccatcctgtctggtgcccagtgttggggaatggtgtcagagactggggggctgcagctcagattttgtttcctttctatacaggatgccatatggcacgctgtccctggggagaggactgacagtgctgtagttgccacttacccccttccccagaagtcggggctctgcactttcccctgggagctggaaaaagaccttgtcttcactgagcagctccttgcactgagttatgtttaacaatggtcagggaggggcctagatgttattaaccctttccacactgctcccctgactcagagggaacccaggctggatgctgcagagaaagattccaaaggccctttcttttccatactgaacacttgtttctccttggccagagcacaggtgcccttttgtcaggatttgggtcgggggtggggggcatgaaggcaaggggttggtggatcggggtgcttacgtattggctgggactccggaagaagtggcaggcgcagaggac

SEQ ID NO: 86980 - DNA, 2753 bp, Homo sapiens
ttgaggctccccgttggtgtgcactagagaacctgggtaaggaccaacagatcaccaggcagttccatccaggtgtgtccctaaatagcatgcgttcatgacgctggctcactttatttttggccccaggtcaggtctcccaaagggtttcccagcagtcacttcagagtctcctgcagagtcaccatcaagcagacctcttcctcgggaggccgtgtcgccaccccaacccttgacttctggtatcaccatctcctgtcacctgggctccagtctctgtccgatggcctcaacaggacatcaaagcatagctaccagtttgaaggtgccctcaggcttggcaggaaccacgtggacaaaagtcttgtagagcacagcacccttgggcagcctggtgatcagatccacagcctccgtgtttctgggatgaggcacgtagacctccttagtgtagcggactatcccctcttccagggcatacagacatttattcttcccaacacccacctgcaacacacagacctggtcagctggtcagctggtcagcgaggtggtccgtcccagaattttgggacagacttctcacacagagccgggccctggggctgaaagggtgatcagagagctccatctcaggttccctttcccactggctagcacgtccaaaccttctgcttctttattgactcataacaaatgagggaaaagaaagctccaacagccaacatgggccactgctcagtcccagggactgttacctggagccatgtctatgcagctggtcagaagccacactgcacaaatcccaaaacccaggaagatgccctaaatcttcacttagacttaaacaacactagaactgtcatattaaaacactagtttgatgtaaattttcatttagatagtgatctataaagtttaggctctatggaaaatataaaccaaagctatatggataatgcatatgctaataaaacaatcatactactgcattagctaatacccatgtaagccctttaatacacattaagtcatttaattctcacctagtgaaagaggtattatttccaacgccacttttcagatgtgaaatatgaagcagagagattaaactgtgttgtatatacagtttttaaccatattttttagctttttcttttagaacttcaggctgggtgtgtggcaaattttacccaggtagtccagcattattctctgtctctctgattaaaagaatgggctctggagccaggatgcctggttcaaataccagcactgctacttactcctgtgtggtcttaggcaagttacttcactgtgcctctattttttcgtctgtcaaatggggataatattaactattttacagggtcattttgaggattaatgctcaacaatcataaagggcctagaatactgtctagctcaaaatgtgttagctttgattattattgttgacatagccacacatctaatgtcttaagttctaaaaggtaaaaagctactacatacataatcaattcacatacaaattagcatctttgaaataaatacaggttactatcaacctttttgtacctactaaaattatcgaaaaaggggtgggggaggggaaactgtttacaaaggcaactaatatttaaaataatgtggagagtacagtatcgttatgtctctgtaacaaagaactgtcctaccctataaaaatgatgccaacttgctgaaactgaaatccccacctggtatgaacctaactcctggcacactgaattctatttcattaaattcaagctatctttcaaccatctgcaagtaagtttatacaaaggaagaagtcttagaataatgaaaaactaataaattgaaattagtttcccaagactaaaataatattttaaatcaccaggtatcttgtcctccaagaactgagggttagaaaggagaaccaagaataccaggccaatgcaacaccagggcaaatcatagtgatctgggagttaggcagacctggtgcaaatcccagcagtcacttgctccttccaccccgtctaggtctctggcatttcaccttacttacagggatgtggtaaggaagaaatgagatcgtgtaggcatgggaatcagcacaatgcttgccatttggtaagcactcaatacatgcaactgttattaccatgcttaggggcaaggagaggtcaacctagaaaaggaaaaaggggggcagcaacggagcaactcacatgggcacctgggtgccagcggaaatggcgctgtgttgcaatgatgttcccagcatgaacatagtgacctagaagagaagtccacagtgactggggcagcatagcaaactaccaagaaaacatgatggcccaaatgctgcacaccaacctccaagcctgcccctggccaaaaacaactcccagacagtccaacacaagcagcgcaggatctgccacccagcagctcttgtctctaattgcatggttatggctcacacccacccactcgatgacccttcctcaggtcttatccgttcctttaaactggagccaattatgatggtaaggaagaacagggccaggcacacgcagggttcttctgctctcctaaggaacatgaggacagggtgcagctaggaaggggaagccaaggcacatcctcaccttccattttcttaatgccttggcgtctgcctgatgactttccaccgaggtttttggagctaccacccgacttcttggatgcgtatctga

SEQ ID NO: 86981 - DNA, 1833 bp, Homo sapiens
acagatttcacgactcagagatagaaatctcttgctatcatcaggtcacgggcagctcctgtggagtcctgcccaacttatgtggcttccataaaatggcaacagtccaggctccttgcctaattttagagcattaactccctaattgccagtaagcaaggaggtggatctctgcaaacctacactgtctatgacagctctagttgtacttggtgtgactaaatacctcaaaggcaacctgcttctgcaggttttgaagtgtcagcttcataagacactgaggtttagaattgtttgattctagaccataactgaagggcataaatggaaacaggatatgaagggaaacaagtagcatcatggagctgaaaagtggtgcatcacccaatggctagcacaaacaaggatcacactgtccattctcttgtctgctaaattaagcattttcttgcctcctttgcttcatcttttcacaacagctggatagagggatcagaaatgactgtgtcatggtgctcattcactgcaaactcccagttgcaagctccttggctcccccggagggagcaagaatctcatagttcagagacacagagggccttttagccctaatgaccttttggatgggactgcaactcatgactatcctgatattggaagaaaggactttgttaatcttctcccccatagctctgctgcgtaggtctacatcttactcagaatcactacacattcctttagtcttcctccaagctccagagccattggtacaaatgctttattgaaactaaatacataatacacacaatgagatgaagacaatatagaagtccgcatagtcatcataatcccgttccttggccggttgaggcagctcagtggctgagcccagtcaagccaacccgcagcttcactcacgacttcaagatttgatgctaattcttttggatttctacagttattaaataagtgtctgagtggactgtctttgttcctttgtgttttgagggctggctgggtaggagtgggggtggtttgtctgtggcagtgaatttttgccaggagaggaacattaaatgccaaaggtaggtggcagtatttcagtctctgccccagccgacaggcagagagaccttcacaaataataagacccaagaaagactgggcctcacctaggcttgtgttccaggaggtgctgccagtctcttcattacagtcaggctctgaggttggggaagtggaagtttccagcttttcatcctcatccctgagggctagaatcagtcagcactatctaaagagagatgtggctgtaaagtggtcatctgaaggtagatacgcctggatagttctggtccaatgcggcgagaagtggatgtcacaccttccccacggcgcacctgtatgtctgcgagcaaattctggcgttctttatccgaaaaacactgctgataagcctggaagtggtagatgacctcttaatatggtaccatccatggtgatcccttctccatgagcatggagggtgctacgcttggcttggggcatgagaacctgtcctccctccctgggtcagcattagcaacactgatcttagtagacctgcactgctgacctgtgaggcctttgtgggccctcaacagttgtccatggaaatctgggggcccactgagcccgcaggcaatgggcagtgacccctgagccctggagcagcatacctgtaccaggagctgtggggagggataggcattcacaactgcactggccatttccaggctgactcggttcagctgctgaatctgtctcctccagactagtgcgagtcccctgcca

SEQ ID NO: 86982 - DNA, 1078 bp, Homo sapiens
catctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggctctggagcttggaggaagactaaaggaatgtgtagtgattctgagtaagatgtagacctacgcagcagagctatgggggagaagattaacaaagtcctttcttccaatatcaggatagtcatgagttgcagtcccatccaaaaggtcattagggctaaaaggccctctgtgtctctgaactatgagattcttgctccctccgggggagccaaggagcttgcaactgggagtttgcagtgaatgagcaccatgacacagtcatttctgatccctctatccagctgttgtgaaaagatgaagcaaaggaggcaagaaaatgcttaatttagcagacaagagaatggacagtgtgatccttgtttgtgctagccattgggtgatgcaccacttttcagctccatgatgctacttgtttcccttcatatcctgtttccatttatgcccttcagttatggtctagaatcaaacaattctaaacctcagtgtcttatgaagctgacacttcaaaacctgcagaagcaggttgccttt

SEQ ID NO: 86983 - DNA, 1022 bp, Homo sapiens
cctcagcaacaacttgggaacagcatttcctccaacacgctttcctgactgcccctcctgtggctaccttaagtccccctccatctactcctgtggaattcaacacaggacattgtagctacttgctacctatctggcttggtcataagatggcagattccttaatggcaggaaccgctgtctggtctgtaggtatcacacaggggcgtggctagcacagagtttagctaattgcaggcattcaatacatacatgaggaatggctaattcccatttcaaaaggaagaaaaccaagactcatagggtgatttgtccactgctaatggccagaaagcagcacagctaagacctgagcacagtcccctgcattcctagggcagagcttgtcgcacacactttcaccacatgcagaggagagctccgagagaagcctacacacagcacacttgtactcggcaatctgagctccccagatccacataaactcgctcatggatgacctctaaccacacaatcacaaagattctcgctatggtgggtggaggaggtaaagaccttttctgtttgtatttttttaaaggtggtattctttggctgtaggggatagagtgtaagcttggagcccaacgcaatcctgactaccccttattgtataaccttggcaagtgacttaacctttctgagccgattttctgatcgagaaaacagagataagatatacttctatggagtgttgtgaagaataaataatataacttgtattggctgccttgtataatctctggcattatatgtgctcagtaagtactgctgcttattttctttaccatgtgagtaagaaaaaagaagaaaacccaaactattagcaaaagggtcttgttttactactgcacttaacaattacatttgaatatgcatgcgcacgagacagacatgtatattcatatgtaattcttatttctagaaaactccagacacgcatacctccagacaagcacacacccatcataagaagtattcag

SEQ ID NO: 86984 - DNA, 1462 bp, Homo sapiens
agggtgctgtggaaggacagaatgggtaaccacacctctccaggagcagtgtggagggtaggctggagcaagaactgagggtgaaggaatagtgttttgtgcctactttgtgctaagcccttttccatacatatcttggtaattatcaccaggtgtggtaggtgttctctgcattttcatttgaggaagaacggctgctaacagtagagccaggatttttacatggggtacctctgacttgagggcttccagactgttacaccgaagtgtgtgagcccaaggcttagatgaggagtttccaatcttgtggcttccctgggccacattggaagaagaagagttgtcttgggctacacatgaaatacactgatgagctgaaaaaggaaaaaaaatctcgtaatgttttaagaaaggttacaaatttgtattgggccacatttaaagctgtcgtggctcgtgtgttggacaagcctagcttaggttctctctttggatcctagtcggatttctgtggcctcacacacctggtgaagctagacctgagtaagaacaagctgcagcagctgccagcagactttggccgtctggtcaacctccagcacctggatctcctcaacaacaagctggtcaccttgcctgtcagctttgctcagctcaaggtaacaattcatgaaccagtgtttcatggccagggtggcagagaactcagggactctggagcacggccctgagaaaggctgacagaaatacccccttgttggtcctgcctcagatggcgctccctatatgtggaacacagaggggcattcttcctgctcattttgtttcaccctgagggactatgtatgtgaactcgggcttaatgagcctctttgcccatcgcccatctctttagaacctgaagtggttggacctgaaggataaccccctggatcctgtcctggccaaggtggcaggtgactgcttggatgagaagcagtgtaagcagtgtgcaaacaaggtaagcaccaagctccctcccagtggctccttatacactccctgggatttctcctcctcctgtttttccctcctagggcacctggagctttgtgtggagttaagcattcaggtccgagtgaaatatgtccactatgagcctgtcaaacagagacctttgtttctgcatttactttatctttttgttttttatttgttttgagacagagttgctctgttgcccaggttggagtgcaagtggcacaatctcggcccactccaacctccgcctcccaggttcaagcgattctcctgcctcagcctcccgagtagctgagattacagacgcctgctaccatgctcagctaatttttgtattttttagtggagatggtgtttcgccacgttggccaggctggtctccaactcccgacctcaaatgattcgcccaccttggccttccaaagtgctgggattataggcg

SEQ ID NO: 86985 - DNA, 1022 bp, Homo sapiens
atatttatttttaaagtgctaggaataatgtctaagaatctaaattttgcttgcctgcctgcctgcctgccttcctttctttttttttttttttgagatggggtctcactgtgttgtgcaggccggcctcaaactcctgaactcctgggctcaagcgatcctcctgtctcagctttctgagtagctgagactatgagactacaggtgtgagtccctgtgcctcgcctaaggtttaccttcttggaggttgtacagccacatcccttctctttgcattcttccttagatcatggttgactggcttatttttcctcttattcccaggaacattactctttactgccattttaaaaggcctttcctaatcatgggaacattctctggaaaatgcttcattaacatatgtcagtgaattgttccagatgttggtctgacatgtttttctcatcctcttttacctaggctgcccttccaaaggccaccatcctggatctgtcttgtaataaactgactactctaccggtaagattggcatgcagccgtgactccttctggtgccttggatgcatctccttcctgtttcgggggttgagaggggggtgggagggtgtcataaggtgtaatttcaggataggcctacaggcaggctatagctaaatctgagtgtgtaggggaggcacagtggaatggagtggttggtctcagtgggaaaggaattgagatggaggcctcattcttcagaacagtggtaaagtcagtccacagaaaactaaactcaacagggtgctgagtaacttactgggctcatcttttttctacattattttattcctctgaaaaatagtttacctccctactgcatagaggatgctagagaccattttgtaagttgctctgcgttccagggagaaagctgtgaacagcttccttgtgcatcttttgatggggagcaagaaagaaggtgattttatgggctaccttatcattattctcccaaaggacttgaattagttgagatttgc

SEQ ID NO: 86986 - DNA, 1044 bp, Homo sapiens
gagagacagaatatgttataggtattgttttgtttttgtctacctcccctccccttactggactattaattccagagactgtgtcttgttcctgctatgtctcccagagtctagagcagtggaagacacatagtagctggtcaataaatgtttcacgactgagcaagcaagtgagtgaacaaggcagagatgacaggttgcccctgggctttccttacagagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtgaggcacttggctcaggtgagcccccagaaacaagaaacacacatgaacacggtgatgtctgatatttttctttggccctggaaggtggtgggagtgaaggacgatcggatgggggaagagatttgtgcctgcattcggctgaaggacggggaggagaccacggtggaggagataaaagctttctgcaaagggaaggtgggagcctccgctcaacctagctgatgctgctctgttctttgctcacccactcctctgccaaccagcccagggtggggattgctctgcccttgacgaagctgactcctggccaggccagcccctggtcccctacccatacccctgtgagcttgcgcagcctcacgccttacctccctccctctggtctgcagatctctcacttcaagattccgaagtacatcgtgtttgtcacaaactaccccctcaccatttcaggaaaggtgtgtaaggtggaggaggctggggagggcagcctgggctctggggccccatagggccccacctctgtttccttcagcaatgggtgtggagagactggcagtagggtgaccgggtcacctaatcctggtttgcctggggactttccctgttttggcactaagagcctgagaaaccccttattcttgggtgaaccaagacagctggtaaccctaactccatt

SEQ ID NO: 86987 - DNA, 1046 bp, Homo sapiens
cggtaacccgggcttaccccacctgcgtacacacacctcagtcttcctgggttgggggggtggggatccaggccaggagaagagagctgtgccccgctggctcgcagctggacgccctccagatgtggtcaggggagggtcgtcatcctccagatgtgggaagcttcgggagcctgggagctgtactctgcccgcgccggttagcgagctgggtttggtttccgagtttggtggggggtgggtgggggcggtggggaggaagctgcggggacggaggaggggggaccgcaatctcctgggtttccctccttcccccgccccaaagtttgcggcggattctagggtctgatcccccaacctggtccttgaggctgaggtttttactgacctagaaggagatgttggggggcggggaccaggtcctggcccacctcaccccccacctcgcgggttggaggcacaacaaggagattccggcggcggctgatgtcaggggcgcagaatgagaacaagatgtggtggaggggagctgtctgcccccggagctgggagtggagcccctttccgctagagcccagtgccgcgggtgcctcctacccgatctccattcgatgcagggtgcttaagattgggttggggagttttatgctggatttttcttgtggagggaaagactgtgtcaagagcttttttagcaagtgggggatggggttaagctggtccaggttactcctcccctttcacaaataaagagtgctcctgcagaccaggtatgggggactgcaggcccgcgaaagtcttgaggggacagtaatactgtcagtgtgttcactaaggaggactcgggtccaccaccccagcgtagactccgcagataggtttggggaatgcaagccccacattccagggagatggatttagcactgctccctgtctgcccaggctggagtggtaggggagaccccagcccagtcagaccctagctcaaagcgccacttgacagacgcctggccccaagctccctggcgggtcctgccaccggggga

SEQ ID NO: 86988 - DNA, 1031 bp, Homo sapiens
gatggcggcaatggcctcttgggggagggggtagacattgtccactctgcacggcttgggagctatgcccagcatggtgcctgacacataatgggtcctcaatatttaaatgtgtgaatatgcctagtggtcatttgagggtgttgagaggttgggaggctggtggtggaagagggagccccgggctctggtgctgtagcagcggggactgcagctgtggacgtctgccttacacctagtgccagggcggtcatgacaggcagttctgcctgcctgagcagctatggtgtgcagaggaaactatcatagatcaggagcttggaaaccaccgtctcatcctgccttctcgggtgaccttcagcacatgacttcggcatttctgggcctcaacttcctcgagttctggggaagaaaatgatctaccccagatatttcacagggctgttgtgagcatcaactgtggcattgtgtgaaagtgcttggtaaactgtaaggcaggcataatccgactttaggtttgtataacacattcacatacagtatctcatttgcttctcacatctaccctgtgaggtagggagaataggattcagattctgcagcaaactcatggtgtctggcatttccacaggcatgatcgatttattccccaaatggcttgtgcaaatagtcagggtatttgtggcttgtcttcctttacagatgaggaagctgggtccagagaggtgagatgaccaaggtgggactccccttctctgatgaggagtctggggctgggggctggtctgcgtgtatgtcagggccctggcaccacacctgcttagcctcagatggagccaggaggtaaacgaggaggaggtgttagggcggggtcggggggccggcctcagctccagccttggccagctgtttccttgactgccagtacctggtttgagcgcatcagcatgttggtcatccttctcaactgcgtgaccctgggcatgttccggccatgcgaggacatcgcctgtgactcccagcgctgccgg

SEQ ID NO: 86989 - DNA, 1049 bp, Homo sapiens
aaaaaagaaaaaataatggtgagttttacacagaaattcagatttgtgtctactcaggaaaagtctgaagatctgggaagactgggcttgcattccctcaaggcaggagtcagccagaacaaagaggcagttttggatggagaatctactctcccctttaccacagtccccgcccctccctactgcttcacatcaaacccacaccattcatttccatcgcctgtcaggcggctgtagctatttgggttcgcaggaacccaggctgtgggcagctcctaagacagcttgccctcgggctgatgcctccgcctgtccttcctgctccccgccagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctggtcggtagtctttccacctctctctgggtcgtgcttgaccttggccttgcgactgcagggggctgggcgctggggccgggggcagggagaagaggctcccacccccctcctcacctccttctccccaagagcatgtctgcctttagagcgagcatgaagcagaccacttcagccccatgggtagggggagctgtccccaccctggggcctcccaggacctcagcatcatcctccccagatgatgccaaatggaggttgacacccagcctccccgagcttgactctcagaggagcctcactggctgctccactgccccatgccagcatccagaggcccagggtgggcagcaagcatctcaaccctgcacccacctagtgtctgcagctgccgagcaaagcctcagcagatctcagtaatggacaacagcgtaaaagagaacccagacacccctccctccctatctctaacaaaactttctaccatgatatatatatatatatat

SEQ ID NO: 86990 - DNA, 1118 bp, Homo sapiens
gccctagatatgcccttccccccactgtctgactctggtattttctccacctaaggcagctcatcctggtgggaggcagggaggtggtgccacagctaccaatgcatcagtgaccacaggtccaggctcctcctggactatggttggagctctcaaagcagcaggcttgcccaaggctcctcccaggggctttctatttcttctccacacctgggtgcttgcctgcagagccgaggtccagagagcagcaaaggagggtggcatcgccaggccccaactttggaggcctttgggcagaccatccaggggtgtcctctgggccaaggcctcaaagccttgtgtctgtacccacctggcaactggcgagggactcgggctggaagttcgggtccagctcggtcatgcctcgtagctagctgaatgagtcactttttgcctggcttcattctctccctctgaaaaacaaaggggttgcccgaggagatgctgatcagattggcctggtactctttggacctgtgctctaatgggggatttctggcagcctcagcacctgccgtctggggtaggggccagggtggaggggtgtttgtacagacctcaggggccgggacctgtctataagcagatgccctgcctcagtcctcctgccccgccttccttctgggcctcttggaggagggtcccggctgaattgaagcccacccaccccacagactcctagtgcaaggccagagttggtgggagcagctgctccgtttggcctggaactgcctacagagtcaggctggggtgacggggagaggagggcaactctcccagcctctcctctacattgtctcagctaataatggggctaataaggagccgctttttctaacctaattgtattcaaacattttagttaattctccattcatattttagcataatgggatcgggtgctctcggcatttatggagattaatgcagagaaaatgttccggctgctcaggcaatgcagggcgactagcgccctctggttcttgtggtactcaaggaaggaaggaagaggcccggcccacccggcccaccctccaccatcgcggtgtggatgacccgtagcctcctgtcctccc

SEQ ID NO: 86991 - DNA, 2632 bp, Homo sapiens
tagtgagctgtgaggattaacttagtgcactactagatgtgccttctgttttacaagtgaaggaccaagttcagttacagagcaaatcacatagatgcatgtgtggtccttcatacatctctgggtttttgacatcaggcttctggcttctcagggcacctgggaaactgatctgtgcattgcctctcccttcgcagtgtgtgctcatgctgtcgcagctgctgagctgtttttaaggacttccactttgcaacccaatcatcctggggccttagttgcactatcactgacttagcctgccacagggatttttttttttcttctaggttttgaaataagacaagatactggtatcaatagagtgcaccaaacatatggagacaagtggctcctgttaatctgtttaacatatttttgttttaggacaaggatgttgctcgactccaagatttccaggagctggaactggttctgatgataagtgaaaataattttctgttcagaaatgctgcatccacactgactgaaaggccttgctataacaggagagcttcaaaactgacttactaatgcagcagggacttttatcactgagtattatgacagtgtgcatcacctctgggccaaggacaagccattgatctaaatgcctcagatgcccgggagggcctctggtgccactgcatagtatatactaacatcattctgccaaggtaggaagcccctgacccccaagcagtggtgccactcttccaagcctcttggtgcacagtaaacctattgcttgaagctttgaacagctgagaagtggtctggagaggcagaagctgaaggttctatatccagtgtgttttatgtccagaatgtaagagagttgtctaagcagcagctgagagagagcggagcctatttctagccactcctgttgacagtgcacctgaagggctgggatgcgtttttcttggtgttgcatgctcacaactctgctgacattgggaacttatgagagaggaagactcgggaaagcacagatactggacagatggattctggtgtggggaaagcacagatactggacagatggattctagtgtgacttgtgactgtgaggtttcctataacatatttataaatgttactcaggttaaaagtatttaagaatacagttaactaattgtaaatatgctgttaaccaaaagagctttccctccctcactttttcctttgtaaacactcatgactgcttctctgtctcgagtcatctctgcattaactccccttcgtggtcactagagggctctctgatgccttctaaaagaacaactgcttttttacaatgccccccacccccaccccgcccatagagacagggtctcactatgtggcccaggctggtctcaaacttctggccttaagtgatgctcctgtccttggcctcccaaagtgctgggattacaggtgtgagccactgcacccagcccactttttttttactctgaagtgattccagtcatatgtgtgtgtaactgcatcctatgagaagagcacaaatattgctgttccatgttctccactttcattttccactacaaatgaaaagcaatttttgagactgaatctgttgctattttaaaggttattgtgggaaactgagctaaaggagttagcatctttatttttgtatcaaaaataaaggttattttgaaattattaggatttttacacaattctgaaatctgttgcttttgtaaacaaattgtttgatcttagtgatccccctactactaccaccaattcacttcacaaagtcagttatgagtctaccagactttgttctgaaaaatagaaacaaaacacctgattaagctcttgagtatggcataggaattttttagaagaatgcattcaaggattcttttcctttccttcagtgtcattaatgttaaaagagcagccactgttttgttgaaacaaacagcttaacttcagaaataagaactagcacacttagacaaacaggagagcaggggtttgaagccagctgtcgaagagcatccctgctgtcttaagaagctttttccccatagtgcctatagtttccaaagaaactcaacttcctaactgtgttaacttaattttattagaacactacagttgagtgagaacgtgcagaagatgtcaacagaagagaatgttgtgctaagataatggcctcctgctgctgcctaaatgctgaaatgaggttgagatgtttttcaaggctaacttcatggactcactctgtttagtgacttaattgtatcccaccaattactgctggtgacttactcacccttgtacagtgtttgcatagcagagtgaaggttacttattaccctctttctctcaagtgctttaaagaagaaacctccctggtgtttcttttctttttttttttgagacggagtcttgctttgttgcccaggctgaagtgcagtggcataatctcagctcactgaaacctctgcctcccgggttcaaacgattctcctgcctcagcctcccaagtagctgggattacaagcatgtgccaccatgcccagctaatttctgtattttagtagagacaaggtttcaccatgttggccaggct

SEQ ID NO: 86992 - DNA, 1106 bp, Homo sapiens
tatctggactatctgtactcctctgccccctgcatcctgcccaggatcatatgttgcatgtagttatcacgttgttttagtttcctttaatctggaatctttaccctttatcatttttgatcttgatctttttgaagagtccaggccaattatttttgtgggatatgattttctatcattctttctctacttattagttggtattttactgtaaagaagggctttcccttctccttcattcatatcagtattgactcatatattcttattttattcagtgggttataatctgttactatcattttttaattattcaaattatcccagatttggccagtgggagccccttgaagctagttcttatgtcccttgcatgtgtcttcattgttcttggagcactgccttactttctggggcagcaagatgttccgggcttatagcataacttttcctgccccaaccctggaatcagtcatttctccaagaagccctggttctttttggtggagaatggtatttagggcacacagcaaacttgcctcccacttgggcccaccgagaatggtattcagacaccaggatgtggtcactaggtgtcctcattgctacaggtatatcatttcttctaggcccgttgagaggacatagccaggaaagatatcaatatttctctatgtataactttttaaaaatattaaaaaccacaagttcatcctgattcttccaaatccagtcaaatgccatagggtgtagctagtcttacttttccttttttcctggaagtaactctctcacttcctgtttttgaggagttactactgtaggtgctaacagtgacctggggtgctacaagggattcatatacagggaacaaagcagaactgccaaatgtacagggtgcttgactcaggctgtcttggcagccaggttcagaataaaggagcagattgcttagatcccagacctatgaataataagccaagaccccttcctcatgaaggtgtgctacattcaaatcaagttatactttagcttttattagtagcttgtcatttggctcttttactgtcttttttgcaaggagtttcatattttacagatacctt

SEQ ID NO: 86993 - DNA, 1054 bp, Homo sapiens
taagataatgataaaaatggtaatcataaacctaatgaagtattcttttttcttctgacctgacactgaccaatgtcacataccaaaagacaccactttcaaaagacaccttgttttgataattttgaaaggactgtgtaaatgttctgttttcttctttttaagtggaagaagaagatgatgatgatgatgatgatgacaacctcccccagctgaagaaggagtcagaactgccctttgttcccaactatttggccaacccagccttcccttttatctatacacccacagcagaggattcagcccagatgcagaatgggggcccctccacaccccctgcatcaccccctgcagatggctcacctccattgcttccccctggggaacctcccctgttagggacctttccccgggaccacacctctttggcactagttcagaatggtgatgtgtcggccccctctgccatactcagaacaccagaaagcacaaaaccgggtcctgtttgtcagccaccagtgagtcagagccgctccctgttttcttctgtcccgtccaagccaccaatgtctctggagcctcaaaatgggacgtatgcaggaccagcgccagcattccagccatttttcttcactggagcatttccatttaatatgcaaggtaacccctcatcagcaaacagcctctgcaacaggggagttggtgtccagaggggtgggatttaatgaggtattctgggtataattgcaaacttacagaaacgttacatgactaacataaggaactccctttactcaaattcacaaattgtttaccttttgcccttttaccctgatacccttcagtattctttccattatatctttcctaagaacaaggatattctctcttttttttattgagacgtagcttcgccctgtcacccaggctggagtacagtggtgtgatcttggctcactgcaacctccgcctcccaggttcaagtgattcttctgcctcagcctcccaagtagctgagattacaggagcatgccaccacgcctggctaattttt

SEQ ID NO: 86994 - DNA, 1001 bp, Homo sapiens
ttacctcatgggtttagaggattaaataagttaatacatgtaatgcctttagaacaatgtccaacacgtaaagcattatacctgtattagccattgttgttgttttcttattatgaagcaatatgctagataatggaatataaggttaccctcaaaaaaacgtactctcttgcatttgcaaagcagaatggtgactgctttcaagtcttagttgctcagtaatcacaatttcagcaccaatgagtgatgccctgttgatgaatgacacccagtgcctcaggtctgaaatagtttctgacactaataagatattttgactgcaaatgtaaagcttaaggagttgaagttcaaagatagagtaatctatcaattagattgatcactaatcattcccccacatcagttgtaattcaagtgtcatgcataacccttggttcatgaagaacttgaaaatattacctggctgcaggggctctgagttatggctgcccagagccgcacagctctggacggtaaatgatgatcactaaggcacagggctgtgggggccacgctatgttgacttaaccctgctttacatgggtggtagtttagcaagttggtttgtcccagagtctctcagacccactggtagtaaattacctcctttactctcaagcttgccacgaacaagtgatctactactagcaagtgagcattttatttccaaaagggagcatatttttctcatcatgcttcattcatttttgagggctcacttatcattataattgttcactttttaagcctgtgccacagacatccacacacaaacacactcaaggttccagtttgcccagaatcaagggtagattggatccttctacttcaagcaaggtccactttatccttagtttactcatttggtactttttttttttttgagatggagtcttgctgtgttgcccaggctgaagtgcagtggcacaatcttggctcgctgcaacctccacctcctgggt

SEQ ID NO: 86995 - DNA, 2398 bp, Homo sapiens
gagactcagggcgggaggacaaagccaggtgcaagaggcgtgagcacagcgactaggaaaatggagtcggaagccgtaatcttcagtttcctccgctgcatgaggcaccatgtgcaccacgtggactaaaggagacactttctccattttgaagcggtgtccaggcttcaagacctaggctccaatttctcaccgtgaagaagctcgggaaaaccgggcgcttggggaggcgcgcgggcagaggctacccgtccccgcggcctctagacaggggcggagtccctacccggcctccgcgggccccgcccccggacggcggaagccgagctcgccctctccgcccgggcctgggcgtgtcccacgggcgcacggcatgctgggaaggcgtccgcgcggcggccattttgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtaagtcccgcgggccttggcctgagcccgggctccgtgggggaggggagcgggcgcgggctgtggccctcctggccgcggcgcgatgtggccagggccgcacccggggtcgagcgtctgacccggtgcccatggagccaggagggaggatgctgtccggacccggggatgggggtgatttggttttgttgttctagtatcaagggggtccgggagagcccttggcataattgaaaagcaccttgatgaggcggggaaacgcgggaaagaaggatagcagcgtcttattaaatctagcggctccgaggtttcacctcattatgaaatagggagaagggcacatttttctatagtttgggttgaacgtcgtatttagactaaaatttctgaccaggattcatggtaaaaatcgtggcggtattttatttaagtaattacagcatgacgcttatacggggaaatagaaatgtaaaagaagtcgtttacttgttagggtttaccgtgatgatttacaagtattgttcgttaacagtattctaagaagtcccttatagaggcagctgtcaaggttttttcttccacataaaactcatttgatgctcttagcccggggagtaaaggtaaatattataaccccagtttcactggtgagacttaaaaaggctcacccaaagtcttggcaactgaggaaactaatctttgtagttctgttagctttccacaatcctatgaaactggttctctgcacctactgtagcatttcaagtgttttgatctagttttgaacatgcagtgtaatgtttactttaggtcttatctggagaatagatacagaatttaattttactttgaggttataatctaacatgctaattttaaaacaattgctaatcaaaataggaaggaatagttcaggtaatgcatgcttctttagaaaactgttttcttactctttttaaacgtaggctttggttaaggtaaaatttcttttttgcagtgtaggaaagcaagttggtgctagatgactccttttaggactttaagaaagagtaagtttggctcaagttgtgttggggtgctaactgattccaaagtagtatgaaacattcttagagtagaatttattgtttttaagaggtgggttttttgtttttaacatttaggctccccatccccccgaccatttgtcacaataggagactaaggaactgcttaccttgaccatctttcttttgtaggcatctttgttatagcgaagtaactttttttttttttaactacctgactctgtaacctttcagtctaaactttgcaaatgtgttaggaataacgctcaaaatcctaagtaaggtaaaaaaccaaaacattatggcgatttggcttatgttcaataggttatttgtatattttgaattcaagagaaaaatgctttccattgcactccttatcagttggaacagccttgtatctctgcacccttgactttgaacacgttttagagaaactgttttctttcccggggtaatttgttgccacattgcattgtatgtgatgggtttatgactcttcaatgatgaggccctcagaatagcaatttaggttttatgtcatctcagccgtaatctgctttgctttcagttttagtacttttcactaattttaactttcagtgtttattactaaagtatttaatgccttaatgacagattgcacttcactctagattgaaggatttcaagtcagttactggcatttcagattga

SEQ ID NO: 86996 - DNA, 2034 bp, Homo sapiens
ttatttatccaaaaattttgatgtctaggattgataaatagcaaaataagcatagaattttaaaaggtggaggtaaattcgggaagaaatagagaagagttaagataattgctttttagaggtgggaagaagtaggggttaggtactagtctagtgctatttgactttatatacagatttgaaaataataaagtcggcaatggttcagttcagtggtctgtccccatcagttttctttagtggcaataaggaacagtttcctttcaccttccctccttttctccctccctcctttacttctcttttaaccatatatggttgctgtccattatattgactttgaagactgagcagatcaattttatatcctatttggttatgatgcttcatgatttagtaggatcagtttagatgtctacaaactactcagtgataaagtgaatcctttttctttttaaaaagaaaaataactctttttttttggcaagaaaaggttgctaataatcacagataatttatacaattatattttttcccccaggtccgtgtgaaaaaattcatgatgaaaatctacgaaaacagtaagttattttgcttgtcatttccacccccccagttattagttggtttaagtgggacaagggttgaggaataattgcaattaaatgtaaaatgagtgtctgagagaagtccagtcagtggctggggatagtaagaaagttctatagcttcagtaatgatactgatagctaccacatgagtgcaccctgtatgtcagactttttttttctgtagcccatttgctgttttttttaaatgagcctcactgtgtcgctcaggctggagtgcagtggcatgatctcagcttactgcaacctccgcctcccaggttcaagggattctcctgcctcaaactcccgagtagttgggattacaggtgcccaccaccatgcctgactaatattttgtatttttagtagagacagggtttcaccatgttggccaggctggtctcaaactgctgacctcaagtgatccacccacctcggcctcccaaagtgctgggattacaggcgtgagccaccatgcccagccccgattttatccatgagacttgtcctaggtccagggtcatagatccagtacagtggtaaagctagtggttaaacccctgtgtaaagctctatgatgaggggcaatcagaaagtcacttcaaatacacctggtttaccctgcagcctaaatggaatagtcgttgaggctagttaagatagaatatttgagttgtaatggctgaagatttggaaatgagtacttgtttattttcatgttaccaggtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggtaagtgaagtcaattcagtctttgtaaacggtccttgttttctggagattcagagacctccctaatatttttgaaacttgtcttctgttcattactttgttctttaaaatgatatgaaacttatagggcattcattttttttccagtctttattagcaaacataacactgattttgctaaccataagatttttctttgtttttatttttcttgaggccaagatttttcccttaaatagtagtaactgacaatatgtgattgaccaacagaagttgaagataattgaattactatcctttcaattaagcattttaattattaaatagaaatattatgtatggtatgtgcaagtttgcatgtttatctttgttttcaacttgttggtaatacgttttattgtcttcaataggccgctggcccaacaggcaaaaatgaagaaaaaattcaggttctaacagacaaaattgatgtacttctgcaacaggtgagaattgtgtgcattaatgtcaggaagtaatgtgaaacagacatgtaaccagcaaaaatacaag

SEQ ID NO: 86997 - DNA, 1081 bp, Homo sapiens
tttaaaaaaaaaaacagagtctcacgtcatcatccaggctggagtgcagtggcacgatcttggctcactgcagcctcctcctcctgggttcaagcaattcttctgcctcagtctccccagtagctgggattacaggtgcccaccaccatgcctggctaattttttttttttatatttttagtagagatggggtttcaccatgttggccaggctggtcttgaattcctgacctcaggtgatctgcccaccttggcctcccaaagtgcttggattacaggcatgagccatcgcgtctggccgaaagtgcatttttcttaacacatcagttatactttattgaagtataaaaaaaatccaggataaattaaacccaaagaggcttttgtaaatgaaaccaaacaaaaaagatggaaaacaaccactaatgaaccatggggaaaaaagacaatagttgggtttgaaagaaatcttaactgtttttttcccctactcttctaagattgaagaattagggtctgaaggaaaagtagaagaagcccaggggatgatgaaattagttgagcaattaaaagaagagagagaactgctaaggtccacaacgtcggtgagtaaaccttatttcacattatctcatctgtctgttaacagttagtaggaactcatttttatttgagaacctttgaaaactgatgttccaaacttagagtcagcacaatttgtagcccacaaggtctgtggcatctactaagctctgcctttgtgcagtatgcaagcaactttatatagtacaagaaacaaatgggtgtggttgtatcccaataaaatgttagcaaaaggcctctctggcttgccaatcactgccttaaaccataaattttcatatgagcctggttttattttcatttttgttgtaataaattactcagtacatacttacatctttgttaaaaattaatacacccttaaatatctaattcttttaattggagaatagaatatacttgtttcagatactattgattgcagaatgtaattggtcattggttcctccatattgaataggatatgttcagattatagt

SEQ ID NO: 86998 - DNA, 3861 bp, Homo sapiens
ttaattagttttgtatatggacattattccttgaacctaagcaaggaatgtattcatactaaaataggtggctttctgaaaggtgatttaaattttgtaaggtaatgtgggtgttgaacattgaacagtgggtctcaacatttcttctggatgattcagtaagttagttgctgttaccttaaacatccctctctaaaagttgaccacttgtagtccaatattactgatttggggaaatggaaaagagcaattcacacacattagaaatcttttctaaatgttgagtactttcctgggatttgtttctcttcctcagatgttcttaaaataactgatttatcattttagacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagtaagtttttttgtttgttttgaggcagattcttgctctgtcacctagagtgcagtgacgcgatctcagctcactgccacctccacctcccaggtttaagcaattctcatgcctcagcctcctgagtagctgggagtacaggcatgtgccaccaggcctggctaatttttgtttgtttgtttgtttgtttatttttgagacagtctcgctttgttacccaggctgaagtacagtggcgtgatctcggctcaccgcaacctccacctctggggttcaagcaattctcatgcctcagcttcctgagtagctgggattacaggcacacactaccacgcccggctgatttttgtattttttttaatagagacggggttttttcctgttggccaggctggtcttgaactcctgcctcaggtgatccgtcctcctcagcctcccaaagtgctgagccactgcgctcggccagcgtaaatttcttctaaagatacattttagctattaaaaaaatctattttagctatagctacagcttttagctatcagtagctatagataaaaataactatattctaatatggcttaaatggagatatgaccctctcattgatattttcctatgtgtaattatttttgaagcattgtgagttctgtgaaattttgctatttattgaactatgaaagcacttgattttcttaactcttgagtgccagaaatttgggaagaatattcctgaggattagacaaataatgataccttgtgtatatacatggtgttggaatgtctacatttcccttaagggcatcaattccataagttggtctacagataacttcacattagttgaccattgtttaacaatgctttaaagttacatttgcataagaatccaacttgatttttctaggaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcaggtatatataaaacaccctaagactgtccagctcataatgggtgtgcaataacaataataactactagtattattccttggaatggtacttgggaagctcttaagcatctttaagtgataggatgggttgcgagagcggaatcagtgaataaaatagttccatcttcggggcaacttctgtgccatttcccacctgtctaggaaatttcacccaacctttttacaaagttagagtacctgatggtctcttaagtgcttgtctcactgattccgagaaataaaatatgaaatcagccatactgttttaattataattacaaattgaagaagagtcttaaagagcacaacgataaccatcttagcactattggagatgaatttagaaagattttcaataatttttagttcttaagatttctaatgtaaatatgttttagagggtaagttttgcctagtcttgttaattaatagcatctactccaaggcctttacttattgtaatactggctgaagttgccttttggttttaaattattaagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaaggttagtttatatgagaattcagttcattaagaaacttttcacaccctaatcgccccactcacttttctccagacacaggcaaagatccatttcatacatactccttttcactttgaggaatgccattcagtaggagacaggcattctttccccctctcctacttagatttgtgaaaatgacagtttatctggtgttttcttagatgttaaaaacatctttcagttgataaacctgaaggtttttaatgtagcttcttttaagtgttatattacctttcggggttattaggtgtaggatttattatattaccttggttattggctccttttttttttacacactgcagtgtttcataatacgtcttataaagtgagtgtacattgttgcattaatcttcatttgtagcattcatttaagttagtaattaacatctaagtacctagaagttgaattgcttacatgtgtcttacccacgttttcaatgggatcaacatgctctttcccctttactttttcttttttctttttctttttttttttttttggtgtggcatcccagtagctgatttactgtgctgttggcactattaatggactttttaatttgtgtggcatgttttcacaagaatattctcatctaacttagcctttattggaagataattctgttaaccaccagggtctcctttctgagtttcatgttcttctattttgtattttttatataaaagatataaaatatcttttattttgtattgaatgagctgttgtgctttgcatggttttaggaatgagagaaggggcctatttctgattttctcagctctccttgtttcatttcattctacctgtctccatgtttaatcaccagcataatatatgtgctactattaaggtttattatactagtcttttgtgtgttgtttgtttattatatcctttaatagaactgtcctggttttttgttttcgtttttcctctagactcagctagaactagcagcacaaaccatggacatattttttggtctctgcttttattttcttaaaataagcacacactctttttctgaaatatttaacatctattggcttttactgtaatgtgagaaagtgttgaaaacttttgtcttcctgccagatgtgctagtgtttgccattcaagttgagaacttgcttctgattcaaaaggcagttgctacaaagggttaactgatttaacattagatttaagaatgttttacctaatctttttgcaagactttctgtgtaatgtctttttgggttgagaggtcaactcttaagagccaggtatgactgtcaggtcaaattaataatatttgttttgagaaagtttttagttttacatttcctattgttagctttagttgctctattctgtgttatcatttgtgccacttaaaattgttgggttggttcttagggataaaagctagctagc

SEQ ID NO: 86999 - DNA, 1015 bp, Homo sapiens
gggttcaagcaatcctcctgcctcagtctcctaaagtgctggggttataggtgtaagccaccatgcctggcccctagtaaaacttttcgttaagcggaataagctgagttacgtttagattagcaacagacagggattttccatgtgagacttggtgcaaagagagaagttactaagaaaactgtatcaggcttgtctcccatgattgggtatgctatgatagagttaaacattggaatctcttttagaagtgatataatttattggcattttgaaaatgctatgtaaaaataaattaattaaaatcagtgtgcagatgagtgaatttaaaaaatgtaaaaaaaaaaatacagaaaagaaactaccatgtagccatctaggcactcttataaatgactgaagatctggactttgggaccaggtgtgagccacagtgggcatttattaatggcaaatgagaaaaagcaagtttattactccaggtgctatgatagaagcagtttatcttactccacaaatgaaaagtggtttctcacacaaagctgtcagcaaccagtgtaaggtgctctctttgtcaagagagtttccttttttcatccatagccctaaaatccaccacaaattgtggatgtccttaggactattaagatctaccatatttacatagggcagaagataagattattggactgactactagtcctctacgggacaacaagacgactcttcctcattgaagctacctgtgcaccggagaagcccataaggcacaaagggaggactttcccacaaggtcagttagagcccactgtcctggcacagttctcacaagtggacagacagacatgaagcaagtcttgcgcttaactacttggacattgctttgtgtattatgcaagtgttacggactaaatatgctcttttacataagatcttcagttctctgagtgggtgcccctcccataccatgttttgtttttcattaccatctctttcctagatatttggtgttacg

SEQ ID NO: 87000 - DNA, 5573 bp, Homo sapiens
gtagttgtagtttttaaaacatgcctgttataaacattcaactttttttcaccttttggggtctccatttttacccttctaacttaataattgaacctcatgtgaacatagttttgtatgctgtcttttatacctttcccagtgctttttgatgttttttacccacaatgaaatttacttaaatattatattctgcaatgtgcttaatagcttctcaccaattgagagaatttacccactattttaccttttgcttccttgaattccccttcctgccttctctctcatatattacaaattttatccctttggtaaattcaccaaaccgttgcttgcagtctgtgggaaatgattgtctctcatctctcagttgtttcactttttttcaaaatcatgtctttattgtattttactttaaaatccatggtcaatgtcttcttttatggcagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaactagtcccctgttttaaatacaagagttacactattactagaggtgttggtgtacagttttatctgatttgttctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatcctgacaagcactctttagctggctagctatgggatgatgtagaaaagcattcaagagctagtttttgttaagtcctgtatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcgactgtataaaagtattctctccagctacgtatatacacacatacatatatatcatagcaattccttgtggtttataacttgcaaatactgctatcagtttataggtaaagaaacagtgtgttaaatgacttatccagggagggtcctgtggcttcatgtttatggagttgctaggtctctgcctcatggtccagtgcctgttaagccactgtgttcattctaataggcataatgaattgttaaagaatttactaaaatctcttccaccaaactttgaaaaataatgaagccgcccccactttagaggctctgtatgaaaaaatgctgtggagacagagccctcctggctccctagctgatcctggagatgcagcaatagatgaatgggttatctctgaatttgtaagagataattcacatgaggattaagataaaatgggaagtaaaatctaacaaacacaaagatagctcccaggcactgctttgtgtagtttgacagcattgtggttgtagcagcaaaggacttaaagtgatagtttttaaaccatattctgtccctaagtaataaaaaatctaggaagttactaaaataccagatttgttctgctctgcctcatctagaatcaacgtctaactaacttaaatgaagtataataaatgagttcatatgaaaaggcttcctctatggacacttagatatattgtaactattgaagttacctgggatgtgggggtggtgggaggaggacctgcctccccaggacatctatgactaaggcctggctttagttatggagagagacgtagaagttgaattttacacccaaaattgatgtgactgaagaggaactgattgttgctaaccagctcacaagaatccagtattgagaccagttcactagaagaaacaaacatttctgccatgcagaccaaaaagttattagttggtgaatatgtattttctctttggaaggtctttaaggggagcaaaccagttttaatcaatcagattgcttggtaagtttggaatctgcaatcagttggtcttaaaaaaaaaaaaactttattttggaaatttaaagacatacacaaaagaggaacaatataattaacctctgttaactcatcaccaacaagactcatgaccacttttatacttcatgagtgattgtatttgtatccactgttttctattattttcgagcaagtctcagacacaccatttaatctgtaaataattcagcatgtatctctaaaagacaaagacctcttaaataacagttcattagtataaaacaaattgggtaaacttttgttggtcatcaaactatattagcactggtccaatagtttaattttcattgagcctttcaagaggaccgaccagtctgctgctcaagacatcctctcctctggaatgtagagataatacatatcatgctcctttttgttaaaacgtttttttttccccttcaaacacagtccattcatttttcagtttgggttgaaacatccttttcttgatcttgagcttataataacctagtcatattgctcagctcagatatttttactccctctccttaggcattctggttccttaaatatagttagtgtcacagaggataaataaccaaccttatttctaaggtctgagaacacttggaccacatattggttgagctcagccaccttctgattaaagttttcagacttgtaagaactgaaaatttttatggtggaagttctctgagccctcatccattctgtttttaaaaatgcattgcagatgggctatgtgaatatgtttttaaacatctgatatgtgcatgaaacaaaaaacacttgaagttattatgtatacaattctgtgggatgggacttcatgcaggattggttttcaagtttgatttcctgagggattttttagttgtttgtgaaagaaccccaggtctacttttgaaattttgtattataattgtaatgttgcccatggttaaaaaaaaaaagtgttcagtgatctatgtctcctactactcctatttctctgtttttcctctgcaggagcttgctgctgttaacagttattcttccaagttgttttctttgtggggagatgggaggtgggaggaaatataaacatatatgtatagatctttcaaaatatatgacggtatacccgtatgttctgagtcttgctgtttttacctggtaatatttagaaacatttattttgagataaaggagagcacttttaagttgaacctgtagttttaaaaagtacatttcaagtaagccaaagcagagaagtaaatgtatttttcattgttgtatcagaattttgaatttactattttaaaaattcaagagttttgtagctgatctatttcttcccctcagccatcccaaataggtcatttgtcaacagatttaaga

SEQ ID NO: 87001 - DNA, 1085 bp, Homo sapiens
gccattcattcccggatacataccctagagaaactcttacacatgcgtaccaggggatggatttaagcatttgtgtgtaataggaagaaaagaagaaaaaacccgggaagatcccaagtgtccaccaacagtgtgttggataaatactgtggtatattccaacagtggaattccacagaagtgaaactgaactgcagctgtgtatgtgaacatggacaaaactcaacaatagaaggatcaaaaaaagcaagtcacagaagaatacatcactatggttccatttcaatgaaagtcaaaaacaggctgtcaaatacatgataaaaggaaacgattaagacaaaatttaatgttagccgttttgatggagggagaggtgatcatgagggcacaggggtcttcagaagaactggtgagggtctgtttctgaagcctgtgggcatttccttttttaatctgtatgtttatgtgcttttgtatgtatgatatttcttaataaaatttaaaaagaagaatgggaaaaaagtcttggtgtaggtagttactaatatataagctgtagtgtatttcgtaaaattaaccatcagtcagtgacaaatttaaagatgctgtttcttgagtgcccaatttaaggttttattttgtttgagacagggtctctgtcttgtcacccaggctggagtgcagtggcacgagctcagctcactgcatctttcgcctcctgggttcaagccattctcgtgcctcagcctcccaagtagctgggattacagcttcgcaccaccacacctggctcatttttttgtatttttagtagagtgtttcaccatgttgtccaggctggtctcaaaactcctgacctcaaatgatcaggcccaccctggcctcccaaagtgctgggattacaggtatgagccaccgcgcccagtcttcaaattgaggtcttaattgtaactcttaaaaagctagaaacggcgacaagagcaagactccgtctcaaaaaaaaaaaaaaaaaaaaaaaaaaagaaacctaaatgtatgttttctgtgtgataccttattttcatcttaacatagtttctacttgt

SEQ ID NO: 87002 - DNA, 1076 bp, Homo sapiens
gctaatatttcaaatacttagcaaacccaccctttgctaagcaaacaaggatgggtttgtgtttttttttttcctgaggactatgccattttatgttaaccagtcaattttgcagagattggtggggccaaaagcactgaactaaagccttaaattggggagtcacttgtcattcagaggtttgtttttttttgagacagggtctagctctgtcgccaggctggagtgcagtggtgctatctcagctcactgcaacctcctcctcctgggttcaagcaattctcctgcctcagcctcctgagtagctgggattacaggcacgcgctgccatgcccagctaatttttgtatttttagtagagacgggttttcaccgtgttggccaggatagtctcgatctcttgaccttgtgatctgcccacctcggcctcccaaagtgctgggattgtactggtgtgagccaccgtgatcggaccatttagaggtttttaaaaggtttatggattagatgtgcaaatcttaaaagcgccagattgaaaatgacctagctaccatgtttggccgttttgcagccaggatttctggtgtcatgaaatgcagaagtgtaaacgattggctccagagaacatgatgtcacccactgtgattctgcatttagaaactcttaacccttacctttctgagcagtgtgtttggtagctttctgatcttctccactcgttctggtttaatccccagttcacagcaactcacgtttagtaggttttggtaactcagttcttgtctcttcagttcaatttcaatgaagtcattttctttggggttctgaattctgactttaaacacaagctctaaatcacccataaattcaaatacagtttgtaaaggaaacaaaatacctgtcagagattttcatatctattattacagcataaataatcctaaaaactgaatgttaagtagacatggagctttcatgggcacatacacactttgcattagctgagggttcttttcttggagtgttgggcaagctctgggatgtatgcccccattatatccactgaagacagaaag

SEQ ID NO: 87003 - DNA, 1095 bp, Homo sapiens
ctccgctgcggccaccctagtctgattattgcaatatcccctcccattcccactggtctccctgcttctgcaccgcccccatatctcttctttctcagcaataaagtgatccttttagcatggaagtcagagcttgccaggcctctgcttctcattttgcttagagtaagtgcctaagtcttgcaatggtctacaaagccctccacagtctggatcccaggagctcctgcaacgtggtcccctctctcacttggctgtagccccactggccctgtgctccttctcaagtacaccaggcaagcccctatctggaaggagggcctttgcactgcccgttcccttggcccggaatgttctttcctcacatatccatgggtctctcatccttcagcaggcctgcccgggcatgttctcatagtggagctcagggcaagaacagatggagatgctaagccctcttctgcctgcctccggtctgctaacatcctgctggccacagcaagcacgtggctgagcccagagtctgagtgggagggcaccaggatggtagatgcacacggtaaagacacagggagtaaagcactggggcccttgcacacatgattacagccccttgatctgagctccaaatcccaggcctcctcctgcacagcgacctgccaccatcagtaactctctccaccagccaccatcccattttcattcagcaaacatttgtggagcacctgcagtgtgcaggccctgttctagacactgtgaggcagctgcacataaagtagacgaaggccctgcccttttaaagttttgttttgtttttttttcttttttttttttttcgagacagagtctctctctgtcgtccaggctggagtgcagtggtgcgacctcggctcactgcaatctctgcctgttgggttcaagtgattctcccatctactcgggaggctgaggtaggagaatcacatgaaccccggaggcagaggttgcagtgagccgagatcgcgccactgcactccagcctgggcaacaagagtgaaactgcatctcaaagaaaaaaaaaaaagaaaaagaaatcctatgtgtagggacaatggg

SEQ ID NO: 87004 - DNA, 1079 bp, Homo sapiens
gaaatttcatcttggtacatatgtttgacatcggagaatgactaactcaaaatgtgatcttgattggttttattaaaacttgagcttggtgtccttgagaacttcatctttttttttttttagacagagtctcgctctgttgccaggctggagtgcagtggtgaaatcttggctccctgcaacctccgcctgtcgggttcaagtgattctcctgcctcaacctcccaagtagctgggactacagacgcgcgccaccacgcccagctaatttttatagttttagtagagacgagacggggttggccagaatggtctcgatcgcctgatctcatgatcctcccgctttggcctcccaaaatgctgggattacaggtgcgagccaacgcatccagcgaggacttcataattttttaaaaaatgaacaaaggccctgtttacatgccctttttgttcattaggaatgggaattttttaaaaggtgcttttgcctagcacatctgagaaaaggttacatcttagttccaagtcattttctccccaaggtgccatcacacttttgactctctgtggggagaccatttcggttgacaatttgatgaattcgttattttcacaggcctttcccatctttttgactcctataactacagatactgtagcagcctctgaataccctgagtgtccaaaatgttgccttacagatttcatagctcatggatgagtaaggaatattataccaaaaaatggctttctaagtttagtatattcgttttctgccctgccttgtcgtttctgaaatcaggtacattgtgaaatgtccttttcgcctataatagatggcaaatgtaaatataggccttcttcaaaatgcctccttaaagataacaatatatgctgtgattagttaacttagcttttgaaggtgaaactaaaggtactctgagtttaaaatatttttccagggcaggtgctgtggctcatacctgtaatcccagcactttgggaggccgagacaggtggatcacttgaggtcaggagtttgagaccagcctggccaacatggcgaaacccatctctac

SEQ ID NO: 87005 - DNA, 1355 bp, Homo sapiens
gtcatgggacttatattacatttatcttatttggatatgtttgcttttgttttaaggaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaaatcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttaagcttatagtaaggatacattcaagcttgg

SEQ ID NO: 87006 - DNA, 1451 bp, Homo sapiens
tctcttgggtttcagtctaacatcccccaccccttctaggctaagagcagggcctgaggtcaccatcatcctcaaagcacacacagggtccttttcccgtgtctcctgtcttcctttgaaagtactgatctgagttcccgttcctaaagcacctgtccattcacacccaaccacaaacaggaagacggacaatcaatggcgccacgtagctcaaatcagtgagtctcaggccaaggagggtaacacactagggggtgatggggactgtggcaagctagcaagtgtgtgccatctgagggagcactggcaacagccatgtggtccagaagcttggccagagaagccagaaatcttactaatcagttcacatggttttccccactagcattagcaaccagttgacttggtatgaaagatacaggtgtggaagtacggctcatataggacagcttccctccatccctcagagactctctgcctggcaggccctgatctgggaagacttaggaggttgtccctgaaatccaaggaatctcataggctcaggaaatgctcatcatgtctgctggcttctttcggtaaacccagtggcccttaggctgggcagcacacaagaatcacctgtggagccatggcattcctaacgccaggctgcacccaggccagtgaaatcagatcctgggggtgtgagccaggcaccagtctttttgaaaaaaagctcctcaggtgatccgaaagtgcaccagtggcatcggcatcactggtagcttgttagaaatgcaaaatctcagaccccaccttagatctgctgaatcagaatctctgggggtggggcccagccagctgcagtttcacaagcccaccaggtgattctgactcaatacaattccaggcgcacaatctcagaccgaggcagtgtgaggtgaagctggtgcctacaggaacatggcacatctgaaaataaccagctttacaagagatggtcaatttaaagacactttttgaaaagaaaaccttactttgattaattaattaccaggggccagggaacactgcaagttgggctcttctctcttaattcagttggaaacgtttctccctctgacttcagaatggtgaaacatcctctcctttacagtctggagacagaagccctcctcactcctccaattccaccgcacgaggctggcacatagcagatgctcattaagcattagtttctctccttcccatttccccttggaatttctagagcaggggcttacacacatcctcttgctgttttgatttatattaaagttagttccagtgcccaagtgcctggggtggcaggtggccaggtggccagctggccagggattaggaaatactgaattgtctttattttaaaaccttggccaatgccagggaatataaagggaagtgaatgaagtgggaagcaaatcatattg

SEQ ID NO: 87007 - DNA, 1023 bp, Homo sapiens
tacaggctggctccttggtcaagatcctgtgttggattcagcctaagcccacaggtgtacatccattgcctggagacacctgtgtcggggaacagggctgagctgggagcctgttctcatgttatccctccagcccaccctctcccctgaactccagacctacacggccacaaactcagcgtctctgcttggatggatgatgggcatctcaaacttaatgtgtccaccatgtgagctcctccagtcttcccccagtgtgactaatcccaactgcctccttccagatgatcaggcaaaaccttagcaccccccaccccctctcacccagcatccaagctgtcagaaaatgctgttggctctgccttcagaaactgagcccctcacccaacctccattgctatcatccagtctaagccaacatcctcactcattagattcttaaaatagcatcggcccttgccccttcatgctatccccagcatggtagccaaagtggttttattaaaaagtgagttgatagtgtcacttgtctgcttcctctgcagtctaaggcaacgccgaggtcctgtcgggcggcccctctgtcatctgctcctgccccacctctccaacaccatctctttccacggcccatttgctccagcctcactggcctctgttccttgactacgcagtgcacatgtcggccttggggcctttgcacctgctgccctgctggctatttttctggtgggaagcaggtggcttgggcaggcctctggggtacccagtatgttggaggagggaaggctgtggggtggcaggggagggagcaaggggtatcccttcttcctgaagtcccctccttgaagctccccacagtttgtccctcaccttctttacatcttcattcacgtgttatcttctcagaagagccttcactaaccaccatgttaaaaagtaaagatcaggctgggcacagtggctcacgcctgtaatcccagcactttgggagaccgaggtgggcggatcacctgaggtcag

SEQ ID NO: 87008 - DNA, 1033 bp, Homo sapiens
gtctggtcatgaagtcattgccaccttccccagcctgcacccccaccacccctgcccccatgctgacatcccatttggcaaagaggttggaaaagccgctgactcttccagaccctgagttcattgactggtcagggcgcatcggccacaggctgaccatgtggccagaggggggtttgcagagtgagggagtggcccctccaggccttcctcccctgcctcaagcctccccctgaccactaagacactcctccaatatccgcccacaccccaactatacatacctgacctacacacatgtggcccaccccctacacacttgctgcagacactccttacacccctcgtaaacacatgccaagcacacactcccctgggcagccacctacctactgaggcacacccagcacaccagactcccacacatatgtgtatgtgccactccctcatacgctggtgtgagctgttgggcaccaccagctacccacggccacagctactcctggtccaccatggcccagcctcttgggctgcatcaggcagatgcacctggcctgagccaggctctggtgggagggtctctggcctggggggggtctctagatcagaggcacaggcggccagacttgaaacgcctcatctcagccaaccccttcactgctcatttgtggaaactgaggcccagagaaggcaaggagtggtcaggggctggtcacgtcacacaggcaaactcctcccaagcgcctccaagtgtctgagagcgtggcagaaaggcgggcagcccaggctccctccgccctcaatgcgctcctcaaatgtcctgactcagtgggtcctcttccatgagttcttccaggatgacgcccaagactgggtgagcttttcaccctctgccctgggtgcaaggtcatttgaagctaggcagggggcacacccactgttgggcctcagccttcacaggctcaggatgttagtgtctcacatagccttggccttgctcagcaaatacccagcgcaggctgcagtcccacaa

SEQ ID NO: 87009 - DNA, 1024 bp, Homo sapiens
gcagcctgcgctgggtatttgctgagcaaggccaaggctatgtgagacactaacatcctgagcctgtgaaggctgaggcccaacagtgggtgtgccccctgcctagcttcaaatgaccttgcacccagggcagagggtgaaaagctcacccagtcttgggcgtcatcctggaagaactcatggaagaggacccactgagtcaggacatttgaggagcgcattgagggcggagggagcctgggctgcccgcctttctgccacgctctcagacacttggaggcgcttgggaggagtttgcctgtgtgacgtgaccagcccctgaccactccttgccttctctgggcctcagtttccacaaatgagcagtgaaggggttggctgagatgaggcgtttcaagtctggccgcctgtgcctctgatctagagaccccccccaggccagagaccctcccaccagagcctggctcaggccaggtgcatctgcctgatgcagcccaagaggctgggccatggtggaccaggagtagctgtggccgtgggtagctggtggtgcccaacagctcacaccagcgtatgagggagtggcacatacacatatgtgtgggagtctggtgtgctgggtgtgcctcagtaggtaggtggctgcccaggggagtgtgtgcttggcatgtgtttacgaggggtgtaaggagtgtctgcagcaagtgtgtagggggtgggccacatgtgtgtaggtcaggtatgtatagttggggtgtgggcggatattggaggagtgtcttagtggtcagggggaggcttgaggcaggggaggaaggcctggaggggccactccctcactctgcaaacccccctctggccacatggtcagcctgtggccgatgcgccctgaccagtcaatgaactcagggtctggaagagtcagcggcttttccaacctctttgccaaatgggatgtcagcatgggggcaggggtggtgggggtgcaggctggggaaggtggcaatgacttcatgaccagact

SEQ ID NO: 87010 - DNA, 1033 bp, Homo sapiens
gcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgtatgaggtctagtgtgttttgttttgtttttaccgttcctggggatctgaacttggtttttatttgcaagtccaataatcttccccatcacacatgtcattcctgagggtcaggactgttgccatttggcaccagctaaaggtgagcagtggggaaccctcatgctggtcagcttggctcacgtgttcaggtgagatatgagaatagacaagagggcttaggagaaatgtgggatccctgagtaacagcccacacatgatactaaggcatactatttg

SEQ ID NO: 87011 - DNA, 1064 bp, Homo sapiens
tttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcaccacattggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggag

SEQ ID NO: 87012 - DNA, 1070 bp, Homo sapiens
atccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggtt

SEQ ID NO: 87013 - DNA, 1183 bp, Homo sapiens
aggctgttagtgtgaactttagaaattgattccagggatgtcagcaggaatggagtcatttcaaagtgttttgaataattgactattgttgaattcccttttatgagaggagttgttagggactccacttggctggggtgatttttgtaactttgtgttggagtgcagtatgtcagttggaaccgtactgaggagtttgttaataaaatctctatgtggtttttccatttccactaaaaattccttccattgtggatcctgaaaatagaacaaaaattgcttaaccaggtttggcagtatctctagttatttccagcctgaaaaacagacttgtctttagcataggctaattttaatagtgaatatactgttgtaaaaaatcaaatttgatcttttttgggggtccatttcctttttcatttcctgtaatattttaacagtgagaaattgattctaaagtcccatatttttaatgatttaaacttaaaacttaggctgtagagaccctagcagacaggataattttcttacaagtaaaatcttcagaacaactcagaagagaaatggcgacagccttttgtctcagccagttaatttttttcattgaaattttttaaaatttaagagccaaacttaatttttttaccttctaaccacctgggtatgtttcagttcagagatgggagtttgaactgagtgttctcctctctctagtttgatattgctgtgaaaaggccattacagggctgggtaagggaaagtttggcctgcagagaaaaatgcagatatttagggttttttctcttctgttgtttctagtcaacagtatcaatattttcttttgtccagctgaaattcacatggggcacattacaaaattctgttagatcagtggaatatatctttaggtcctgtggtgtgtatgtttttaggattctgctgaagaatccatcccactagacaacttttcactgggttgtgccaaaataaccctgctctgtgacaacagatacaattgatgcaagcttgtatcgagaattatggtatgccctgcactgggtcttatggagaggagtgtggtgtaccccagactgggccttggaagccagtgtctgatcaggacaccatggatcacattcacttagccgtgatgcagaagaacctgtatcttggctgctacccc

SEQ ID NO: 87014 - DNA, 1029 bp, Homo sapiens
atactgaagcagaccttcttgtgtgcatgtgtaaggattttttgttgggtataaatctaaaagtggaattagcaacatggttgttgcgaggccagttggccctaaagattaaaccattctggttggccttatcagtaataccactgtgctcttgcttctgtggcagaactaactcgtctaccaacagaagtcattgctggcatgcttgatttcttccaaagtataattgagtaatgcatgaatgaatccctgtggggatacgtcagactatcctatccactttcaacatacattaattttgttacagtgtgtcgcattaatggctgtccagctagctcctggaggcgcagtctgtgtagtttgaccaaaggacagcagattctgacaaggaaaaaaatatcccacaattaaatcttgctaagagggttggcttagagattgctcatttgttcatagttgtgaataatatttaaaggtttctctctttctattatttcacactcaaggattctaccttagaacttaagctttagaacaaacagcacatttactagtaattttgtttgcataatctaaattaaaaataacctgtattttccttaaatatgagaggaaagccatagatttgaaataaatttaaatgttaattatgactatgcaaactcatagggcttaagttgaagacttttctcagtctcttacacaaataagcacattccttttcaagggagagaccttttccactgtcttctcagatcaaaagatttagactataatagtttgaagcaggtaggctgtgcatggtggctcacacctgtaattccacaacttggaaatcaaggcaggaggatcacttgagcccaggagtttgagaccagcctgggcaaacatagcaagacttcattaaaaatttttaagagaccaggcacagtgtctcatgcctgtaatcccagcactttgggaggcctaggtgggtggatcacttgaggtcaggagtttgagaccagcctgaccaacttggtgaaaccc

SEQ ID NO: 87015 - DNA, 1143 bp, Homo sapiens
tactgtgagggagaaaaatcagaagataaactataaagaaagactttatttgcaaatatacccatttactttaaactgtataatggttagttttctaacatgtgcattaaaaacaaaacaagaaacaactaagattcaaatttgttttttttttaactaaaattattttttaaatgaatagatgtgtttaaaaaataagcttacttattgctagactggcaaaatcccctactccatttactgaggtacttaaaaataactagcatgctgtatctctttttttcccagctttgtcttgaattggcattgccatccttgttttatctcaactggctgtagcttttagataatatcataaggattaaccagtaacctcttacattcattactgttttctaggggaaaatatttggtatttggtttttctgttgcagcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtatgttagattattctgttgagatgttccatgtaattgtctctcttctgtcatctcttggttccactacctaatagtctaaggctaagtactcgaattgcaggtaatttcaatatatacgaaggaagttctgtaatggaggtgtgactaaggtgctatagggatacttgaatgaagttactttggaatatctctcccacccccaaagataaatttgttgatttttctttaggagacttgcttacttttgaaaagcagtagtattattttatcatcgtggattgccaaaaatggtcttgacctaataagagaaatcactagaaagaagcttctatcatcaaggctgcatggaggaagagagaatgcactctggtacctttagcagcttaataggaaaaagcagtgaactaggaggcctgggggtctggcccctgtgtctctgccactaacctcgagcaaggcacttaacctcagagactcatttcctcactcctaggtggatgtgattaatatctgctctgcctacttcatt

SEQ ID NO: 87016 - DNA, 1193 bp, Homo sapiens
gcacagccacctcacccagtccttgtttttatttttaaatagtctaaaatgctgggtagaaccaatgaattaagttatctcaggagtagtgaacttttatcattgaaagtgtcagacgtttcaatctaccttactcttttttttttttttttttctttttttcaagacggggtctcactctgtcacctaggctggagtgcagtggcaccatcacggctcactgcagctttgacttcctgggctcaagtgatcctcccacctcagccttcccagtagctggacaggcctgcactatcatgttggctacttttttttttttttcctgtagaaatgaggtttcactgtgttgcccaggctggccttaaactcctgggctcaagtgattggcccagacctcagcctcccaaagtgctggtgttacaggcatgagccaatgcacctggccccttattgttcttgatggaaagttgggatcattttggactcctcttctcttatttcccacatctaatctgtcactgggaactgtcaagtctgcctctaaaactgtattaaatcagttacttctttatctctaccactatccttttacccccaggcctcctaactgggctccctgttgccaccccagtctgttctctgcctagtaaccaaggtgcagatattaccttcacacacctccactgttgcctttaggtgaggtgacatgaccaggagaccttacatgttctcaaacactctccttgctcataccgacccacagctcagcaagctccttcccatttcagggtcctcacatgtgctgctgtatcatctacctgggaagttcttcttggtccctttttacttacttagctttcaggtcatagcctaactgtcataatcaggagagaccatttaggtcctgtcatactttttcttcatgggcttatcattattgtgatcgtaccagtcttatgtgattcttgtttataatctctcccctacagaccctaagccccgtgaagatcagggaccatcattgtcttgttccctgctctatctttagcacctgacctagtgttataatgattattagaaatgtcataaaggattcctttcatgaaaaatgattgaactggatcagtggttttcaaccatttagagttactgccctcagaaaaccttatttctagctatgtaccttctcccta

SEQ ID NO: 87017 - DNA, 1025 bp, Homo sapiens
ataggtggttgtattagtctatattcacactgctgataaacacatacccgagactgggaaggaaaaaagaggtttaattgggcttacataggtaacctctggggaggcctcagaatcatgacaggagatgaaaggcacttcttacatggtggcagcaagagaaaatgaggaagaagcaaaagtgtaaacccctaataaacccatcagatctcgtgagacttattcactatcacgagaatagcatgggaaagactggcccccatgattaaattacctccccctgggtccctctcacaacatgtgggaattcggggagatacaattcaagttgagttttgggtagggacgcagccaaaccacatcagtggttgtatttttacccttccaaataatctggaaataaatttgaaatagtattgccttttactgtaacagcaccaccttatgaatatttgtacatacatattgttttaaacatttttcctcctttgcctatacaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtaagagtgagtcatgcgtttctctgccctcccctccatccacctacctgctgggcactgatgtagcagctgaagatgcagttctgcaccttgctgtcatgaagcttatgttctagttagggaagattaaaaaacaaactggaaaccattgaataaagaagatattttcaggtagtgaaaaatactgtgaagaaaataaaacaatgggaatatgagaaaataactgggagccagaggactgtttggattaattaataaggaaaggtcttctaaagttttggattaaacattatgtgatgttaaaacattagtttaaaaattaaagaagtgtatgtgatatatccatatgttgg

SEQ ID NO: 87018 - DNA, 1041 bp, Homo sapiens
ccactgcactctagcctgggcagtagagcgaccctgtctcaaaaaaacaaaaaaacaaaaaacctgaacttgatttcaaggagtaaataacagcagtgcttgctcatgtctcagtggatctgtaataagttcacttttgatgaggcttactaatgtgcctttttcactcctccttccaccattattaggtaaccaatggtcaaggtgaaaataagatgaaaaatttacctgtgcctgtctatctcagacctctggatgaaaaagatacatcaatgaaggtaagttcattgtgaattaaaaggagatgttttctaaactctgggtagttttttttctaaaaccaaaaaagtataagtattacttctatggtgaggttattgttcattttataatattaggttataagacctgtatttacaaccattagttattttaagaaaacatgaaaatgctaaacatttctagacttaatattgttttctttttcacctgagaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggtaagtgtgtgtactaacatttgacctggtttatgagactatgagtttaactctttcatccaaaatttgcctctgggtccagcttctaattgggattactatgccctggcttactgtccctcagcacccttttaaaatcaattttaaaatattgaggtataatttacatgcaataaagtgtgcactcgaaatgggtataggtcagagttttgacacatgtgtacacgtatgtaatcactacagtgatcaagctaatggaacattttatcattgttctgctttacctgttagttttgtgttgctgtttagagacagagtctcactctatcacataggctggagtgcagtggcatgatcatggctcactgcagtgtta

SEQ ID NO: 87019 - DNA, 1702 bp, Homo sapiens
actgtgcccaactggacttcactttccattgctgtttttaactctagcagccaagtggtagtcaacaaattaaaggaaatagtagcttacttttaactacttcactgaagtaaagaatgtttttaatttagttcataacaaaaaagtagtgaaaagagagctctgattatgatggcagaatccctaccacctcataaatcaatttggaatatcttattttctgaaattttgttgaatcacctgtcaatccagtttatcctcttccctgctgtggtcatctttccagtgatggaaaagttttagtcttgtgaaaaatgacccctcaggatgccaaagtttcaagctattttgtgagagctccgagtatagatgatagagacttttatgtaaagatgggaatttacaaggcaatattttaataaaagggaaagttagagggtatcttttcaataaaaaattttaaatatcattcaggcatgttggctgtctagcacatattacagtcctctgtcggtagactaagctctttgagggagggatgatattttatttttcttagtagaattaaagtcaatctttagcagattgactgacacatggtaggtcaaagtaactacagtatttattgaacttaattgttgactcccctctgtgtatcccatgaacttcttgggtctcttgttcttcagaaagaaaggtagaatacctcactgataaatgtttcttttcttttctttttgaatgtagggcatcacgagaaaatccagccatgcaggaaaaaaaaaggtcaagcatttggcagttgtaagtattgaaaaacaaagatgttagacagcacatgagacaagaaaattacagtcaaaatttatttccaagaatgattttatgtccattttctttccttcattttttttttttaaactaggggtaatggttaagtagctaaactgaactttttttttttttttaatatatagtgtgccaactcggtaaggctcttctcaaggacaaaaaatatgatatcgtaagctgcatcatgttgactgtgcatttgttgcaatcctctgccaaatttaaataatggggaattatttagagacttgaaaatgacctggatccccattaaataagtttctgattggctggttttgtgattgtaagaaactttacaaagtgaagatgagaaatttagtgcttgtagggtttgagtaatattgtgtatgtattgagcttgagttatgtttgtgctagaagtactatgtgtttactgtgattaaaacttacccttttttggtgaatctgctatttaatggaagtgtcaattaaaaaagaaatagacccgaaagtagttgtttaaattgagcttaatcagaaaatgtataaaatgtgtgttaacatggtaatatgtgttccagtacttgattataataagctgtttttagaactggcatactaagcttccattcacatcacacagccataaccttgcggtttaacaatcgctcttaccttgcaccaagtaggagctagcaaaaaaaccaaaatatatttattcagtaggagaagtttcctctatttaagagcttcttgctttcattatacaaattgctagttaaagaacaggcacccgccattctaagcaatagtttctcttcactgaatgtctgagtttggctacgagttactgctaaggctacagcgt

SEQ ID NO: 87020 - DNA, 1037 bp, Homo sapiens
aggaactggatatcagggttttttcttcagcgtagactgtcttaactttccagtttaaactgttttctcattatttattaaaggtaacatcaagaaataattttactttattgattgggtaatatattctgaggaattattaacaatagtaaccttttgaatgctatttttaaaatttaatcttctcactttttagtaattgatgatctgtcttgttttattcatttgataaatgagtaaaatcttagactgttgctttgtgttctttttgcatttatctacaaacaacattgggtagaatgtcttgaagtattaaattattattgtctatggttgtacagtttagtctacaaaggaatagctgaaagatggaaagaatatttatttgtaatgatgcacttgaaatatgtgtttcttagaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaagtaagttttaactgtgttgttctaaaccaaactctttgccagttatgccacaaagggttacagatgtaaccctgagactgagaccttctgtccactcaagcctggaaggccaagagctgcctgggagagggcaaagtgccccagcccattgcctctgctgtgagcaggcccctccagttgttagcctgtcatctaaatattattgtcttttgttttttgttttctgtttttttgagacggagtctcactcctgttgcccaggctggagtgaagtggcaaagccttggctcactgcaacctctgcctcccgagttcaagcgattctcttgcctcagccttctgagtagctgggattgtaggtgcctgccaccacacacagctaatttttgtactgttagtagagacagggtttcgccatgttggccaagctggtcttgaactcctgacctcaggtgatccacctgc

SEQ ID NO: 87021 - DNA, 1017 bp, Homo sapiens
cttgcctatagcctcccaagtagctgggactacaggcatgcaccatcacgccagcgcaacctttttctgattttactaatttaaaagaatctcaacaatttgtcctttatcttgattggtgtctcatccctcaactttcttatttaaaactctctttgctgggtttctgtgatatcaacttgcctgtgtcctttcctgtctcgactcttaccttttcagtcatcttaacaggatccgcttcctttgctcgtctttcaggtatcagcgctcctgtcctaggcctgatactttgtttaagaaatcatgtttgctctcattgtttcttggttttcatggctaattactcccaagtttttacctccatctcagatctttttctagagcccaagactattatttcctaattgcatgctagacacccctaaaatgacttggagggctttacgtttgacatgtataaagctcagtttgttatctttattgttctgtcccccaaggctgctcttggaccaacaggcactgttttagtgaatgaatagctctccatcctgcacctctcactttccctcacagctaatcaccaaggcttgtttgttccctctcctaaatgtgtgtgtgtatacatacatatatgtatatatatatatatatatttttttttttttttcttttcttgccttgcttaagtgatacatcctccaggaattctgccttgatcccctaattaaagcttagttttccctgaaatgtattcccatggcactgcattttattataccactcttcatactttactgttattttttagttatctgtctccctggacagactataagctcaatgtggctgagacaactgtgtctttgttcactgttgcatatttagcacatagcaactgagtgaatgggattgctaaatagttctgacagttttgtttcacctcaaaatcggtgattcttctccttttgggattaaaaattcttcacaggtgaatttgtaagagagcaatgtaccttt

SEQ ID NO: 87022 - DNA, 1089 bp, Homo sapiens
tttttaagttatattttctagtaaacgtaaattataggtaagaaagtcctatgtagcttagcctattgtattcattttacagcgtcaaaaaagtctttgtcatttgttgatttggttttgttgttcttgttgcatagcactcccaccaaaggcatagagaacaaagcttttgatcgcaatacagaatctctctttgaagaactgtcttcagctggctcaggcctaataggagatgtggatgaaggagcagatttactaggtatgatagctcatctgaagaaatatcatactgtttttaaaattgattttttaaatgatttaattgaaaagtcctttaaaatgtccccaactgctcagtgatacagggttattgcccttttaggtaattattgggaacatattctttgtgatcatgaaagttttaaatgaaagcacctttgcatatgggtatgcttaaaactgaattgcatttaaattcatgttttgaattcatacaacacaatttattgaactcctgctatatttcaaaacagataactacacataagaacatggtgatgtgtgtgtgtgtatgtgtgtgtgtgtgtgtatgtgtatgtgtgtgtgtatggattgatgcctagttatcccctggcttacataaatttcattatattctgttgactttaattaaataagaaattataacacttgatttttctaagttttctcagagtatattatgttttagccctatggtaaatataatcattttaaagtttgtgttctagaagaatacatggtctgaaaagaatattgcatttggctcttagactatttgcctgctgacctttgccaagtgtcttaacctttttggaccttaatttctttgtgtgtaaaatgaaggagctggaccctagttcaggaatctggcaaactgccgcttatgggccaaatccagctgaccccttgtgtgcgtgtgtaaataaagttttattggaacacagacaccaccatttacttattgtctgtggttgcctttgcctaccaacagcagagttgagtaggcaactgaaatctgaagcctaaaatatttactgtctggccctt

SEQ ID NO: 87023 - DNA, 1059 bp, Homo sapiens
tttctttggttgcttattagtttttgatacaatctgttaactgaatatgtgatatattgtataatgctgtatttcctaaaatccagtcttgcacattttaaaaaaatgttcaaatgatacctttacacccataaaaacaacaggatttttatattggggtactgtgtaatatatgtattgtttatttcatcatgtccttttttaaggctctgctgaaaatgaagaaaagtcagaagttcaagcaatcatcgaatctactcctgagctggatatggacaaagatctcagtggatataaaggttcaaggtaacataaatgttagatgaagacatattctgcgccccccacccccaactcccataaacactgttctccagtctctggacaaaatggattcagatgttttgttgaagaaatgttagtattatattctaattcctattcttgaaactggacactgtacatggtttaaattttttgttaaatgttatctttgcaggatcacaaattaggtgtatgagcaggaaggatggtgtcttagtctattttgtactgctatagcaaaataccagagtgggtaatttatatatttatttatttgtttatttttttgagacagagtttcgctcttgttgcccaggctggagtgcaatggtgcgatctcggctcaccgcaacctccgcctcccaggttcaagcaattctcctccctcagcctccctagttgctgggattacagacatgtgccaccacgcctggcttattttgtatttttagtagagacggggtttctccatgttggtcaggctggtctcgaactcccaacctcaggtgatccacccgcctcggcctcccaaagtcctgggattacagtcgtgagccactgcgcccagccttgtttatttttttgagatggagtctcgctctgtagcccaggctggagtgcagtggtgcaatctcagctcactgcaacctctgcctcccagggtcaggtgattctcctgcctcagcttcccgagtagctgggattacaggcacccaccaccatgcctagctaatt

SEQ ID NO: 87024 - DNA, 1037 bp, Homo sapiens
ttcattctacatttattaattggaattcttctatcagggagagttgtcttcttccctccttccctccagtccagtttgaattcaagggatatatacatatattattctgtgggctatgcgaacctatcatttctttggtttctcaaatttttctagctttggacattgagagctctttcaggttggctcctgtgctcttttgacataccccatccttttttgaatgctttcttccttattggcaccataagatgctctaagctgttgtattttccctgccccactcttaaaaattggactacttctcaaaggagctctggcacattttttgggagaagtgtatttaggaaccaagatctaggcattattcattcatttacttctggtttgggtttttccattagtttatacctcctttatagaattttgtattagtgtgcctactagggtaaaataaaagtagagttttaagaaaaaaatggattatgtgttgtaatatttcatattgttttgtttatgacagtggataaggaatttgttctataaactcaatttttgcttataagcttttttcctcacatatatcttcatgtgataactttaggaaccacctataggtgactgttagggtttggaaggaaaaaaagggtaaagattctattgtgttgtatgttgaccaagatgcctattatgtatgttgagaatagaaactgataaagatgtaaataagcagcactttcaaaatggcggtgtttaaagcttgtattttaaatgtgacttcatctgaggtaattggcacataggtatttattaatacttacatttactgtttaaacagacttttagaataggagaagttgtttaacattttctactgaaaaaattacctttttcactcaaaaaaatttattgatgctcactgtgttaggcacaatgccatgtactagaaatgttgttaaggtgctcagaggtccaaatattttctaaaagaggcctttataatttcttttaaaaagttattttactactcaggaggc

SEQ ID NO: 87025 - DNA, 1134 bp, Homo sapiens
gatatatggaagtagggcaattaagaaaaaagaattctgatagttgttgatagcttcgttttctagacaagtaatagcagatgttttggtctgcaggtataaatctgccacttgatagttttccacgtgtatctcatttttttccttcttctgtgagtttgaagcatttaatgcatgccaacatagtactggactaatgtttacctttcagggtttcttttcaaaagtaggattctcatgaacttgcctaattatgcgtccttctctcccttaccccaactgtatgtaatttgtaagtaaagtaaggggaggagtatgtagtaattattttttcagagttggaacattgtaacctagagcatcattgacccacttgacagatagctgtcagtctctgaagagatctcccctccctgtagagtagtttctgaatgattgatacaagcaaattaaaaaggtgggaattctatttgcaatttgggttgtagattttgttgactgttgattgtagattttgtcaactgattttgtttactttttggaaagtaaaatttggattcatagaagactccctcccccaatagttttaaactttttcaatatttgttatgtgtgaaaatgaatggcttatattttgatttctattagtgtgagggagtcttatgaagtctgtatatcatcttcctggttgtctttgcattttgagttagagagctttccattatattcagtcattaaattcccagtcaccttttgcttaactcattaaggtatgttagaaaataaataaaagtcagctagtagctcttagtccccttggattttcggttcacaaaatatggggggaaaacatcagattgacaactttttattttgtccagaatgaatatgaaaaggaaatctagctacttatcactgtcaccatcatttaatgaaagaaagggcattttaaaatcaaagaagaagaaaagatgtaatttaaaataagggtcagtcattttcaagaaagaacagggttctatagtatatgggaatgtgtatgtgtacaataggtactatattatctatgcactaaggaaataataaataacgcctcttttttcatggacttattataaaaactttgttgctgaa

SEQ ID NO: 87026 - DNA, 1051 bp, Homo sapiens
tttgcctcaaggaaggaaggtttatgtaacatatatagggctgctttgaaatgtgggtctgttctgctctagcccacaattttttctgtttatacatctgttctagagatgtcattcaattagcaattataaatagctatctaaagccaaagaactaggcgcccttaaaacataaactctgaaaacattcagggaaaggaagcctgaaggggtttaaccttaaccttttcactattatttccaaagaagataatgtcttttaatagttgtttagcacttttatgaaacacattcattgttgcttaagggaaacctaccgtggctttttaaaatttgatttaagaataactattcttaaatttaaatagtcaactattcttaaatcaaatttttgtatacattactgaatttgcttaaaagacatgccttaaagagggcagtggaagaaatataaaggacaattttgaagcactcgggcccacatgtgtatgctaatcaccaaaaactttagccctttggaatcttgggagagtctcacatcagggagtgtttgaatgcattctcattttatcctttgaccaaattctcatccattcccattttacagattgaggtttagaaagagtctataaaatgatttgccccaaattctaggctagttagtgactagatttgaagccaggtttgtcagattctattgcctgatttttttttaagagggagtctcgttgtgttgcccaggctggagtgcagtggcgtgatctcggcccactgcaacctccgcctccagggttcatgtgattctcccacctcagcctcctgaatagctgggactataggcacatgccaccacgctcggctactttttgtatttttagtagagactgggtttcaccatgttgtccaggctggtcttaaactcctggcctcaagtgatctgcccgtcccggccttccgaagtgctgggattacatgtgtgagccacagcacccagtctccctgaacttttaataacactaacaccttggccgagtgcagtggctcacgcctg

SEQ ID NO: 87027 - DNA, 1053 bp, Homo sapiens
ttgcctgtttgcggccagctgacccttaaacccagggaacattttcaactatgctaaggctttccaacagactaaatgagtaccctgataaactcctctagcaccagctttatttctccccagactgtctcccactgctccttagccaagtatgggctcctccagtctggccagtctcccctctgcctcaccaccaccctctgcctcaccacaggcatggttttgtgttcccttctctgtggtaacagtgtcaggaatgctctcattaccatctgtcttgagtactgtaatttcttcctttgtggttctgtgtggacaccacctcctccctgaatcattcctctttgctatcagttattctttcctgtggaatcctgtcctgacattctgtatctcaggatctattaataaaactttttttttttaaatatcctgaagttgtactctgtgagcactacctcaagtcagtgccactcacaaaacccatcagcagagggagctaaataaaagaagatgagtccctgaaattgaggagacctgaagcagaaaaagtacttataaacaatcaactttcacaaactgccagtgctaaagagcttgagtagtgttggaaatacattatttgggccctaatcccagtttaaaactttgatgaggtgatttgtgtttttgaaagagttaattctgtatcatgttaaaaaaaaaactgtttagggggatgacctgataaatataggaatattagagaaccaatctaaggtattccgctcgtctgaaagttttcattattaaggataatgaaatgaggtcactgctttgtgaagacttgcatatggaacactgagtctgaaagttgctaaggattatggatagcccattctgagtctaacatgtactttttcaagtaaatttcttattttgttttgatcaagtgtatgtatcttaatttcagttagcagacttgaagaaagagaagcagaactgaagaaggaatataatgcattacatcaaagacacactgaggtgggtttctaggtttttcattaccatgct

SEQ ID NO: 87028 - DNA, 1009 bp, Homo sapiens
aggtaagctctgattttgagccggcagagcaggtggctcttcctgccttaatcttatcctcttgctttttggaaagacggatagaaagagcgctcaaaatgaggctgaagtatctccatcattattctaaaggggaaattttggatttgtcttttgattgttcttttttcttgccccctcaccttttttttctttttagataacatgatttgcctttttttttttactccccagaaaattagcaattttaaaaatggcagttacttatcagttgttttgggataggatgaacagaatcttgtttatttccagttaatctcggcttggagctagttttgatgagtaaaatgacaaggttttagaattttccctgagatcgttttgaagtttaggtttatgtgataactattaaacaagaaatgaccttttaatacacttcaaatggaatgcaacaatataggtataggttaacttcatggtacttgaggctttcgaggatgtctatagtccttgccaggtgggcttttctttcctgctttccccttcccttctacttccttttcttttccctttaactgattccttagtggcattcaggactttaaagagatggctcttccacactttaaaatgacttctcaaaagtgtttataccatcttatgggacttaggccttgagtaagctgagttcattggatatgttgttgtactgagttattgtaagtattttcagaaaagaaaggttctgaatttgtattatttgatcttggtgtatgtgtgtatattttctaatattttctatgtattatatgatcaattatatatgatctttatgttacatgatttatattgtaagtacctacaaagataataataaaatttaggatcacagtatatgtaaagaaaacatgaaatacacaaagtcataaaacagtttctgttcaggttcttgctgtgggtgttaggcaggagagaatataccaccagaaaaacattcagaaaatcattt

SEQ ID NO: 87029 - DNA, 1021 bp, Homo sapiens
tttcctctaatgagaattatttaatggccactgtgttttttaccatggcagcccagaaacagaacaaacgttgaaatgcaaccataacaactagtttgaaccttacctggttggcatatttaaattgttttttttcttgatccacgttttatacatgtataattaatatattatgctctattgtaaactgtctcaaatcctttgtggaatgaagaggtgaatcagggtaaaataaatgtaagaaatttaaaataaaaaaaccaaaaacttctgttggttggttggtcattttttctggtatactgaatcatattgcagtaaatatttttttacatctacaagttttcccttctattggtagttttcttagaatatatttaaggaagtaggtcaaagaattttagtgctttttggcatataatagtttggccatttctaatgtcaatagaattggagaagtaagggttagtagtaaattccattttgcttgtcataacttatgaatttgaagcattatttacagcatattagcacacagagctgatatagaatcatttattatttgattctctcttaggaagcttctgttgccctcaggctccttggatttacaacttattcttccctgagtatagagccattgccttttgtggagaagatgaaaagatttagatgacagtgatattttttttttagtgagtacttcttaatttggtggctatgttttttggggagtacaggttttttttttgtttttttttttaagagatgagggtctaattcctgtgtttaagtgatcctcccacctcagccctcccgtgagggagcccacctcaggtgcatgccactgcacccgtggctgtgattttaagctgttatatttagactcttctttaattccgcccttccttcctttaaatgaaaattcgtctttttgaattaaatggaaaaatgttgttggcactgaagtcaaatgtgttagatccttatactttgacctttctaccttttttgtccccca

SEQ ID NO: 87030 - DNA, 1054 bp, Homo sapiens
tcttaggaatttaaactccatggttcaggtgaatctatgactattaatcacacaaccatttaacaaatatttattgattattccatcattcttttgttctctattgtacatgttatagatttttaagttgtctggaagtcaagatgcatatgcaagtatacaaaagggtttatatatttgtagtaagatatgtatatcatatggaatgcctataacatgaagtggaaacaattattttgttatttttttcttctatatttgggagttttttaaacttaatttttatagaaaaactaaaaatcaacccaaggtcataattctgagatctaagtagttaatacctaattgtgattattgattccaagaaataacaggagttgaaaatgtaaagtttaatttctctgattaaatttatattgttcttctttattagaaattcattgaatttgaagactctcaagaacaggaaaaaaaggacttacagacccgagtggaatctttagaatctcaaacaagacaacttgagctgaaagcgaaaaactatgctgaccagagtaagtaaaacatttcttctcataagtacactaaagattgggcttggccagacgtggtggctcacgcctgtaatcccagcactttgggaggccgaggtaggaggatcacttgggttcaggagttcaagaccagcctggtcaacatggtgaaacctcgtctctactaaaaatacaaaaattagctgagcatggttgtgcatgactgtaatcccagctacttaggaggctgaggcacgagaaccatttgaatccgggaggcagaggctgcagtgagccaagatggtgccactgcactccagcttgagcaacagaatgaaactgtgtccccccaccccccagaaaaaaaaaaaaaggaattggctctaatggtgcaatgactcatcctgaaattcgactaaggttctaaatacaaacttggaattgtcatcccagactcaagagtgagacctaggacctagggttagttcttttttattcacattttcacatggtacccatgt

SEQ ID NO: 87031 - DNA, 1755 bp, Homo sapiens
actgcaacctccatctcctgggttcaagcaattctcctgcctcagcctcccgagtagctgggattacaggcgtgcaccaccatgcctggctaatttttgtatttagtagagatggggtttcaccatgttggccaggctggtctcaaactcctgaccttaagtgatccacctgtcttggcctcccaaagtgctaggattacaggcgtgagccaccatgcctggcctggtatcacagttttaaataggttggccaaagaagccttcaccaagaaggtgagatttgaacaaagatgtgaaggaagtaagtagagagcaagctgtttggatatctggaagaagagaattctaggtagtaggaagcaagtgctgaggcttgaagtgtttgaggaactgcatggatgcttgaatcagagaatgggaaggagaagagggtaggaagagaagtaggggatgatgtcaaagaagtaagagaatggtggaagcatgttgtgtagatccttagaggctatggtaaagaatttaaaccactagagcgttttaagcagaggataaattgtttttactttttttttttttgagacagaggtttgctcttgttgctcaggctggagtgcaatggcgtgatctcagctcaccgcaacctctgcctcccgagttcaagcaattctcctgcctcagcctcccaaatagctgggattacaggcatgcgccccagacccagctaattttatatttttagtagagacggggtttctccatgttggtcaggctggtctcgaactcctgacctcaggtgatctgctcgcctcagcctcccaaagtgctgggattacaggcatgagtcactgctcctggcctgcttttttttgagagggggtcttgttctgtcgcccaggctggagtttagtggcgtgatctcagcttactgtaacctccgtctcctgggttcaagcgattctcctgcctcagcctcctcagtaactgggattacaggagcctgccaccacgcccagctaatttttgtgtttttagtagagaccgaatttcaccatgttggacaggctggctggctgactttttaaagaatcctcctagatcctctagaatatattgtagaggattagggtggaagtaagaagactaattaggagactttcactgttgcagtaatccaggcattagatgattgtggcacacaccaggatggtggtggaaatgatgaaaagcggtcagatctgaaggtagatttgctgatggattggatatgtgaggtactagagaaacagaagagtcaaagctgactccagagttttggtcctgagtaactgaccacagtaatttaatgagctagagaagaccaggagaggagcaagttttcacatgctaaatttaagaatttaagatgcttttttttttttttttttttttttttgagatagagtcttgctctgtagcccaggctggagtgcagtggtgcgatctcggctcactgcaacttccacctcccgggtcccggttcaagcaactctccttccttagcctcccaagtggctgggattacaggaacgtgccaccatgcccagctaatttttgtatttttagtggagacagggtttcagcatgttggccaggttggtcttgaactcctgaccttgtgatctgctctcctcagcctcgcaaagtgctaggattacaggcgtgagccaccacacccagccttaagatgctttttaaacatccaattgaagttttcta

SEQ ID NO: 87032 - DNA, 1008 bp, Homo sapiens
aaagaaattacatttaaaaacaattacatttaactaattaatataatatcttgatggacacttaataagccagccctttatttgatactattttttagacaagtactatagtcaaagtatttaaatggctattctttttcttttctttcttttttcttctgcatctttactccaacaagcaacaacctttagggaattttttttttttttttttttaactttgggagcttgtcttttcaaagtattcatttgtttttccccagaacagtggggcgaaacagtccctataagccatctggacttaaaagcattttgcttcatcacaaagcttactctttttagatcctgacataagtctgtattgtccactgatttttttttttttaacggtgtctagttgctcccaggagagttgtctgaagtcactttaatgttgttgctggcctattagttattgaaagggaagaggggtatttagtgaagatgtgttattatacctgctgaaaaagctcattcacaggcccttaatccccctagtccttaaaaaaaagtgggtatgtgtgtgagaaaaacagaaaaggggaggagtatgtgcgtttcataccaacatacctgagtgatctgacaaatgcttgtgctgaggggactctctggaatttccagggctaatgtggttttataatatgcaaacaacaacaacaacaacaaaaaaacagaaaaacaaacaaaaaaaactgctgcgcttctcctgccacgattttgctgttggcctaaccctatcgtggttattctaaggtttgccaagcgtagtagagggtgaccaacttataaagtcatgccactggcaagcaattaagtcacattaaatcattaatgactatcctagactttttatgagcattcatttccttttttttttttttttttgtatacagggtcttgatccgtcgctcaggctggagtgcagtggctcactctcagctcactgcaacctctgcctcctgggct

SEQ ID NO: 87033 - DNA, 1098 bp, Homo sapiens
gacggggtttcaccattttagccaggatagtctcaatctcctgacctcgtgatctgcccgcctcagcctcccaaagtgctgggattacaggcatgagccaccgtgccggcctgtttgtgtctttaatgcggagaccaagagtcttttataccaaagtaagtgcctcagggtatttacagcaaaagtgatttgaaagcatggaaattatccatcaccagagagagtaaagtaaattctgagcacctctgtggaaacttaggtgggtatgtagatagaatgttttaggaatgtgtgaggtgctatgatctcttgcttgcaggaattctcagcaaggcatcaaaaatttaatctttatattgataggacatattttgaataccttctgactttttcctttgcttttatttgaatttctagtgtggagctagtctgctgttttagggattctttaaaaacaacctaaagaagggctaattttagatagatttggaccggtttcagatgctaatcaagaaatctgtcatcttatcgcccatcactctctcctttgggctgcctgtgacacacctctccattctttaaccaagacccgtctgatgcctttgcccatgctctagaatgctctccttagaattttacatagctagctcctcactttctactctgtttcaatttcactttttcagccagaacatcctgttgactctatccagaataagccctgtgaacctattgaataatttattttaaaatcagtgacttttaaatttaaattctttttggagacagagtctcaatcgcctaggctggggtgtagtggcacagtcacagttcactgcagcctcaatctcttgggctcaagtgatcctcttgcctcagcctcctgagtagctaggaccacagacatgcgttaccacactgggctaattaaattttttacagagacaaggtctcactgtgttgcccagtctggtctggaactcctgggctcaagtgatcctcctgccttgtggatcctgccaaagtgttgggacttacaggggtgagccactgtgccccagcccagtgattttttaaaataaaaatctggatacaaaa

SEQ ID NO: 87034 - DNA, 1033 bp, Homo sapiens
ttttgagcagaaaggattccgccttgttggtctgaaattcatgcaagtaagtggacttcattgttcccattttgattccttcatagtataggagaacactgtgattaacctgtttctccccgtctttcttatttaaagttctccacggtagagtgaacacaagtgtcttgagacctggaaactcctcagtgccctagcgtttggctacatcttggaacaaaccaagttatttaggattttccaaaatagtctctgtaataggaggtgcattgctacgggaaaagcagtgcagagttccacatatgactgcatctctgtaatttctgactgagagctgagcatgtttgagttcttggtcttgagcttcctgagcagataattttagagagatttttttccccctttgagacaggttgttttttagcaagaaagtctttccatcatcaattactagacactaataaatgcttattgtttagcatatattaggtatcataggagctggtggaggaaaactatggttttggttttggggaggttcttcagaaacagcagagagcagatgtacctgcaagctacttacaaagcaatcttttgataaatgcaaaggattgattgaccaataacccttcttcaaacaaattctagagataatccaaattctcggctgggtgaggcatagtggctcatacctgtaatcccagcactttgggaagccaaggcaggctggtcacttgaggtcaggagttcaagaccagcctggccaacattgtgaaaccccgtctctactaaaaatacaaaaattagctgggcatcagggtgggtgcctgtaatcccagctattcggcaggctgagacataagaattgcttgaaccagccaggtgcggtggctcatacctgtaatcctagcattttgggaggctgaggcgggcggatcacctgaggtcaggagttcgagacagcctgaccaatatgatgaaaccccgtctctactaaaaatacaaaaattagccaggcgtggtggcatgcgcc

SEQ ID NO: 87035 - DNA, 1017 bp, Homo sapiens
ggtttccgaggctggaggtagacatgataccatatgcaggttgattttatcggagtttattgttttcctccctcttaagttggcgtttggctttggttgttaacatcacttagtcgtacctctgttacacgaagtgtagaacctggtacaacacactttgctggccagtctttcctgaaggctctcactgtttgcaccagcgtggccgggagggctggatgtggggagggcatttttcagccttaagtgaatggccattgtaggctttttcttttaacatggtctaatgtccatggagcttcagcttttatgctgctgtggctgtagatttctggcaatgggcgcattttaatccttctggtcttggtcatgtgactatctctttctccacccaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttcttttcatgtacactgaataacctgacctaatagagagtgtaaatactataaaaatgatttattttgaggtctcacatacacacaggcattctttgcctgcccttcttaacccccgcatcccttccactcttggcactgagctattcaacaggcatctatggagcatgtgctacgtggccaagactggactaggtgcagaggattcatcagaaatgaaagaaaacatgagggctgggtgtgctggcttgtgcttgtgatacc

SEQ ID NO: 87036 - DNA, 1056 bp, Homo sapiens
cgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggtaaggcggtgggggcgcatcccctggcgactcctcccgttccctcttccgcttgcgctgccgcaggtgggcccggtctgtgggcgccccccgatttcccgcaggtcccgcgcggcgtcggagcgggagattcccttgcagcttgcgccccgcgggccttcgggctccgcagagggacgccggccctgcgcggggcggaagcggccgggaagccacgtgtccccgcggccgcgcgtggtgggggaggagggaccggcggcgcccacgtggcctccgcgggccccgccagagcctgcgcccgggccctgaccgcacctctcgccccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggtaactcgcccccgtctccccttccccgctgcagccggctcgcgggtgtttttccctcccggcggcggtttgtccgcgtctgctttccgagttcatttcgctgccgcgaaatccctttgccctctgcccccgcccacggcggcttgggcccgccgaccctttcccggggtggtggggacagacgcccttgggaaggtgaagcgctggtagcgtgactcgccctccgggtttgggttccttcccgcgggccgctacctgcccacccgccgcaggggggcagcagggagcggaaaaaccccgggccccagaccccctgcgcctgcccactcgggtccacctaggcacagaatggaggcttggaatctcctttgctttagtctgaaactccgagttccagtgcggtgctcctcctttagcatag

SEQ ID NO: 87037 - DNA, 1157 bp, Homo sapiens
ctgagccacatagcaagcccctgtctctacaaataaataaataaataaataaaaattaattgggcatggttgagtgcatctgtagttccagctacttgggaggctgaggtaggaaaatcacttgagccctggaagttgaggctgcagtgagccatcattgtgccactgcattccagcctgggtgatgatagtgagaccctgtctcctaaaacaaaccaaaacaacacaccaaaaaaagaacagtctttctgttaaaatggcattagtttcatggtttggatgggatttaaaaaatatttatgtgtgtgtatatgtgtgtatatatatatatatttccacacaccacttaggaacgtgggctagaatataaaaccggacttgctaatgggaggttcagaggatgggttggagtctttccagcttagctcctaactggtgcctcctctccaatgccaggcctctgaagaacacctgaagcagcactacattgacctgaaagaccgaccattcttccctgggctggtgaagtacatgaactcagggccggttgtggccatggtgagtgctcgtggggaatgagagaaaatgaggaaaaagtgctcagtgttctttgttagacatctccctcagctaatctaaattttattttatgaatggaacctgctgaagttacttaactgagcaactaggagcttgggaggagaaagcaaatcagaccttagaaatgggaaggatgttagctgggtgtggtggtgcacggctgtaatctcagctacttgggaggctgaggtaggagaattgcttgaacctgggaggcggaggttgcagtgagccgagatcgtgccactgcactccagcctgggcaacagagcgagactctgtctcgacaaagaaaaaagatatgggaaggactttttcaggtacatgtctctatggttaaatagaatctcactgcctgcaagagtggtaaattttcgggccaggcttggtggctcatgcctgtaatcccagcgctttggaaggctgaggcgggtggatcacctgaggccaggagttaatcccagttactcagggggctgaagcacgagaatcgcttgaacttgggaggcggaggttgcagtgagccgagatcatgccactgcactccagcctgggcg

SEQ ID NO: 87038 - DNA, 1052 bp, Homo sapiens
gagccactgcactccagcctgggcaacagaacaagactctgtctcaaaaaaaaaaaaaaaaaaaattggagagagtaaaatagggaggcagtgaaattgttgagaaagtagatctatttcctgttcacctttttcttccttctgctgttccctggaatccttaccctagcatgttagtctttcttttccctcttctagcagtcttctgggatgcccttcccactgatcctattccagactggccactttctcctttcttcaccagttcttctgtgttgatggctgcataaggattctgcaacattgtttatctctgtctcagctaaactgggaagtccccaagttggacagacttttctttgaatcctagcaatacgtttggaatgcagtttttatataggcccctactctctgctggggttagctgataatcatgtcactgatcggtctcattgatgtgtcgtgtcaggtaggagtaaatgttagaccctacctgtcctgagtggcaggtctgattataaatccattttcacactttcgaggtctgggaggggctgaacgtggtgaagacaggccgagtgatgcttggggagaccaatccagcagattcaaagccaggcaccattcgtggggacttctgcattcaggttggcaggtaagtccggggacaggagggtggatgacttttatgcaacaccatttaaagcagacgtcatggcgtatcctactttcagaagaatctgtgcccttttttttttttttttttcttgagacggagtctccttctgcctagctggagtgcagtggtgccatctctgctcactgtaaccttcacctcccgggttcaagcgatcctcctgccgcagcctcccaaatagctgggattacaggtgcacactgccacgcccggctaatttttgtatttttagtagagatggtttcaccacgttggccaggctagtttcaaactcctgacctcaggtgatccgcctgcctcggccccccaaggtgctgggattacagacatgagccaccgcacttggcctgaactt

SEQ ID NO: 87039 - DNA, 1150 bp, Homo sapiens
aataagcagtgttatgtcatggttgggctttgcaaatcagtgttataagaaaatgcagcagagctggcctatgataatgaacacatcatatctagttgggatgttgatctgcagtgggtttgagtatcactgtattttccaaaatttgcggaggagtgttttatgtcttcggcaatcttggggtacaagcactcttttgatggggaggccagacttggaagcataatacagttgaaacaaggaatgttttaaatcaagcacttttacagttgtatagctgcttttaaaaggaaatgctttgggggtataaattggtctgttgcttcaagtggcaatttggctgaaagagtctggagtgctgtccattgcggtacccattaaacagacttttgcactttaaaacatggcaacttgtaattgttttctttcttaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggacactgtctccttgtgcttatttgatactgagctgaaagaagtgacttggttctctggctatagtagcattatgtacatctcaatcctgcttgtcaaagaatgatctgatcctgacggagtttcgctcttgttgcccaggctggagtgcaatggcgcgatctcagctcaccacaacctctgcctcccgggttcaagcgattctcctgtctcagcctcctgagtagctgggattacaggcatgtgccaccacgccctgctaattttgtatttttaatagagacggggtttctccatgttggtcaggctggtcttgtactcccaatctcaggtgatctgcccgtcttggcctcccaaagtgctgggattacaggtgtgaaccaccgcgcccggcctatttatttatttatttgagacagagtctcgctttgtcgcccaggctggagtgcagtggcgtgatct

SEQ ID NO: 87040 - DNA, 2287 bp, Homo sapiens
ctgttttaaaattcatatgacttccttttaaaaaaaaaaaaaggatacaagggtaaactggtgaaaggtttgctctctgcattttctaactttctactgagttgtgactgaatgagagcgctctagcgtttaccagtgaggttcataaactaaactctcaggaattaattgcatctgttctagaagtgcttctgggtcttagcctggcctcttcagagtggtaatattgaccatctcctctggaatataggtagggctaattagaaattaatcaaaatgattaacctctacagtccttcagcctatggaatgctttaaaaaatgttaatggaaagccccaggagaccattttaggtaagacttttgtttgaattttaaaatgcatagaacgttaaaaaaaaccagcaatttattttctaaaatattgctctacttttgggaataatagcattggtaatacgcacaggtttacctcattctatgcaagaggggttaataacataaggttttataatagctactggaagtaaaatttgttactttatagtgtaagaatgtatggaatcgcatgtcaccatttcttaatactgactctttaggggcataaatgcagatcacatcaacgcaagttgattctcatgtgtcaaatatatgtgaattcagctgttaaattactggatatttatcttaacattgctgagagggacctactgtaaatgtgacatcctcacacttcccatatctttaactttgaaaaatcttcttgtaaacttaaagcctagaagtattccaaagcaagggttagagcagtctttattctcaggctcactgaattaaacccaggactaattccacagcacaggcacaagaagcctgttgtgtagtgtactctgccagtaccttggatttaggagctccatggggaactgactaaaccaggagagagaggatttggagctagtcagtcctggtaatctatgaaatgctcatttatacccaggtttcataagcttccaattctatagcaaacccaggctctgagtgttttagaatttcctaattcatgaagtgtttcttgtcttgatcccgtgaccaacagttgaaggttggtaaggacttttctacagtctgaacacaacctaaagccctctttcattgttcacacactaactcctactgccgacgaaccgaaaaataattaatgcagaggagatttatgtcttagccataactccagttgtacaactcaatcgccccattctcttttacggttcaaaatgtactgctgaccttgggtttgtttttgttttgttttgtttttcctgttaggatttatttggggacttttggtagtttaaactctttaaccttttccttgccgtgtatgaggaaagctaaagctgttatcaacttcttattctacgatactaacacgggttttcagtgtttgtttgtttttattattattattaattttgcgtgatgtgaataccctctcccatcaatatttgtattatggtgctatatattggtaatgatcctttaatattgggaagggattttaaaaatactgtgattaaactgggtttcttcctttgattttcatattttaaataaagccacagtcatttatacaaaagaaaagcatctgtccctgggcaaatcttttgaggacagaggtcaaagtaaactgcataaggtttttacatcatttctgtatgtatttgatatatagatcaatatctgtacaaatttaatcttttattttcttggtaactcgtgatcattgagaaagtgtttgaaactttctcatgaagtgtatatataatggcgtgaaaaattcctttggaaaaatttatgttcctttcatttttaccaaattgcaaattttcagcatggatgtgaaaagcattaaaattataactttgtgtacaagatgaaaataattcactaaatttgcccttttttacacaaaataaaatgttaaagttaagctggatttgagcagttctttaatatgctttggtttggggggttgcttttctattgcgtgccctctataagcagtcagagacccctatgaaagttggatcagccccttcctcttacaaggggtagcaggcacatgagtgctgtaaggaagaattttccactagctgccaagggagccaagagtagtatggttagacatatggatgaggttgcattggaggtgggatttcatgggcagggagggaaagggcaaaaaccacagcaggagccaaggtgaatagggacctttatgggg

SEQ ID NO: 87041 - DNA, 1842 bp, Homo sapiens
ctttgggaggctgaggtgggcggatcacaaggtcaagagatcaagaccatcctggccaacatgatgaaaccctgtctctactaaaaatacaaaaattagctgggcgtggtggtgggtgcctgtagtcccacctacttgggggggcggtgctgaggcaggagaaccgcttgaaccgggaagcggaggttgcagtaagccgagttcactccactgcactccagcctgatgacagagtgagactccatctcaaaaaaaaaaaaaaaaaaagattgtacttcagaaccatgaaagaactacatcattgtttgtacaaacattgacataaaagtgaatacttaatcacaaacaaaattctcattatcccagtcagattagtgagcaccattactgcgaacatttcattgaagatgtccattacacagtactgttcctttccagaatgtttcttaactgctaatatactggaaaattaaaattaactgaagaaatgaagaagtcttaataactgtaaagctgacggaacacgaagatcacaggcaatccgagtactctagagagccttaatgcccatatgtttctctctctttcattcagtgacaacactgcagctgaaggaggagttgctggatggagaggattataatttccttcaaggagcgtctgatcaggaaagcaatggctctgccaacttctacatcaaacaagagccatgaggtggcttagaaactgagggcgggtggggaaggattttacacaggactgatttataatcaatccagctgtacagggggctactctactgggacattttgctaaacatagaagatttcagttccagatttttcaggtgggtgggggagctattttagtcgggggggcaggggggtgggaaattttcaatttataaagatggacaatttttgtgttgtatttgaagcttttgaaagaattttgtaatattttccaagtttggatttatgtgcattgttaacaagaactgaaattctaacttttttggtaacattaaagtttaggtagcaggattgaaggaaatgatttaagaaggatatagctgttaaatgcaaatgaactgtcattacaaatgaacctttttggtacctgttgggagattttgggatttttagaagttaggccagtcacatctccagcttcttttgctgcagaaatatgcaactgaactcctcatggaggggtcatcaccacaaaggtcatggaagggtcattatttctcttgttggcattttattgcagcccattttaaatgtttgtacagaaatatttttcattctgtgaaaatttatttggagttctgtatgaaactggaagaactctggatacttttatatgttctcttttaattaaaaaaatgattagaattatcctaacactaaagtgttaaactggaatggttgacaagatattcaggatctcagtctacacattgaggggttggggaaaatgtaatgttgtccttagtttattttcctttctaaaaaaaataccccacgaaagggattctgatcagttctctgccatttccctctatctgtgaaataacagcttcgtataaccacaaccaaaaacagatgttctgtattaggagaatcgaattgaaagttattcaaagccaaaataagtttagatttcaaaatcattccagctctgcttttatctatcctggatttggtagaaaactaatttgaaagagaatttaattttcttaaaattccatatatatatatatatatatatatatatatatatatatatatatatatatataaaattgtctttaattgtattcaggatttattttaataa

SEQ ID NO: 87042 - DNA, 1284 bp, Homo sapiens
ctgttttcttctcattcttctgtttgctaatatttttgcacctatgggggttttcttgtttgtttccgttgttggttttttggtggtttttgccattttaggatatgttctttagcttttgcctccctcataatgtattaggccatcttgcccccttcccagtctttttctctgaagatcactgtgatgttcttacatccagaggaaattacactacttcttttgtacgaaaaacaaattaggattgtaaatccagtgttacctgctctttaacagaaaaatgttcaaagtctaaagagcgttcctgtttcctttcttgtctaagtttttttctttttgcacttatttatgaaatagtcttgcattacttaattaagtatggatattgtgagttccaaatatatttgagcttttattggatcttggatgtattttctttaagcatgaggctggttttgaagatgtatgtcacattttgtgataggttactgattcatttaaaatggaacttctggcactggcaaaacccaagaatttagagtagacgaactagatggaaactacctggcatcctatgtgacttccttcttccaccgatgtctatagtatattctgagctggggcacaacttgtgggacttggtgtgatttttctctgatgaaactaagtagggactacattgctaccttaactatctgaaagctatggtttcattagctgttgaaagagtttattatttatgggcttcgtagctggaaaaatatgatttcagttagcttatctcctgaaatggtagtgattagtgtcaacaaagtgacttccttctaaaaacagagctgagaaaagaaaaggcatttgtgtagaaagtgacattcaaccacaggatctgttttatttcatccatcatttattgagaaggcctggaaaggagaaatgattcatgtgaagataaccagacaggctttattttagattccatgaaaacagtgaaactttacattaaaacattgcacatctgagtgagtgtttcacctttatcttgagtgactttttttagcacatcattttcatattttaacatgactagaagcataatccagaaatttgttgttagcagtaatgcatattgcttcaagatatgctttagaatctcaacttacctttcttacatttttttaaaaaacatccgtttgaatgaaacatgtttgatcttgaagcacattaattcttttctcattcatttagccatccagtcatcatagaacaagatactgttttaatcaa

SEQ ID NO: 87043 - DNA, 1487 bp, Homo sapiens
gcggatcacctgaggtcaggagttcgagaccagcctgaccaacatggagaaaccccgtctctactaaaaatgcaaaattagccaggcgtggtggcgcatgcctgtaatcccagcactcgggaggctgaggcaggagaatcgcttgaacctgggaggcggaggttgcagtgagccgagatcgcgccattgcactccagcctgggcaacaagagcaaaactccctctcaaaaaaaaaaaaaaaaaaaaaaacctatttgaatgttggaattgaggataaggaagtatagtgccgtattaagaagcagcagttttcactctaatggtgccgccgcctcttatttttttctattactcagcagtttgttagaaagttttctcactaagctttagttacacaaataagtatttggggtttagaaacctgtcatccattgcaggcagactgatataaataccagatgggctataaaaccttttgtttttacgtttgccttggtaggttatcatattctggctctgttgcttcatcttacagctcgttggtctttttgaacttaagatcatctgttagtggtatattctttggcagtgcttattgtacagaaacagctgatgagcttcattggtctagcttgctttgtagtaagttgtgttcatgccacgaaggagggataattactgacacttttgagaataagtataaggttctgccagaaggatcatagacactctctagtctcaaaagcctcttttccttaagatgtaattctagagcaggaaaagcagtactgatttctgctttaaatctcaccattttcagggactactgtaagtagtaagagtggacattgctccttgcgtttttatctgtgagtatgtggtatattaggaaaaagtcttaagttgttgctgcatgtgattttggtttggctcttgagagttgaatctactcaataacagcttaaatcccacatcattttacataggaatactgtgtggcttacatttaccttttagttttgattttgtgaagcataattttttattgctcttactcggtttattctgtcatctggaagaaaacagacataactcagtcacaaagataaagatccctttgctttttttttttttttctttctttctttctttttgagacagagtcttgctctgtctcccaggctggagtgcagtggtgcactgtcggctcgccacaacctctgcctcccggattcaagcgattctcctgcttcagcctcccaagtagtgggattacaggtgtgcaccactacttacggctaatttttgtatttttagtagagacggggtttcactatgttggccaggctggtcttgaactcctgacctcaagtgatccacctgcctcggcctcccaaagtgctgggatcataggtgtgagccactgtaccctgctgatccttcagctttcaatatgattaatgcactatgcctggttcttcaatatt

SEQ ID NO: 87044 - DNA, 1065 bp, Homo sapiens
gagtataccaccatgcccaactcgtttttatatttttatagaaatggtgtctcaccatattacccaggctggtctcaaactcctgggctcaagcgatccatctgcctgccttggtctcccaaagtgctgggattacaggtgtgatcctctgagtctggccaatttttatttaaagatattttttaaattggactggacgcggtggctcatgcctgtaattaatcccagcaactttgggaggccaaggcggatggctttagaccagcctgggtaacatggcaagaccccatctctaaaaacaaaaaaaggaagaaaaaagcaagctatttaaaaaatgtaaaagtatacttgaggattaaaactgaaacagatttttccagctgacttgccaaatatgctcaggtacgtgctgatttgcctcattaacaacctagagactgaagtggcaagaagaatcgaatatactctgttctaacctttctgatgtttgcttgttaagtgggaaacttaaaaatttctactgtccactatagtagtactttgaaaaataagttttctcccagcacaaaacccatgtcagccacacacaagtagcaacctacaggcctgtctcttgacctctcgtttataggcacaagcctcccacaggcccagaattattttgcccaccagctgcttgccaggtctgatactcacctaaaagaactttagggagcattgccaaaccagcctgatgaaagggagttctcatgtatctaaatgagtagcaagaattcacatgggaacttcatttatgtcagtggactgacaatagcagatatgatcactaagctttctgtgaagtaaataacaagtctgctttcactttctgttggataagactttggaatttcagaattttctttccaagatgtcaaattaaaaatggtttttattactcagtggctatatgacattgctttttagaacttatctgtgagttttatgtagacaattcatttgcctccctcagcgtgactcttgtaggatttgtttctgatttgtggagttaaaactgttttgaat

SEQ ID NO: 87045 - DNA, 1053 bp, Homo sapiens
acttcaccttcgtactatgtttaaatagttaaagaattatttggaatttatggtttataattatgttatttagctagtcgcttctgttttttgctttcttagtgatagtagggttgtgcattctttcttcttcataccaatattaatgttttcttctctgtgtcaggatgttccaaatcacggatttcgtgtaggaatgaaattagaagcagtagatctcatggagccacgtttaatatgtgtagccacagtaactcgaattattcatcgtctcttgaggatacattttgatggatgggaagaagagtatgatcagtgggtagactgtgagtcacctgacctctatcctgtagggtggtgtcagttaactggatatcaactacagcctccagcatcacagtgtaagttggtatacagaaaaggtgtccttttgtaaaaatcagcaattctccagaggactatctcacataagtcatcttatgagctcacaggacaagaatatacctatgtctgattggttgccaggtaagacattaagactcaacaacaatatcacagaatcagaccatgtgtcccatggcaatgtgaatccaatagtcaattacataatgactatagaaacacaacagtcaccaaattaaactagacttactattttagtgagttaaaaattacatactaaaagtttattggtaggtaataaatgcttttgagtaaatagtggaaaatgtctcatgttgaggctatggttttgtaggaacaagtacccttattttcagagcatcatgtacttaagtataatggtcttggtaaagatagttcatataagttgtatctagacaactgtatcgtctaaattgtaaacaattatctagtaccaattttccctttttatttttcagcatcaagagaaaaccaatcagcttcatcaaaacagaagaaaaaggctaagtcccagcaatacaaaggacataagaaaagtgggtcaccacgtggtgttcacatacattttctaattgttaactaattggagtcacagtattcttggacaga

SEQ ID NO: 87046 - DNA, 1447 bp, Homo sapiens
taccttaattagtgaaggttcacaccatattagtgtcctaataaatttttttatattccttccacttgttctccaaaagaaggaacttcttctggtcacaactataattgtttctttcttttattattcagcccatttgaaagatctaaagatacctttccctttccattcaattttaatcaaaatagcaagattaaatgtggttagacttaatactaagcacatgaaaacatgcttctaaagttgtaattttctaactagggaattacattaaaattatgagcattaaaattggctgaatgtatttaaaagcatatatgcacatgtactctgaagagagaaaagactattaaagaatattcaccccaaatgtagaaggcatgtcttcttgccatgttttatagtatgacatactttgtgagtttgaagccttcaaagaacgtggtttttggtcttctcacaaatgctgacagattagtgtgtaacttttccttgtagatattacaaagaaacaggatggacattttgatacaccaccacatttatttgctaaggtaagaagtttttataagaaccctcatttgtaaattaggtttgaaagagggttgtgggttttttcctaaaattacggaaatcacaattacatatgttcacttaaaagaattaagaccttgtaaattcataggtgtcacaactctttattataattattcttaaattctatttgtctgaattctctctaaaccttaatggaagtttgagttataatattaggtaggtaggagaaggcacctggtaaatcttttcacattggtaatattttaattatcaaaataacaacatttgtaacagtagatgtgctttcatataattctttaggtaaaagaagtagaccagagtggggaatggttcaaggaaggaatgaaattggaagctatagacccattaaatctttctacaatatgtgtcgcaaccattagaaaggtaagataataggttttaaaatatagaaatgcaattataggatttgggtataagctaatagaaggagtccccaagcatattcgttttgacataaaatgtgtatgtgtatatcttcactggggagaaggttgctaggaatttcaaaataaatttgaatcctctgatcttacatagtttattgtcaagattgtcattttgagtctgctacacttatttatggaagtatatcctaatttagaggaaaaatatttatttaagttacttctagacaaggctagtccaattcagaattgtaacaaggccaagtttatcttcagtttcctgtgtttcctctttaggcctttttcttccttttggtagtagtttttgctgcttttctcttttccccctcatctgaaactgctcttacaaaaagacctagaagagaaattcttgggttttttgtttgtttgttcattttttt

SEQ ID NO: 87047 - DNA, 1059 bp, Homo sapiens
attacatatatatgcctataatcccagctacttaggaggctgaggtaggagaatcgcttgaacccaggaggccaaggttgtagtaaggcaagattgcaccactgcactccagcctaggcaacagagcaagactccatctcaaaaaagaaaagaaaaagaaattatgggtacaattgaaatacatgtaaggatgccatgctctgaaaacagttgaactgtttgcactgaacagatggttctcaaagtttggttcatagaccagcagcaacagcatcacctgaggacttgttaaaaaggcatattctcagttcccacccaagatctacaaaatcagaatctctggagtgagacccagccatctgtctgttaacaaaccctgcaggtgattgtattgcagatagacactagtttgacaactgctatcagatgctgtattgttttatttaattttattttcttattatgtagtgatttatttctgggtttcaggttacaatgcccttttaagatatgaaggatttgaaaatgactctggtctggacttctggtgcaatatatgtggttctgatatccatccagttggttggtgtgcagccagcggaaaacctcttgttcctcctagaagtaagtagtttatttacccttaccgtaatttttttatatgtgtactttaatgctattttacacatagtaatgttagagtaatatggaaattaaaggccgggcatggccgctcacacctgtaatcccagcactttgggaggccaaggcagtcggatcacttgaggtcaggagtttgagaccagcctgaccaacatggcaaaaccccatctcaacttctccctagctgggcatggtggtgcatgcctgtactcaggaggctgaggcagaagaatcgcttgaaccggggagatggaggttgcagtgagccaagatcacgccactgcactccagcctgggcaacagagcgagactccatctcaaaaaaaaagaaagaaattaaaatagtttttttggtgttaagcagctttttgctggcaaggcatatacttgctttct

SEQ ID NO: 87048 - DNA, 1055 bp, Homo sapiens
atctttgctcatctttgagctttgaggctattttggtttttcctgatttgttcatactatcaagtcttttataacctcacataatccttttctttatgatcaacattctaaattgaatgaggaactgactgtccagagcaacacaaactgtttagtgttatcagcatttatattcttaaatttgcttatttgatttaatttaccattgcataagttccaagtaattgtgaattgccttgagttttaaagattaaaatataatggaaacaatactttgggaacatctgttagatttcagaaaatcccttcatgatgctcatttaattgattttccgagtccccatcttaaccatttgctgtgggaggctagtgattaccggttctaacattggaagttttctctttatagtaatttctacatgagaaattttgaaataataatttaaatagtttaccatggtactcatctccaaaactcttcaactccaccttcttaataactttatccagtgcttttccctcacgtccatctatgtggactagatttctaatctatgaatttaatttaaattgaaaattttcatttctcttattcatgttgttggaaaccacactgctgattggaattgtttttctttctgctcttaggccagatcttttaaaagtagaaattagggtgaagtgtattcactcagtacatattaaaaatttcttaaatcagtttaatcctattaaatctgctattgagtttgtaattccactcatagaaaaatcgctgcttaaatctcatattaggacagtatcagattttgaagtcagcatgaatctagtctaatatatgtgaattttctctttatcttgtttgtccctgaaactggctttttccagatagaattctaggaaacaaacggaattaaaatgacatttttagtttaatattcctattattgatggtactgcttaattttcattgatatgttttaggctttatgttaataagacaataatttaatgatttttatgtgacaggcacctatggggacctgctggggtga

SEQ ID NO: 87049 - DNA, 1050 bp, Homo sapiens
atgcctgtaatcccagtactttgggaggctgaggcaggcagatcgtctgaggtcacaagttagagaacagcctggccaacatggcaaaactaaaaatacaaaaattagccaggcttggtggcatgcgcctgtaatcccagctactcgggaggctgaggcaagagaatggcttggacccaggaggcggaggttgcagtgagccgagatcgcgccacttcactccagcctgggcgacagagtaagactctgtctcaaaaaaaaggtgagtggactttatggagaaggcaggaacagtttttcttttctttttctactttctaccagaaaattctgtaagtagttaggaactctcatttctttctacttaattttctgtaatgttttctccccttccaaataatatttcatcatcctctgctagatgtactttgcctgttagtctgaagacattttgatgatggctttttgtacatttgccatctcattgggataaattattccttcttggttacctatatgcaacctcaggtcttgtctctgcccacttacagattaatattaaagattgtatggttgtctttggttggcagctctgcagagggaaatctgtatctctgccataaagcatcgtgtgtgcagtgcatcaacctcctgagagtctgaatactagccagctgagctgttggaccatctgggaatgatcttgaagtacagcaaataagacttcccacccacttattttcttacagtcatgtggaggttgtcatacatttgtgttggggacccctcagcatttggatttggccatgtcctgcaggacctgatgacagcttaccttgcagggaaggagagtcgctcccagatagccctcacgagtggccctggagcaggaagtggtggagcagatcttccttgtttgggaggagcctgaggtggacctcgcgtcctgagtctggaaggtaaatttgttgttacctgtaaattatggttctgctagttcatgctatgccaatccagactttcagaggtatccctcctgccagcaagaga

SEQ ID NO: 87050 - DNA, 1292 bp, Homo sapiens
cctcatacagctcttagcatttttccaagtattacctctttttaagtttcaacctttgcagtattttaaaggcctgtgttatactttgttattaatcctcagttgtgtggcacttttcatctttcaagtgtaatcatttcaaaagctggaatttgttgtatatgaaaatgcctggcacatggtaagcactaaggaaatgttggttgaatccagcgtatctgccctgtttctgttgaccctttgtaaacctttcagacctcaagccactatcagaccttatagagcccatcaccatggcacaataccagtgttctctctgacttctctgtgcaggcttctttatcatttgtataggagatagaagaaatgttcaaggcaaattttttaattaaaactttcagatggcaggagaaattatttaaactgttagatgaagattgattttattatatcatcataacaccagtgtttttattttgttaattagctacctgtgagatgtgtgggatggttggcgtccgagatgctttttactctaaaacaaagcgtttctgtagcgtttcatgttcaagaagttactcgtcaaactccaagaaggcaagcattttggccagacttcaggtaacggtacagaaactttcttacttatatccattatttctatggcttttgccatttatctgtcatttgactgtgattcactgtactccacctctgcccactcagttatggttttataccacatcttgaggaaacatgtgagccccaaagtttgttcagcctataaaattgaaaaactattttaaatggataaggcatactatccaaataaactattatttgcagaagttaattaaaatatcctttttccaaataagtataaacacttttttatatacagaaattgaagacattttcctgtttccccttgtttccttttgtgttaacatcaaggtagaatctttcaacatttggggggaaataatttaatctctggttttattttctcatcgtcctcgctttgtactttttagtacaatccatttgatacattgaccaaatgtatttggttaatccaactaacctttttgacaacgctcatggtatggaaagaaaatcgtcttgctttaaatgtacatcagtgcctacaaaatgactggagacttgaccatttgactaagttcttactattgtattgtaaactactttttaaaggcattaacttaactgatttttgcagtatttttattggatgatcacagtcttctcatttaatttattattgtgatcat

SEQ ID NO: 87051 - DNA, 1260 bp, Homo sapiens
taggcatgagccaccacgcccatcccataattaaaaagaaaaaagaaatctgggcgaggcacactggctcacgcctgtcatcccagtgctttgggatgcagaggcaggacatcccttgaggcagggaggtggctcacatccataatccgagcactctgggaggcttgagtgggcagattgcttgagacgaggaattaaagaccagcctgggcaacatggcagaaccccatctctacaaaaaaaaaaacacaaaaatgtttatgggatggtggcacttgcctgtagtcccagctactcaggaggccaaggtgggaggatcatctgagtgcgggaggtggaggttgcagtgaccgaagattgtcactgcactccagcctgggtgacagagcgagactctgtctcaaagcattttttaaaaaaagaaaaaaaaaagaaagaaaatggttatttctcagggctgcgttttcatttatcaaatctcatttaccagaatttgtgctagggtcttttagggggtgtgtatgagtgttgtgtcatgtgtcactggtttctcttacttcaaagactgaacattcttcacgatctgaaaggaaaagaagagattctttcgggatgtttgacggttatgatagctgcagtgaggacacaagcagcagctccagctccgaagagagtgaggaagaagtcgctcctttaccttctaatctcccgattatcaaaaacaatgggcaagtctacacatacccagatggtaaatctggcatgggtgagtatttataaccttcacctgttctacagctttatgtttaagggtgtgttttcatttggtttcttctgtcatttccccttccttagaattattaaggggcagtttgaagagctgacgtttataattcgagataagatcactgagttggtgtttaactctttattttgcctacctcctggtggaaagcaaatacaacaacaacaaaaaaaggccagtgagaaacttcatgtggatataaatttagtaattagataagaaatgcctctgtaactgaaagtataagtgcataggatcatgggcttataaaattgaaagagacattcgaggttgggctccctcctctatattaatttcttataatttccgttttaacataactggtgcttggatattctctgactcagtaaggaatttctctctgcctaaaatctggcttgaaaaagaaaaaggaaatgaaaaaggaagcagtttcatttcttagtatctcaaat

SEQ ID NO: 87052 - DNA, 1058 bp, Homo sapiens
aatactcattagtttgttcaacgttgtggcccaattatttggccaccgtttgcagtcttaattgtaggacaggaatgttaagtctaatacttctttgtatttctggtgctaagcatagtgatttgtatatatcgttcaataaatattggttaatattaaccaggtgtgttggctaacgcctgtaatcccaatactttgagagcccaggacaggcagattgcttgaacccaggagttcaagatcagcctgggcaacatggcgaaaccctgtctctacaaaaaaaaattacaaaaattaggtgtggtggcacacccctgtagtcccagctactcgggggcagaggtgggaggattgcttgagtctggtgggagacccaggttgaagtgagccatgattgtgccactggactccagcctgggcgacagagtgagactccgtctcaaaaaaaaaaaaaggaaaaaaaaaaggttatcatcatctattactttaagacttctaagctttaaaatttgctagagattattttatacaccagagaagtagcccccttgtgtatctgtatgtgtttaacccatctttgtttaattattaacaccctgtagttactattgttcagtgattttatatcttctgagcaaccagttccaaatatattttttaaaggtaaacaccaagagaatgttatcatttcagatcaagtgtttttaggttatatcagatcaatatgatactgaataagctgttgaatttactttctcttttctttttttttttgagatggagtcttgctctgttgcccaggctggagtgcagtggcatgagctcggctcactgcagtctccgcctcccgggttcaagtgattcttctgcctcagcctcccgagtggctgggactacaggcaaatgccaccacacccagttcatttttgtatttttagtagaggtggggtttcatcatattggccaggctggtgtcaaactcctgaccttgtgatctgcccgcctcagcctcccaaagtgctgggattacaggcgtgagccactgcgcctggcccgtc

SEQ ID NO: 87053 - DNA, 1433 bp, Homo sapiens
tcatgctttttaaccatccagtttctaactttatgtaatgtttgacataaaatatttcctctaaatctactcattagaattcagcttgtgaaaaagaatcagtagaggtgtaataatagtgtttttaacattttaattaataaggagttccaagtttttttcctgcttactttaaacatgaactgtcatgacttaagttgactgactttggagacatctgcattctaaacatactagacaggaacaactggttttatttttaagacgctgccatattctttaaagctggttatatgttgaccttattatctaaacctttctagatgttctagtgctgcttttggtccctcaataatgttgaaaattaaaacaacattttaaattgttttcaaatgtaacatagtgatcaaaggaaaatataagctatagtttaaaagtgaaaacaacatattaggataaatactaaaccactgaattactaaaagccaagagtgctcagtagtctgagtaaccacattctaaaattagacaagtgacattctttgggttgctctttgtttctcagcttttcatctttaaaatgtttgctaaataagatataacctttcacacttatgtatcattagtctgagggtttcaaaattcaagaaagaataaaaacatcaggacaataaaagagaaaggacttacaatagttaaaacaagctaagatatttctcctaacaccacagtattcttaactgtgcaagatgacttttgatttcaggcaaaaattgcacatagatttaatcattattttttaataaaccttggcttaaggatttttttacctgcaaatttaggatttctcttcttgctttgctggaacccacaataaaaggtgaaaaggaaataattcccatttgaacaaaccctgaatatgagataggatgaagtgatacaataagaggggtgctggcagtgaggttgatgtcacaattctgccattgagtagctccatggcccttgttggacaagatcctgtgcctccattttctcatggcagttgaagggttagtctagtatcagcataatccaatagaagtttctgcaatgatggaaatttcctatatctttgctgtccagttacggtagccactagccacatgtggttgttgagcacttgaaatgtaactagtggaactaaaaattgaagaactcaatttttaattttgctgttttaggcaatgtaaatttaagtagccaaatgtctggcatactggacatacacacatagaacactgttttctaagcataactaatcattataatcacttcttggaggctcttgttaaaatactaaacttctctcctataacttatttagtaggtctgcagtgggtcctgggaatgtgtttttaatgtataccccagaaagtttatcaggttggtta

SEQ ID NO: 87054 - DNA, 1520 bp, Homo sapiens
agggccaatcttccgggtgtagggggaagcggcgtgactggagtggaaaatttttccaacacaatttcgcagctgcaacatattgaaaggagcgcaagaaaccccgactatacactgggacggctgaatggaacttctgcttttcctcttggctgtaaccacttgacttgacacaagccccaatacgctttccacccttcgtcttggtacggtccttggagtacggagcctgcagagggtcccacggtggaagcgagagaggagggtatgtagggaagtgggccaatcggggcgcgggtcacggcgcaggcgcgctggggagggagggctatgctaatgttgttgatatcctggggccacccgagttaaaggggggaaatccgggggctgctgcacccgccaccggtctgggcccagccgggggccccctgtagtcgccgcagtcccggggagaggcacctgcccccagcccggggagggggcgccgcgggctcggggagcacggacaacccctacccatgaggccctgatggaaaacacaaaggatctggtgagagccgagcgcggcagccgctttgtgtgccaggtgggggggacgcctgcagctctccgaccccaggaaccccgcagctccctgaccccgctccctggcctgcttctccatcccacgccctctcaacctccggagcccccctcccccttccagccgttaaacgattcaggggttcccctccccccaccccgtcagccttggactcgttggggttctctccatctcctccaccctttggaagaaaaattcgagaagaaagtttttctctgcgtcctgcccccgccccctgctctggctaggggggaaaggctggatccgagacttttccttttttagccacccagggtgggagagtggagtagtcctctcttcttggcggggagggggagcacagtttcgttgctttgcaggggaaggtgtctatctgccttgggggcagtgccgcgaggcggtttgcacgtggaggtggaaatattgaaagggggcggggtgggcacgtgcgggagaggtgggagtggtgtttgggaagcagcctccaaggctgcatatttaaaagggtttcaagtcggtggacttctgtgaccattgcgttctcctttgtgaaataagaatcctaacatttcagagtcggaagagacattagaggtcatccaaagcagccgtcccctctgcagcctctctgacaagtggtaggtagtctgaaccctgcttacacccctaaaagcactgagagctcactactgcccaggaaagcccatatttcagtagttctaattgttgtctgcctacccttattagacccttcagtctcattcatgtcctggttaagttgctcctttttttacttctcaaattttctctcacatcctcctcacccacccactgctcattggcctatattttgtgtgccaagaaagaacagcagggaagtggaggaaggggggttgagagatagtgagggctagcc

SEQ ID NO: 87055 - DNA, 1955 bp, Homo sapiens
accaggcttttcttgagagagtcccggacattgttctaggcactggaggagacacagcaatggacaaaactgacaaaaatccctgccttttggcgcttgtgtgctagtggcagagacaagatagaggagataaacgagtaaacttcaggtttgttggtgacaagtgctgaagagaaaaaaggacattcgggaaagggagatgggcgtgtgtagaggcctgtgaaattttagataaagggggcagaggaaagctcaccgagaattacccaggccatgtttattacacaaatgctgacctagttaatgtcagctgcttaccagagccgccttcgggtgcttgtaggagaagtggcagcaatctttttgggaagtacagaactattactggaaacatgctgaactgtgcgacggttttgtcgtctggaaaaggaacagtgtacggaggtgggagctgttgggtttgaaggctattagactagtagtagagcaagtagaaaccacttggacatttctatcattggttttgggaagctcaaactcacttcaagggatattctgtggtctaggtttagatttttttttttttttagactcgccctgtcgcccaggctggagtgcagtggcgccatctcggctcactgcaacctccacttcctgggttcaagcgattctcctgcctcagcctctggagtagctggcattacaggcgtgcgccaccacgcctggctaatttttttttgtatctttagtagaaacggggtttcaccatcttcgccaggctggtctcaaactcctgacctcgtgatccgcccgcctcggcctcccaaagtgctgagactacaagtgtgagccaccgcacccggcctaggtttagatttgatagtataaactttatggtataaatttataactttagaatttagatttaatggtatatttattttttacttatttagagatacggtctaactttgtcacccagactggagtgtagcggcacctattagtcttccatctcccttttgctaatagtaactggttgctcttcttgttggtcacagataaattacacctgcacaattctccgaacactttaaactcagaagtcagcttcatcctcctaggctcaagtgatcctcctgcctctgcctcccaagtagttagctggggccacaggtgcacaccacacacccagctaaatttaaaaattttctgtagagacgagatctccctatgttgcccaggctggactcgaactcctgggcccaagcagtcctcccaccttgacctcccaaagtgttgggattacaggcatgaggcattgcgctctctgctggtataaagtttcttaaggaggtagggggtcaaaaacagattgggaaaatggagatatctttgactctagtttgcctccggtcctgtaatttctgtagttctgacatttctcctccttttttcatctgcagactcatcttttgttcttgtcttacttggtgttttccttcctgcgtgttgagtgttgactttttctccttgactgttccatcttgcctcacctgtccagtcggtgccattctctgatttctccattttctgcctctgcttccagcatttgcaatggtagcattccatcccattatttcatcagagagtggtagaaaaaacattctatgagccatttggctgtaaggcctatgtgtctgcagtcatgggataggaaaatctcagtgcttgagggtgttttgtctgctgtaggttcaagaacatgaagactcgggtgactcagaagtggagaatgaagcaaaaggtaattttccacctcaaaagaagccagtttgggtggatgaagaagatgaagatgaggaaatgtaagttgcctaacttttcttctgaatccctctgtacacttaaaaaagttattttgcagattttaaaatcattctttttaccaattt

SEQ ID NO: 87056 - DNA, 1026 bp, Homo sapiens
ttcaccacgttggccaagatggtctggatctcttgacctcgtgatccacctgcctcagcctctcaaagtgctgggattacaggcgtgagccaccacgctgggcctaaggtttgctctttatgtatttaactctttgatttacttggggtttattttggagaatttcataaactgtgtgcagataagtcatgatgaattttctcaaatagtagctctccaaagtgtaaaccagatgatctgaaatgttggcaactacttttttgttcttttaggaagaacagagaagatgcatttgaaatgttcacatcttaaaaatcttgacctatattgtttcattaaacatttttctccaagtgctaaaagcagcagctatttatattaactctttaaaagttatttaaaatatgctgttctgtttttgtagggttgacatgatgaacaatcggtttcggaaggatatgatgaaaaatgctagtgaaagtaaactttcgaaagacaaccttaaaaagagacttaaagaagagtaagtgtcttttttcatatgatttaccaagaggtgtatgtaaccaatgcccagtcattaaccgtaaccgcttcttgtgtagttttccattttgaaacagtaagaggattgctattgtgggcagtgactaaatttctgtagttttttttaggggagaggggacaaaacacagacacaaagaaaatttggaaaaaaattcttaccactcaaatataatcagtgataatattgcttacttgttcatttgcatatggtacaccataattttataatatgaacattttcaaaaatttaaatggccaccacctgggttcaatggtttttaacattttgtcatatttgctttgtgtatttgggggatgtgtgtgctttcccaatgtatttgagagtaaggtacagataatgcgacacttaactcattaatttgtcaatgtgcatctcttaagattaaggatgttttccttcatattcacaataccattgtcatacctaagaaaattaac

SEQ ID NO: 87057 - DNA, 1024 bp, Homo sapiens
tcttacgaacacagctatcatgcttctgttaaagcttactttttccagagtgaagtgattctgttttattcagatgatatataatgaagttttgtatattcttaacaatctggtcagtttcttttagacgtgttctagtgtgtagtctatgtactgtggcataaaccacaaagagacttctttacatagtcctgatatctgggatgtgttgatatgaacaaataagacaaccatgtaactagatggaaataattaacaaaaaatatgtatccaggactagtttaagtgggcagaggttcatggaggtttccagtataggcaggttgggactgttctgtgtgagtaaagataataacttctgttcttaaagatagttacttctttggaagagagtccatacgtattctcaagggtgattcaacgtatatgctttaaatgtatcaagctttatggacatgtagtggttgccataaatatatttttcaaatatttttgcttagattccaacatgccatgggaggagtacctgcctgggcagagactactaagcggaaaacatcttcagatggtgagcgttgatatttctgtttaaattagtacataagtccctgttcctgttcgttattatttgagctttcttatgaggctcattaaaacctggcatttcttgcctggctcggtagctcacgcctgtcatcccagtgctttgggagcccgaggcgggtggatcgcttgagtccaggagtttaagaccagaccgggtgacatggcgaaaccccatctctacaaaaaatacaaaaattagccaggcctggtggtatgttcctgtagtcccgactacttggggggctgaggtgggaggattgcttgagctagggaagactagggtgcaataacctgtgataagtgataagtgccaccgtactccagcctgggtgacagagtgagactctgtctcaaaaaaaaaaaaaaaaaaaaaaaaaaaaaaaaccaaaaaaatctgttttttgactgtaggttttaa

SEQ ID NO: 87058 - DNA, 1080 bp, Homo sapiens
tgggtcttccatgtttaatctaacactgatgtacattgatggtttcttgggttgcaacaataaacaacagacctggcccttcacttcaggatgtcactctctgatgggggtatagatggtgaacacatggtcacaaatgtaaccattcagtcctgcaggtgcttcacagtatctgctcttggatagggtatcccagttttcttttagagaataacacttggtccagttcatgtagtttggatgggactgactcttatctccttatctgtgggtggacaaactcaagaaattagtagggcaaggtatggggaaggagcgtggagcttccgtgccttctcagggcacgccacctcctcagcacctccgtgtgttcagcaacccagaagctctctgaataccttctgttaagcctttttatgaaggcctcttgacataggcatggttgattaaatcactggccgtggctgcttaagtcagccttcagccccttggatatgtatttttaaatgaacacttgtagtgaaaagtatatactaccaggatacagggtctgtggaaataatcaaaagaaccattttgtacttctttataggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtaagatttctgttgaatgcacacaaccagtcattccccccaaggtgagtttatgtaacagtgtttacaacacttttttcactccataggattcttaaaaataagagtttctttaggtatagtgtttggaaaatgtctttgtgcttttgagataacacgtttgaatgaaaccagtgaacttttttactgaacacttacggaatgatcataatttggaaatatatattccccctacaccagacaagcaattgcaaatacttggctgtaaagttagcagttgatgcagcagaaaaagcatgagccatggagctag

SEQ ID NO: 87059 - DNA, 1003 bp, Homo sapiens
gccagttgtatgcattctgatgcatcctgttaggtaactttttaatgagtaacttggctctctaagcattttgatatcaggaggagtcccctgtatagtcaatatgaacctttcagtcatggaaaaagagacatgtccttttgtaagtaagttgactgtatatacctagctctcatatatgatttggttacatgtgtcacatccagagaagctagtcagtccttaagtaaactgacatattgtgaaaagttttggggttttttttgttttttgtttttgtttttgactcacaaagttaaagatgagattcctgtccatcatgagctgcttagtaagtggccagcagctagtttatatatgtttttatgtttttggctgtctctagtggcagtgtatttcccttctggtaatgaactttgtgacaaagaagtataatttatccttttagtaaattagaggtattactgcatatatttggaaaattagttgatatgtttactgtttggagagctgagtctctggcctgcagttaaaatggtgaatgctaaccaggacaaagaagagaagtttgttaagtgctttgtagtgaccttatgtttgggtcaaactcagtgatgcctgcgtttagacttattcggggtctgagccagggttttgtttaatttgagccacttacgtattttaaaaagtaagaaactcatttgtcaatagatgatagttttattgaaaactatataaaactttatttaattgcttcatttcctattttaggtttgaaagagaagatagtgaggagctttgaagtctccccagatgggtccttcttgctcataaatggcattgctggatatttgcatttgctagcaatgaaggtaaagcattattattgcttcttgttcttctcccacaagacactagtgtagggatagtcttgcaccttaactcagtgtgtccttaaatctgcatctccaagtagaggagcacaggtgggacttggagagaa

SEQ ID NO: 87060 - DNA, 1693 bp, Homo sapiens
tggtggctcacacctgtaatcccagcagtttgggaggccaaggcaggtggatcacctgaggtcaagagttcgagaccagcctggccaacatggtgaaaccctgtctctactaaaaatacaaaaattaactacgcatggtggcacaaacctgtaatcccagctactcgggaggctgaggcaggaaaatcacttgaacccgggagaaggaggttgcagtgtgctgagatggcgcagttacactccagcctgggcgacaagagaaaaactgcatctcaaaaaaaaaaaaaggaaaaaagaaaagaaatattcttagtccagttttccagaactaggagggttataataggtctgtatttgtagtctcctgtactgttaagagggactgagagtggccagtttacttgcctttcaagtttaaagcaaaattaacaactctttttttcgctcttttatgcaggggatggagaagtttatgtttgggatgtgaactcaaggaagtgccttaacagatttgttgatgaaggcagtttatatggattaagcattgccacatctaggaatggacagtatgttgcttgtgggtaagtaaagagaggttcttgtaaccttaatcacattgtgctaatgagaatatgttgaggaattgaatatactaggtggtgcatgagtagttctctttataaactattcagtaatatgaaattggtcaacccagctgagcttttttcattttatcatctttgtgcagtgttgaataataatattacagtagttccccccttatctgcagtttcactgtttgtggttttagttacctgtggttaatcacaatctgaaatctatgtaagatattttgagagcaagagaccacattcacgtaacttttattaggatatattgttacaattgttctgttttattattagttgtgttagtctgttactatgcctaatttataaattaaacttttttatagagatgtgtgtataggagaaaacacagtacacacagggttcagtaatccacagtttgaggcatccactgggggtcttggaacatacgccctgccagataagaagggattactataattgcagttgaacacctttttagcaaagaaaatgctggcgctaccttatatcattgtattttttcctatttaaaatacctgtttgatcacatcaagttttcctataattattttcagcttcttgtcattgatgaggagatagaataagtaactttgggtttaaatcttaaagatacctaaagcatttttcctttatccagctgggggtataaataaaaaacatgttcctaggaaataccatttgatagtattgtagaaactttaaaaatattatctagaacacattgtactgtgctattactgaaaacattggttattacactggggaaaagatggctgtgttctactacttgattctgaagatgcagggtgagaggatgaggcattggatacttcgcagtaattctaagctaccttactaaaccactaattagaacccataattctgtaacttcaagaagtaggtttttgtgattttcttagaccaaacacaattgagccatgaaatgatttcagtcaaatcctccctgggatgggaagtcaaggggtcttgttgtccagaaacttagcatactctctactctttgttcactctctccttcc

SEQ ID NO: 87061 - DNA, 1075 bp, Homo sapiens
agaggagtggaattgtcattgaagggaggcgggaggaggggtgatggtgttagaagagataatatgcatgtggccacccccacaaacctttaggaatgcagtgcataattaggactaaaggcactgatttggatgtggtgggtgataggtggtctgtgggagtaaatgagatgaatgagacactagaagtaggttggaaatagaatcctggggacaagaatcagtggagaaagaggtgactgtgaaggaatcaggatgcaagaagagtcagtaaagtttagccttcaagaagtcaacagaagggggagaatttgaattctgttttcaacctgtttggttggaggttctataggacatctgtggctatagtggtgatagctggtctctttgtaacatgattcctgtaaataccagtttgtggggttaaatctatattcacttaggttgtgaaagcccttttacttggtttttaatctattttaatccttttctctttgtagttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggtaaatatttcattacccctttattattgttattttttaaatttaagttgaaaacatgcaagagtaacaggaaaggagagcgttgaattatttttaaaacagtggcttcttttgatataggaattattagtattgtagcttttggatgtggttgttggaaggatgcacagtagccaccacatttgattatgtcacttctttcagtaaagctttgctgtccattctcaccattcctaaagtggtcctcattttcagaggtttcttttagtattaatgttaaggactatatttaaggcagacacttcattccttcacaattttctttcctcatttacctttttaaggcctgttgtcttaacagaacggaggcaattctcgggttttgaaagtaagttgaact

SEQ ID NO: 87062 - DNA, 1021 bp, Homo sapiens
tgacactcaaagggaaatggacaacgtagttacgccgttcttgcagagaggaaaaataaaacacatcgattgttcaaaggaagcaaggtttttcctagcaattagggttaaagaaatttctcatctggggcttccttcaggaagacccaatgacacaatgtcctttacaaaatgccaacagcaattcccccaaactgctcataaaattaagttttgcaaagcaaaatgaatcttaaatgtgtttgtcattgcagggaggggacacatttggtctgtaagttatcgcctttcaatttatcacttttgtcaagtctgaactgttctatgttaaattttcaagtaaaagccagtctctgcagtgaaaagaatgtgggtggaagacataggtgataatgcaccttggctagtggaagaaaagtggagacggctgtgggccgattttgaacctaaagcattatgtgacattacgtggttccacttgcccctccaggcgcttttaatctcagtcaagaggccatgctctaggtagctgctgcctcttcaccctgggccatagaatacatctgaccttgacttgaagcttgaatcagacctcccccagcagacctgaagactcatgagcaagaaatacacgctgatgttttataccactgagatttttgtggtggatagatagcgttattgcggcaataacttactaacaccctgccttgacgacttcatgaagttgtgcagactaagtgagagaatgctcttggatattattcgcatatccaaattgaatgagcaaatgaagagttagagaaaatgattcattctgcatagcattaccagatccattagttgacatgttatatggatgcttctgtattgcaataggccctggttgtatttggtctgccaagcaggaatgaaacactgagttgagactgctggttggaatgatacaaaaaggacaatcgagaagtgcaaaagaatgagacagaatagtaatgagctacagaaggagtctgaaaaccaa

SEQ ID NO: 87063 - DNA, 1046 bp, Homo sapiens
tttcaaatttacaattttgtgagttttcacaagtgtatacagtgctgtaaaagcaggatatgtaatatttttatgatcccaaaatgttcccttgtgcctcattgtagtagaggaactcctctgaccccttcacccttggaaaccaatacaattttacatttcccagaggttcatattaagagaaccatatgcatataatcttttgtagcatttctttcccttagcatggtgcttttaaagttcatccatgttatattgttgactgtattagcagttcattcctttatattgctgaatagtgatttattctatacatacatcacaatcacatattgatgaacagtttgagttgcttctagattttgtttatctgaaataaaacttatgaacattcatctgcaaagtccgtgtatgaacatatgttttcatttctcttgattaaatacctaggagaggaattgctgcatctatggaaatggctgtgtggtcttttatttttagtgtgttaaaatggtgaattaatgatttgtttttgaatgttggaccaaccttttatttctgggatgaactgcacttgactatgatatattattctttaatatattgttgtattccatttgctaatactttgttaaagatttttgaacttatgttaaagaggtatattggtctaaaagttttttttctatataatgtttttgtctggttttagtgtcaaggtgattctgtgtctggtttctgaaaggagctgtaaagtgttccatcatcttctattttctagaagattaaatgtttggtagaaaggcatcaatgaaaccatctaggcctacacaatttttataaagatttataactacttcaatatcttgaattgttatatgactatccagattatttcttctacagtaagctttggtagaaagtattttcaaggaatttgtcattttcatataagttgtaaaatttattagcataacattactcattatatccttttagtatactttcggtgtctgtagaatcttagtgataaattccttccttcc

SEQ ID NO: 87064 - DNA, 1048 bp, Homo sapiens
gacaggaagtgagaattttggcttggcctgaaggctcaatgtaaataaaaatctaaatagctcagtttttttttcttattactaagctctgcctgtgatagaattctttatcacttcagcccttacaggaagaagctgacataggtgccagcctgtgccagaatattcaattaactatgcatcaaggtgacccatttgtccagtgggtgccaaagctgaaatttttttaaaaatccattatttttccaggtgaatgtattagataaacttgcctgccaacaagtcctttctgacttcataattgttgatttgtgatttttttcaaggacccatatgctaatctatagattacagctacaaaatacaataataataatatttgtatgaggcttcagagttcacaaaagtcattttatatatcttgcgtctcataacaattcacattactttaggtaaataatattattgtctccattttatagataaggaaattgagatttaatttagttgaagagcttgtccaaggttactaggcaattgatgaaactggtattcacactagaggctgttagctcttttagggtatgtattttactgtctcatgttgctgtgtaattgactatttataaatgcccatggttgacctcacttaacagttactaattaataaaaatcagtaaattacagttttctccaatagctgcaaattgaaaccctaatccttttaattttatcatttcagaactgtttttgtaacattaaagaattctgagtttcacatattttcaatatctctcacaagtgtctatcacatatttcacatcatcaatcacagatgtgttagtgggaaaagtctcaaagacactcaatagaatgctattctgttagaaaaactgactttgctaagaaaatactgtggtaactattttgttaatagagatatgaataatagtcctccaatttgtatattttgtaagtttaaatgttcttacaacaatggttcataaaatctggatgcttacttttcctaaagctaggaagaaacact

SEQ ID NO: 87065 - DNA, 1028 bp, Homo sapiens
gtttcttcaagattttgaggcatggaaatctgatttaaaagattttatattttcctagcctttgaaaatgagcattttgcccatggcattcaaaagtagctttctctttctgagtggggtacataattattgatctcttattttctatcaggagcttaagaattgtgttttcggctgggtgcggtggctcacgcctgtaatcccagcactttgggaggccgaggtgggcagatcacaaggtcaggagttcgagagcagcctggccaacatagtgaaaccccgtctctactaaaaaatacaaaaagtaagccaggcgtggtggcgggcgcctgtaatcccagctactcaggaggctgaggcaggagaatcgcttgaacccaggaggcggagattgcaatgagcagagattgtgccattgcactccagcccgggcaatagtgtgagactctgtctcaaaaaaaaaaaaaaaaaaaagaattgtgttttggttttgttgctgttttaactctggaacttttttcatctcttgaattcagacttggtcacagggcttcccaggaggtgtggatgtaagcgaagtcaaagaagtatacctcgacctggttaagaaaggcgttcagtttcctccctcagaagcagaggctgaaacagcaagacaagaggtaggaggcctttctttgacccatggagactatagtagtgtatcacttgggtcttttctcattacaggagacaaccctaaatccacccagcttaagcaaaaagatgaagttattagaaggatattgcaatatctcatagaataaccgagacttgggattttgctacttaaagtgtgttttgctactaaaagtatgaaagtttgtttggcatgttccaccctagactaatcagaacctccctttttacaagatttccaggtgttttctctgcacattaatgttgagaagcactggcctagagccttgagctttcacctctccacccaaggttggagatgtggcattgacccaaggagggtcattgat

SEQ ID NO: 87066 - DNA, 1074 bp, Homo sapiens
gtattatttttttcttatataaaaatgcatgtgactaattcctcttagaatttaatacaggaagaaaaggtgtttctttattccttcttctttaataccatgagaactggataaccctcatttgtttttcttttaccctattggttgccaagaaactcaggataacttttgccattttatccaggtttctggtaccttcttctgctaggtacctggtacttctcccctctccatattgggttctaatctttttttttcctttcatttttaaaattcctaaagcatattttggggtttattacaagagatctcaagtccttttagaaggtgacaaggtatacatttgtaaaataactatatgtatatttatatgaaattaaatttaagtttgaaaatattaaattttgcaaaagcattttttcatccagcaaatgtcccatgggggcaggaaacaaggtagttattctttgtgtgtcgcactgactggtgattgtgttgctctctacagattggaaaactgcacagtgaattggatatggtgaaaatgaatgtgcgagtgatgtccgccatattgatggagaatactcctgggtctgaaaaccatgaagacatagagcttctgcaggtgttgtacgatttcagggactatcagtcaaagtgtctcttaaagttattctctaaactttgagtttggagatggaagacaccttaatattgtctagtacatcctcctacatcctgatttcagttgatttctaaacttaacaaaaatatccaagaatgactttgtcagaaatgcagtagtaacttagacatggtttttagcctcttgcaacaaataatttattataagttataaccttggtcatgtacaatcaattctctagttgttttaagtatgtaaaaattgcctctattttcatccactcaacaaacattgagtaactgtgatataggaagggatgtagaaatgagaaggaggctattctagtccttaagagtttatgcctaatgagcaagattggtttgtaaacaacaaacataatgaagtattatagatactgtagtataaat

SEQ ID NO: 87067 - DNA, 1015 bp, Homo sapiens
gtgggcttaaccagactggcagaggggagctgttgaaaggatataagctgaggggctacataaccaggtcagattttagaaaaatcctctggtggtgttgtgatgacagattctcaggaagcaagacaagactctagaaaacaacttaagagagtatttctcattggttgtatgctgtgttctgtgggtagaaagtggcatctttggtcaaataagtttgtaaaaccaattgtctactgtatttctcctcttggagatgcataaagttcactgatacagctaagagtctttgtttaacccaacatttataaacttatttatccaaagaatcccaatttgccaaatatctgctaatattctgcagaacatcagggtagtataccttgagaaatgaatcagtattttggatccgtggctttaagtatattatttttggaatatcttagaattgtaacattttgctaaggatccttggggttcttgaccttaggcaagtcatttactatcactggacttagtttatgtataaaatgaagagcttagatgacagtaagcaagagtaatattaaatatatcctctttatgtgggatgtaaaaaggaaaattcatcattaaatagatttcaaaggtagtagtccacaatggcggcttttccagatataaactttttaacttatgatgttaacacgtgtgttaaactaaaattgaaaaattaaatatcaaagtaaacggatatgtggcagataatattttttaaatagccacagcaatatttctagttccacctggtcttcctgggcctttcagagctctaaaatgaaatgatttatgactttttctctcatattctcatccatctgtggcaaacaatccttcagtaaaaacacactgaaacatttcatttaaatatgtgaatccagttttatattttattccaatctgaagtgctttgtctcagggtgtttgggtgcagatgtttggttgaatttttcaaggataatgctaatttgttggt

SEQ ID NO: 87068 - DNA, 1034 bp, Homo sapiens
ggctggttgtccaaataacatccattaacaattcacgccttctccaatggttttaaatgcccctttatcacatacggtatattctaattcagggttgtcttctagaggctattctcgaggctattctcgtcccttgacctatttgtgcctaacttggcatcatactattttcattactctaaagatgtgtttttatgctttctagggtatattagcaaagagatgacatacttcatttgggtaatttgaagaaagcttaatcaaaatactgtttatttagtaagatgttataaagttcagggaaactacaagggcttgatcgctaccctggattattaactaatatccctagaattacatagacaagaagagggcacttttgccagaacctagaggaaagaataatgtgggggagggcagacttgaaagcaggggtgcctttggtggaaggagtggaaagaataaatatccagacctcattctccttccttcctcctgtttcctgccagccagcatgcctgttggctgaacacagaagcaagaagacaggggatctggcgatgtgatccctacaagccaggccccagggcacagagttaaggcagaaagtatggacagtggatctggagggccaaggaaagttctccagcagaaaggaagagcctccactcaaaaatttcttggctgctcttgcacatatacttcaccagtgaccacagtcttatagtatcagtttattataaaaccatcctgaggccagatgcgatggagcacgcctgtaatctcagcactttgggaggccaaggtgggcagatcacctgaggtcaggagttcgagaccagcctggccaacatggtgaaaccccgtctctactaaaaatacaaatatcagctgggcgtggtggcacgctcctatagtcgcagtcactcaggaggttgaggcatgagaatcgcttgaacccgggaggcaaagttgcagtgagctgagatggcaccactgcactccagcctgggtgacagatcgagactccctct

SEQ ID NO: 87069 - DNA, 1459 bp, Homo sapiens
gaaaggactgtcagcatctttgagtccatctccctttctttgcagttgaggctgcatatgcagaaagaataattgcccacaccatgacaagtggtggagctggaaggagaacttctttctcatgagcttatgttctatccattagaccaactagtttctcattttgaacccaggactgattttctagtatacctggctaacctattgtgttttcatgtgggtacgtgaggcaatttcaaggcagcaaccaagtcctgtactatttgcagacactgttttgttggaaagaagagttggaaggactttaatatgttaatgcttttcttaaggattatgctgacaatttgtcatttgactgaagcctgtataaggaaagagactatatgagcaagttaagttgaaaaatgtttagttttagagtaggtggggagagtatttactttgagcagatagagaaattggggtttcttgcgctttggggaatactgggatgaagaaaatatgttatgggctgataatagggatattgccatacagatagtatttccagagacattttaaagcaaacacatttcttcgtgttttggctctttcaagagagatattcaagcatttttgtgtttctttttattgagttgccctctcttggtcaatgtgggatgactgtagttggaattgaaagtgcagagggatctccttccttaattcctgagtgctctatggaggagtaagagccatctggatatcagaagaggaagctcttaatgagctcctttttgttttgctccaaagacttttgaattgattgttaaattcactttaacttagaagcttgcctttgcttttatatggtataaaaggaggcaattccggggtctccgtgatggacatatgcaccagcagctgttgttctgtattttgacttgctcccctggctccccacatccacagccctgcaagtgcctgctatggggaactctgacctatcccttttgtccatggtgcttgatcttggcttggcttccaggtggcttggccctcctctgagacagacatcaattgcaaagatgagagtgggctggcttttgaagacgtttttcacattctggtttgcagacctgttgagatgtgctactcctttcatgtttccattccatctgtctcttgaaagggcaaagggagtgtcttcatgtgactgagggctgttgatgttggcttcaaattcatttcaaattaatttctacatttttgtcataggtatcagccattgcattcccttgatcttgacattgttctagcaaggctgccagtgagcaacaagaagaccaatttctgtacactctttaaagcaagaacaaaggaaaagttctcattcattacgggggttatattaaatgccattcttaattctttgtagaagattggatcctggataatagcatattacaggattgtattc

SEQ ID NO: 87070 - DNA, 1049 bp, Homo sapiens
tcattacacacatctcatttgatttttatgtcaacccttgaggtagatgtggcaaggggtataattttcatttatcaatgagaaaactgagatttaaaaaacatgtgtttttttttttttttccccaacatggcacagctaataagcactacatttagaattcccatacaacacttctgggttttagtccagtattattttcaatgtaccatattattcttatgacacctattttgatttttaaaggaaaatataatcagtttatgactcactgccttccaataggaaggataagctgtttatagttaagtactttggtagtgccccacaggctacttaacgtggaggtgactgtaggtatgcgcagattggtgagtcagatgtctttatagaatgttccaagtgtggaagaagaaatctctctcctttctttgacagaaactctataaaacaggtcgggagatgcaggagaggatcatggacctgcttgtggtggtggagaacgaagatgtaactgttgagctaattcaggtgaatgaggatttgaataatgctatccttggatatgagaggtgagcagatcatgtaccctctttacccctcttccatttctactttcaccaccaattactcagcattcttatcagagtgcctacaagtgacccctctttctagattctccattctcaataggaaaggtattggcatgtggggtgggacagttttcccttgtacagctcctactcagtaaatgctagaggtctttctcctagttaaagtgacatttcagcccagcatggtggctcccagctataatctcagcacttttggaggccgaggcaggaggatcacttgagcccaggaattccagaccagccctgacaacatagtaagaccctgtctctacaaaaaataaaaaataaggccggacacggtggctcacacctgtatccccagccctttgggaggccaaggtgggcagatcatttgaggtcaggagttcgaaaccagcctaaccaacatagtgaaaccccatctctactaaaaat

SEQ ID NO: 87071 - DNA, 1674 bp, Homo sapiens
aagaactcatggtcattaattcccatgttctgctcagtattgtgttgatgcgcagcccctgttagcaagatggtaaggatcaaaatttttttggagtttgtatttgctatctccacttcctttccttgtattctctttgacttcagacatgctcttctaccactctatggacataactcttgtcaaggtcactggtgacttctgtattgtgaaatttagaactgcagttccatagtccctcattttatcagcaacaaatgacaaagttgatcacttcctccttcttgcacacatggctttcagacaccagtcactttggttcttctcctgcctcacgttcatttcttctccatctcttttggtggctcttcctcctctactgaccttttcttgttggagaccccagggatcaggcttcagacttttctatctacattcattcctctgtggtcttttggtctcatatcttgaaataaccattcaatttttgacaacctacaagtttgtatctcttgtagcccagaccccttctctaaactcagaactcatatatctactttccacttaatgtctcctcttgatttcttcccagtctccactctcaacctgcccttcctgcagacttgccacctcagtcaatggccactctgctctttgctgcataggtcaaaaaccttgggtaatagcgcttgacatccacctttttacttttacttttgccttttacttttaaaatatgtcaattattcagccacttctcaccacctccacttctgcatcttagtccaagtcaccatcggatggacattgcagtggcctctaagggaagccctgtttcaacctttgcctcccttcgcatccctcccacccacctcataatctgttctcaaaacaaaaacaggggcattcttttttaaaaagtgaagtcatattatgtcactcatttgctcaaaacccacctgtgattttcttcctcactccattttactcagtaaatgcctgaaatgccgatctgaccgcacccgtcacctctccaggctcacctcctgcccctctctaccttggctcactctattccaaccacactggcctcccccacttcagagactgtgaacttgtgtcctctccagtaaccacaagactcactttagtcaggctctgcttaaacgtccccagtgatgagacatttcctgaccacgacctattagagcagtattccaccccagtctctctcccacccactactctgcttttatattagagcacatgccattggatatctgttcacatttgttgattgtctgagtcatgagggcaggaacttggtctgctttgtttattgctttattaatagtgcctggcagctggtaggtggccaggatatatttgtggagtgaataaggaaaattatgagaagagatatttctaattaagattctaatattttatcaatcctgattttgttgtgtcactgagtgcctctctgtagatttaaattttttttttcctactcaaggctgagattttatattcagagtgaaacaacagagaatctggcctgagccattgaatctgcttcatttttaaaagcaatatatggtttttttttcacagtttctatgggaaatagggtgcattaggcataaaatcagacaaaaatatagtaaattcttg

SEQ ID NO: 87072 - DNA, 1023 bp, Homo sapiens
ccccagagaccaaggcaggaggatcacgagcctaggggtttgaagctgcagtgagttatgatcatatgatcatgctatatattctagcctaggtgactgaatgagaccctgtctcaaaaacaagaatttactatatttttgtctgattttatgcctaatgcaccctatttcccatagaaactgtgaaaaaaaaaccatatattgcttttaaaaatgaagcagattcaatggctcaggccagattctctgttgtttcactctgaatataaaatctcagccttgagtaggaaaaaaaaaatttaaatctacagagaggcactcagtgacacaacaaaatcaggattgataaaatattagaatcttaattagaaatatctcttctcataattttccttattcactccacaaatatatcctggccacctaccagctgccaggcactattaataaagcaataaacaaagcagaccaagttcctgccctcatgactcagacaatcaacaaatgtgaacagatatccaatggcatgtgctctaatataaaagcagagtagtgggtgggagagagactggggtggaatactgctctaataggtcgtggtcaggaaatgtctcatcactggggacgtttaagcagagcctgactaaagtgagtcttgtggttactggagaggacacaagttcacagtctctgaagtgggggaggccagtgtggttggaatagagtgagccaaggtagagaggggcaggaggtgagcctggagaggtgacgggtgcggtcagatcggcatttcaggcatttactgagtaaaatggagtgaggaagaaaatcacaggtgggttttgagcaaatgagtgacataatatgacttcactttttaaaaaagaatgcccctgtttttgttttgagaacagattatgaggtgggtgggagggatgcgaagggaggcaaaggttgaaacagggcttcccttagaggccactgcaatgtccatccgatggtgacttggactaagatgcagaa

SEQ ID NO: 87073 - DNA, 1045 bp, Homo sapiens
tccagttcaaagttcttggaacaatgtacttgcaagtgtaggagtctcagtaataaaagaaaagcttaatgtagaacgtttatatgaacatgtgttatgctttcttcagtttctggaacattcaaattcagtgtttctacagccagttagtctacaaaccattgcagcagcaccatcaaaccagagtctgccacctttgcccagcaatcatccaggtacatgggaccttattattcgcatcaaataaggaaacttatgagaatatatgagtctgccagagattcattggtaactgaaaataggagaaattagagatgctcttttgtatttttaagctaatgaaacaaattcagggcagataccattatgactgacttataagagactgtaaaaatgcttgtgttaaactgagtattgtgttttgaatgctaaggtaaatgaatctttagttgaggtttggaaacctttttgatacatacagatttgttgaacttgggagtagcattgggacaccagtctgttttggttgtgtttattaggatctaatatttgaagtctaaattataaaaagaatatcaattgcgtgtactcctcaaaaagcacaatatgtttactggtctctttttttgcccaaagcgatgacaaaaagtgatctccagccacctaattactacgaggtaatggagtttgatcccttagctcctgctgtcactacagagtaagtcatttacaaaatgattaatttattttttgtcttggttccctttgatagcagagctaacagggcttggttatacatttaactttgtttaggtcttggcagaaattgatggccttattaaaaatgccttatgaggttttatggcagctgttactcttaatggtcttatcgttccggccttgtgactaaaaaataaaaatgctggggttgcatgttaagaaataactggaactaacctgcttaatggactcctcatagatcccttggcagaaagtcatgttctctttagcttgagaagggtactagtcactgattggtgacata

SEQ ID NO: 87074 - DNA, 1040 bp, Homo sapiens
aattctgttacattaggtgtaaagcactattaaaaagtagtctatgggaataaaaaaatttatagtaatggaacccgtcagtattttgaaattaagtttagatgagtgaaacagttgggagtagcagtaaccgtcaggctatatagcttcctgacttttcctcaggcatagaagacatgggaaaaatgtggaaaagcattggttacaatgagtagtttactggtttatatcaaaagtatccctgtccttctaaaagaaaacaaattgagggcctttgaaataatcaataagtagtaaatagttatgttatactccagtgagactgagactatacctaaacgctttcctaaaattttaaccaactgtaagaaagattttaactgaaatctcattaattgaggattagccagagtgagttaatttcaacccatattggaaaagccttataaatattagtgcttgcccagtttagtaaacatgactgaatctcttaataaagattttataggttatgattatgaatcttctccaattacgtggtagtatacaaaggtattagtggctgaattggtacaagtgacagaatatcctttggaaaatttttttaagcctcgctattcccttattttctccaaagtattaacactttgtggcataataaaggttctagtcagtcagttttattctgattttaaggtaagtttaatgttggtatctttttaaaaaaaatagtcaatcatgacattcaggtataagtgttacagaaaagttgggctagggctgtgatatgattggcttggacacattttaaataatgtaatttgccgattattccttgaagacctcaaatatacaagaggacagttcataactaattatggatattagaacattggttcttcattgacatatgcaagtaagtttttaaactcagatatgtttatgggtaatattcacaatttattttgctgaaccctacattagattaggtattatggtctgatgaataggcaaaataatgagactaatttagcagggaa

SEQ ID NO: 87075 - DNA, 1027 bp, Homo sapiens
gaaacgcattttcctaaatgttaagagacgttctggcgagaagcgaagtgggagtaacagtcacaaagcaaaacgcaaacttacccgtaatctggcaacccggcctccgtagcccgactgcaagcgctgccacctgaggagcctggtagccaaggcagcggcaggctcaacccagatctcgcgagacggagcacgcctcgcgagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccaggtaggggccggcgccgcccgcagggtggcgcagacgcgagaggtgggggtgcaagacaaatcccgggacaagccctcgctctgcgggtcgtaggtggaagaggtttccgatattatctacctaagaggagagaggttcaaaacagtcacttaacacccaaagtcaccaaagaaattggtgacaaaactgcaagtagcatccagttcttagtgattgtgcttataccatgctgcagagtgaaacccctgatctatgaactgcacctcgccaaaaaaaaaaaaaaaggtccgcagcctctaaccgggtatctagcagtctgccttaccctcctgcgcacacacgcttttaaaatgtattattcatacattcactctgcaaaccacatgtggtttatgtgccaagggtaac

SEQ ID NO: 87076 - DNA, 1047 bp, Homo sapiens
actttttgtcttcttgtcactattaagtaatttttttcttgtataatagatgtaacattgtattatttataaagcatctgtattgctgaaaaaaaattgaccttttggtttttaagtgatgaaaaaaagatatttttcatcccatctccacttgaaaatcatcccaaaataataatgaaaacaagaaacagaaaaacacatacaagtaaaatcacaatatctaaggacagaaaaatgggtgaggaaagtaaatttgtgagcagaggcaggtaaagcccaagtgtgtgaagatagaggaaaatcacaatgaggaacaagttgatttgaccctaaaatgatttaagaattgaagacatcaagtacttctggagactgagtttttaggcaggatattaaaacaggattgttggaaatctttataaggagaattatgcatgctcttctctgctctttctcaagtagtccggcatctcccaccgtacacctccaggagaaaagaagtatattcctttgagaaattaaaccagagatcgtggacctatagttgccagctgcaagggagtttgtggagtatatagtgagtcatcactcgtaatatgcacccagattgctcagggaactttgctgccatgtttattactataggcagaagactatggtattctctctgaagaagctgaacagaaatgtcagctggccaccagattgccctgtagtgaaagctgccagttgacaaagcaagttacacacacaaaatttccaaccaacttttttagtgcccgattcttaaatatgaactcatagtcaagagtcaccagagatttggagaaatcctccaacataaaatatagaacccaaaactatcagacaaacagaaaaaaggaactcagaaaaaaagaaataaagaagcacagaagagaatttcaggtaggaggtcaggtgcagtgactcacacctgtaatcccagcactttaggaggccaaggtgggtgcgtcacctgaggtgaggagttcaagaccagcctggccaatatggtgaaaccccgtc

SEQ ID NO: 87077 - DNA, 1067 bp, Homo sapiens
cagaaagtcttcaacattttttgttctaatgacaccctttctgagttgctaatagtcttattaacttatatatttctttatttttgtttctgttttcagatatacttttaaataaatgatatggtcagtcaggttctttgaatgctgctagaaaccctaaattcaagcaggagaatagatatgttacatatttttaataactttttcttttagttcaagtttaaaaacaaaaattgcacttttatttcatggttatatttagagctctactgttttcaagtgatatgctttactgacaggaagtttgaatagtgtttattattaattacatgatttcaaattccagaaacacagagtatataaatatataattaatttattgaacaaataagtctgaccactcatttaaaaaatgatgcatgtcactttttttaatgtttcaaatcactttgttctcttttgtaagcaatctcttttactgctaagcatgttgcccattgcaatcacccacagatctggttgttctgtaaccctcaggagagtgcccagttctcccagaatgaagcactgatttatcagaactaattttgtcgcatttattcaaagagaactaaagctgtattcaaggcgcacagttttcattctgctgattcaggtgttgtgtattaatctacctaatgttgatgtcagggagcattgttttttactgccaaacagttctcagagctgccatgctcatttttgatgaggaaggcaaagatggttgggtagtttacaacaagccaatgaaataggcaattcagagtattttgtatgagcaagcaaatcttttttagcagctgcagatggatggtcatgctccaggttagcaatttatttcctccttaccaatataattttagggcagataagaatgtgtttatagtttggaagttgttgggattaaaaaaaaaatatgttcaacctgtgagactttgacagcaaaagcaaagcgctaatggcaattgtgcaagagtcactaattccagacatgtcaataattctgacatgtcaatgatttccaattt

SEQ ID NO: 87078 - DNA, 1085 bp, Homo sapiens
caatggggctatgtcctgatacacccaatccaagtttaaaatatcaagtagaaaatgtgtttaataccccagtaagcctattataaagtcaaaaaaaacattaagtcaaaccatcataagtcagggactatctgtatatgtatattttccctagctctgtcaacttaaagggctaagaaacagacaccctaataacagtgagcacattactatatctaagtgtccagataccactccccactagaagaaagccaggctactcagagaaatgacaaatttcagaaatgaggaagggtaagtaaaatataagcctggaatatcttaatatgccagaaaataaggacgtgctcaaaatgacaggggcatatcacaggaactagcttgaaggggcttccactggccaaatatggaagaacttgagtaccaaaataatttagtacagtaatgtattgcagactatagaagaaatcgtaattcacggtatcattcgtaaattgattaattaattaatagggagaaaggagtacttttgcctatagtaggatgttgaatactgactggtaattgcagagaagctgctagatttggaaatcagtattttatatctattttaataaagacttgatcaggcacaaatcattcaatgctaaatttagggaaaaattttgatgaagagcagaatatttacatggttttaaagtatctctctacaaactgcttattaattgcaagggggtaaaatagcagttatacagtggagaaatcagaaaacaccttgactaaatgttgctaaatgtgctaaatgttgatatcaccaatgaagaacatttgggcattgtgtgactccaaatatgatgcccaaaaaatgactacaacatcacctgtgtaattttctgggcgagaatgtgtaacctgaatctaaccatgaagagatgtcaggcaagctcaaaatgagagaaagttttgtttaaaaaaaaaaaaaaaaaaagacgtgtatgacgtgtgtgtgtgtgtgtgtgtgtgtgtgtgtgtgtgggttgtattctttagaaatgtcaatgctattttcttaaaaaaaaaaaagg

SEQ ID NO: 87079 - DNA, 1063 bp, Homo sapiens
tcatcccagctactcggaaggctgaggcacaagaatcactttaacttgggaggtggaggctgcagtgagctgagactacactgcactccagcctgggtaatagagtgatatttcatctcaaaaacaaaacaaaaacaaaaacacagtgaattggcctaaggataagtgcagtagataatggggtttggagttatacctttggtttataccctgaccctgctccttgctagcttttgacctttgtcaaactacttcacctttatgggtctcagcttcctcatctgcaaaatgggtttgataatgggatccttcacaataacattagaggtattaagataatacacatagatgataatgtgtatagcacataccactcaacaaatattacaaataatagaagaaaaaatattaagaggtggaaatgatttgtattaactatttaataaagaggaggaaaatgtaattttaactgagggcataaggggacttttcatagataaggtggcacgtgagctgacccagacacagaaaggcagagcatttcaggctgagaaaacagcatgaaaatcatggcataaaaggggaaatttgcttgtgtttgtggtcaaaataaaccttttctatgctaactttaagttatttgttaatatatttctgtcttcatgtctgaaaaagtgttaatagtacctaccttacaattttttcataggacttgagaatttaagagcctaaacctgtcaggaatctaattttgaatactagttttgacatgtattcttttatcaacatcactatcaaaggcccaggaacataagggaaacacggaaagatgaagctgttaggaaatgacatttgggtgggtgtgttggggcctacacatataagcagttgaataccagcctaagatcttagaggactgccatttaaaatatttgacaaggagagaaaaatgaacaactgtctccacgtataatctgaccccactctttctttcatactccataaccaacttgttgggcctactttttagaaatcacagaattttgccacttttcaccacttc

SEQ ID NO: 87080 - DNA, 1032 bp, Homo sapiens
attgtgtggatatactacgtgtaattatccattctgcatttgatggacagtccaattgtttctgttctcttctgttataaatggtgctaaaaacattttagtgcatgtatcctgctccacatgtgtaatagttacctgctaggagtagaattgctaagttgaataattgtaagtttggctttactaggtaatgcctacttgtgcttgaaagtgtttgaactaatttgtactcccaccagtaatgaataagaattattgtttaccccgcatacttgctgaccctttgttttattttaattttattaatctggtagttgtaataagtgttacatcattacagtttaatttgaatttccctggttactaatggctttgagacagtgatgtgctgggaccaactgacactagctcatgagagctgattgcatgcatctcttctcaactcaatgtacagtgatatcaggttggtagcttgaaatcagctataatggggttatttctacccataaatgttataaaccaaggtttcctcctccctggtagccagttgagcatatatttatctctttattaggcatttgtgtttctctgtgaaatgcttcttcatatcttttgaccctttttcagtggattagttgtctttttcatgtagatgtatagtgattcttctggttactaatcctttgttaaattacatgttataaaaatcttcttccaaatttctggcttgccttttcactctatggtaaaatggacacaaatccagtcatccctcctgacttaatttccatttttgtcagtattttagttctttctttacttttaagaccacaaattagacattgattatttgttttgtgtggtcagcatttgcttaatagactccatttttaccattttctgttaagcattcttacatctcagaccttctcacttggtttctttcttcatgagtacatattttagaaattcatgtagtgaggatctgatgataataagctctccccattttatttgtctgaagaacatctt

SEQ ID NO: 87081 - DNA, 1091 bp, Homo sapiens
ctattgcccaagctggagtgcagtggcgcaatctcggctcactgcaacctctgcctcctgggttcaagcgattctcgtgcctcagcttcccaagtagctgggattacaggtgtactccaccatgcccagctaagttttgtattcttagtagagatgggttttgccacattggcccggctggtcttgaacacacacaagtgatctgcccccctcggcctcccaaagtgctgggataataggcatgagtcaccgcacccagccaaaactgtgtttctttaatgaaagtcagctatactattaatatttagaatggacattatggtattttcctctacacaaagtaattatgctatttcttctcctagaattggggtgatgttccaagcattagataatagcttattatatgattctgtgtcacttgagagaaattttacctgtttttgtaaaacagccctgttctctggtgacttgattattcaaagccagataataaccacaacaaatatttgtggcattttgccattcaaggaaatggcgaactcacatattctcctgtgttgtttcaaactgaaagtaggtcactgttgtaaggttccattaagaaaatatatcaaatttaatcttgggagttttaagttggcaaattattgccagcaacaagagaaataattcttttcctagtacaattttatttccagaaaaaatgagttaaagagaaaaacatatcgcttaagaaaaggtaatgatttacattcattatttccttccttccagaactatttgttgagtgtctacaatgggccagaccctaggataacaacacaaacaaggcccttgctatcaagctgcttaggtaaattgtagtgggcagagatggacaagcaagttcacaaataaatagaaaacgtaattgtagacagtgatgagtgttatgcacataataaaaccagattatgtattaggaaagatgagtaagtggagatgctacattagattaattgacaaataagtcttctttgaagaggtaacattgcatcccagactcagccaggaacaaaaactatgggaaggacctttcaggcccagta

SEQ ID NO: 87082 - DNA, 1039 bp, Homo sapiens
tgtaagttgttattcaaaaatggatctctctttattgataaggtgccgataaggttctgtgaagtgtattgacgtactttggcttggagagttattaaaacgtaaaatgctattgttttattgcttgagtaaatggcgaattgacattaactgaaggaaacagaccactgtaggtttttctaagtatcttgcagtaaatcaacctccaaagacttccttaggaagcacgttgactttaaaaaatataagtgcaacacatgatcatagttctaaaaccacctagctctttttttaatccaaagataggaaaaatatatcagtatagaatatggctttctgtagatttagagaaaaagctcacctgtttctaatctaatcagtcttatagttctttgtatgttttcatttgttcagggttgactaagagtatggttgcatttgtgtaacaacttgccttagctcatcttaagttttcttctaaagagtgtgtaattatttaatgcttcccaaatagaagtgcagattttgttcatatattttctgaatttttaactataccctcttttttattctttggagtaaacctttgtttgttttctctttaataaaatgcagtgatacaattactgcaaaaagtttacttgcatattttaatctgtaacccaatcacagtttaaagtaataattcctcagcgaaactcttccagtaatgaatctgaaacttaaattttaaggcaaatgcaaaggaatgcagacctgaataataggaacatttgttatgatacagcaatgtcatcctccagcatctagggttatttttcaaatgtacaattcaggattcaaagctgaactaaatttgactaatcagacatgatttatgttctaggtttaaccatggttggaaatgacagagtaagactttaccttccaattcttttctgaattgttgaggaggttgtagtttggtttaagacttggtaacccagtataggtgtaaagacaaactctagggagcggtgccttatttgattgcttccat

SEQ ID NO: 87083 - DNA, 1048 bp, Homo sapiens
aatcagaagtcctatttttgtataaggtaggctatttgtgtttttagtttgtaattggacagtgattgttttctattagtgaactatcactgagagattaattactatcattttagtctctaggtctgtcttttatataatagattatatgaaatctgcatgaactgtaagaaactattcagtctcctaaaaagaaacacttattttctcagaacagagaacatcttctaaaataagttatacatgttatttaatatgcagggatatctttatggctgcagtcactgaataaccattgtgacttaaatgcctgtgaattagtacctttataagtctgttataaagttataattcttttttaataattgtaaggaaataatcaaggcagaaattctattctgatggcacaggggatgtggtaatccaatgttagtgtcaattttcacatgatcctgtagattaaaagatactgtcttgaaagtgtccactttatttttattagaacgtatctgtgacttaagaaattagaaggacagacacagttgtactgatcagacaaattatttagcgggcaaaaattgtagtcacattagaataacttcctacttaacttttagctgcctttgtcttattgattggaaatcctgttatttctgagcatttttgtcatgaaagcaaggttcttaggtacagtcatcattttcttccctccaggtgaggggcttgtcagtgatgaatgaagtaatctataaaagaagatgcagaaagtgtgaagacagaaaataaatctacttgaactggtgcagcagagcagtttatcatggcgcatctggctgagcatgtgcttgcagtgaacactagaggagacatatagtgacagtcactaaggggcttttagggaagccagtcatttgcttaagccaggctctaggaagtgcttattttctacttataagaggaacatttgttcattaagagagaatagaaacttcaaggtggcctgtgttaatatacaaaggaaatagttacagaatttttgctcaaggtg

SEQ ID NO: 87084 - DNA, 1022 bp, Homo sapiens
ctgaatttcatatggtgtataatacagatttatatggtaaagatatacatatacattgtgctcaactatacattcctgaatccatttaggatttgtgatttatgtcttgagtaataatataaagtcaactccagactgataggtagtcattagccatgagaaatgtttcaggatggctagggaagacttgtgttttgcctgacagccatttgaatgttaggaagcttcggggagacaagttttgagagaagccccagagggagctatttccttgcaccccccagaggtgaatgaggtattctataagttagtgtctataattgtgaaagtacaaacttcttgtttttgtcaaattaatggtatgaaatttctctccccctgcttgaagagttttctaattcgtttctagtgagcaaaacaaagaaggtgcttgagtcactgaaatcaaagtactcaggcacacagcccactgacaagagacacctcatccattaactgctgttttgtaccacttgccgccctgtttctgtcaaatacctagtgaaaaaggcctaaacaattgtaatgatattatttattgggcattttgtgccatacatggtgatgagcagtttgcatatatttatttatgatcttcttaaaaccattccatgaaataggaactgtaattatccccaattctaaaagaaaaaacttagttttagagagttagtaatctttgcctaagggtcacaaagcacctatgtgtagaagctagggttcaaggcagatctgtgattccagaagctgttctctaaaccactatggagaactgcttagattcattgtctatgggtacattttataaaaaggcagattctagttcagtgtcataaggaactttctagtaattagagctgataagaaaagaattccccaggagaaaatggaaacactatcccagcaatctgaattccttacttggggaatgttgctgaggaggttcagtgtgtgaatggactgaaccagttggccactctctc

SEQ ID NO: 87085 - DNA, 1065 bp, Homo sapiens
aagcatgaaagttctaagcaatggttaataagaaatggttctattttggcattagcagacatggcataattttggaaagaattttcatcctaagatgtcattattgtgtctggttaattttgttttaagctgtatttgacttccaaggtaaatctatttccctttataaataaggtgtcccttcaacactgcagagaaaacctacttagaattaatctagcggtgagatattcaagtgatcgttacttaagatacatataaatggtgtcagggaactaccagtttccttcacaaaatcccaccctggtcatccaaggttggcaatatggaggaaggtcctatctctggctgttattcctcgcagcctacagggaaatggcagcagcaaattatcaaaaattttctaaaaggaaggtaacccttcgagggcaatgaggttcagatgcccttctcaaatgattttctttctcttctcaaccttgaaagatgtggggtttaattttattagacttttgtgggtttccatgcagataggagcaggtttgtttccttcatgggtttaaaatcactccaacattttactgcttctccttgtttctgttcagcatcaagacataaaagtgcatttcaaaaaatacccagagaggaaacaactggcctagaagtcacatgccaagaaacaggatcagaaatcagaaatccttcatgcactagcttctgggatcatcctggggtcacccttttaatctgtctgtggatcccactctccatttgcccaaagactgattaccagttccaatttaccttcaggtcatcagggatgaagactttgcgagctttcttgatcatgggctgtggcttcagttcttcctcagagaacttgcgtttgcgagggtcaaacatttcctggccagggatgctggaaagggcaagatctgctgggtctggctcataacccactgggacctggatggtgtcaggatcaatgggacttggtgtattgcggtttgctggcaacagctgacctggaacaacacaggagttttaattcatgaacaccctaga

SEQ ID NO: 87086 - DNA, 1050 bp, Homo sapiens
aacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaa

SEQ ID NO: 87087 - DNA, 1048 bp, Homo sapiens
atctcagatatgtttttatcagcagcgtgaaaatggactaattcagtcccttaattgggattcacctgattttttttttatatgattagactggtagcatgagtttttgagagcgagaccacaaagacgcaatgttattctcatcacatgttactaagggacatgacttatcacggttgatgttgaccttgatcagctggctgaggtggtgtttgtcaggttgctccactataaatgtacctttttctccctctctccccactggactcttaggaaggaaatcactatgtgcggcctgcacttgagtagtggggaattatgctctacctcctggagcatggaatgtctacataaattatatggaattctgctgcagggatatttggctattctcccccattacttatttattttgtcatttatttgtatcagcatagactcttggatatgtattttatacttcggggtataatccaatactactttatttatgttgctcaaattgctctaactttggccatgagaagctctttccattggctgattgcacttttaacccaaacaaatgttctgatgtctttttacctaactgcatgaactagagtcaggaaaactgcgagttgtttgtcacgccatctctaccacaaatttttgtgtcactttggtaaaagctcaacttgtctttccttttcttcacctgtacagtgaacttaacaccatctgcttccctttgcctctgctgtggctgtgaaactatagtgagatgacaagtaggacaggactctggaaaattaaaaacaaaaaccaaaaaacatgccaacccaaagcctcacttaaaatctccacttctttttctcacttgcatctatagagcttcacaattcaagcacacaataaatattttcatattttctgagtaaatgaataagtgaatgagcgaaaatgcatacaggcttctgagctgcaacaacagataagcaagggggaagaaaggccacaggccaggtatgctggagcatactggctcgaactcagctcatttcagagt

SEQ ID NO: 87088 - DNA, 1363 bp, Homo sapiens
agtccttgttctgtacctggggagataagctcgatatttgtccatgtgagacttaacagaccttagttttaggagctaaattcagcttacagacctaaagttacaactgacatgtacttgttttataggaggatatacatcttgaaaggttaaggggtcatcccttgtgagggcagtcatccagaggggtgcaggaggccttttgcctttgtgggggtctggttaatgtataatgctttgacacaaggttgggaagtaatcgctgtctgtttgggaaaaggatggtaacgttacctgactcaggcttaactcttcctttggcataatgagtttgggaatcctgagacttttattttgctttacatcaccaactttcaagataaaatgaaccaggtattcccaagcagccctgaagtcatcctggctgacctccctccccaacatcacccactcccctcgtgcccccctccccccagctgtcctctgcccctttgaaagaaagcatttttgtggccgagcacggtggctcacgcctgtaatcctagcactttgggaggccgaggagggcggatcacgaggtcaggagatcgagaccatcctggctaacacgatgaaaccccatctctactaaaaatacacaaaaattagccaggcgtggtggtaggtgcctgtagtcccagctacccgggaggctgaggcaggagaatggtgtgaacctgggaggtggagcttgcagtgagccgagatcgcgccactgcactccagcctgggcgacagagcgagactcagtctcaaaaaaaaaaaaaaaagaaaaagaaagaaagcatctttgtgcagtgtcttatctctcttctacccattgatttaagtatgttcctgtgaatgtgttcgtggtagaaatagcagcctacatctggcccaagtctatctttattttcacttatcggcattaggagctcgagccagtgagaaataaaaggctcttcacagatccgttttggggaatgtgacctggcaatcagtggagaggaaagagacaagcagttgacttggccatgctgagccttgatttcctcatcttgaaagggaggattatgctgtcagcctcaaagggctgcagtgagatgatttacataaagtatctagcacaggacctgaccatcaatatgtgctgaattccattcccagctatgcaccttcatcagaggtgctctgatgaatgttgaatagcccttggttatgaagggaaagaggtacaggtagattgctctcatatttatctcctttcatttcatattagggaaaaatggccctccttctatcaaaggctcttcttcaagcccatcagctatttggaccttat

SEQ ID NO: 87089 - DNA, 1032 bp, Homo sapiens
ccagcattatcttcccaaaataaaatctgagcatgtgtctcgatgctccaaaacttccactgactattatcctataagattcacgccagatgctttagcatggactcttcacatgctgactccgcctgatcggccctctccccagctgaaccccacttgacatcagccctgctagtgattttcacagcctcccccacaacacacatgccctcatggtgcttttgcagctgtgtttttgtacctgctgttccttggcctggaatgcccttactccagcccctttcctacctggcaaatagttgcttattccaagccttcatcaggtgccacccatctcccttgtgccattgaccaagttccccctggcatgagtagtagtgccctcctttgaccccatggcacagatattccttcatggcccctgtcatggtgcattgtgattgtgtttactgtctttacctctggtcttgggactgacctccttcaggcagggacagagtctcatccacttctgttcctagcttctagcatagcactggcttatgacaagagtgaagaagttttgttgaatgaaaggggcagggtcgggggaaggttggagaatgttgctgtggaagggaaagactgagaataaagcattttttaggacagactttggttttagcaggtttatcctgtccatcacaagcactcttactagctggaaactgacttttagcttcttaggccttagaggcttttttgaccacaagggtcagctagaacattcgtggcaaccacaggaaagttgatgagaaaatagagtgtaaatattagaaaatatgtcctaaagaagaaaatgtccagcatttttattggtgctttcctagaaataacaatttacaaaattattttgagagaaaaaagtatttggcctaacgtatttccctctggtcctcttttctgaatatagtaataaaataaaacaattgtgcaatcattgggtcttagtgcagattatactccagaagcaacaacttaaatttttaaaaa

SEQ ID NO: 87090 - DNA, 1055 bp, Homo sapiens
tgcccaatggttaagtcattgtcacttagctttatattgtcagtttgatatttattttaaattgtggaactagatgcataaattcacatttctgcctttcctttgcatcttctcatatattgtgtttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtcaaaaccactaatatgtatgtaaaaattgtgctgtatactacaataaagttgttacttggatttgttccactgtctctaaattagatgactgtgaagaaaaatgaatacaccctgtcacttagaactttctagtctactttttaataattgaaatgccagagtcagctcaaacattaatcaacagacattttcagtttaaaatacactagtcaggacctaatgatttcaagttttttagatgatgcatccttaccaaggtaagccttttggtttagcatatttaatattctataggactgaggtgacagtcttttatgttaccaaccagacaagtagcagattataa

SEQ ID NO: 87091 - DNA, 1045 bp, Homo sapiens
aagaatgcatgttatgcccagcaagattggcggagtctgagttgctgtaagttctgggattaatggtacgaaatattgtttgtaatgtattctcctcttgaatgagaccatctttggattaggattcaggcatttctgtgtattcagaggaaggagaagcaatagacaaagcagaaaagcttgtaaaacttttgtagaccgccagggtatattaaacactgtaagtgcttcctgctttttctgtcttcccttcatatgcatctgcttcatcttattttttgcctaaatgcaaagagaatgcaaccaattcaaaaaaagagtaaagttgcttttcacatggatctgtgcctcctagaaaggaggtgcctccccagcttttcatttctgcttacagggtgtacattctgatacatgtagctgacatctcctgttatcttcacagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggt

SEQ ID NO: 87092 - DNA, 1017 bp, Homo sapiens
tgcgccggggtcgacctccccgcagggagtgcggggcggcagtcgcggaagggacaggggcgcgtcttctccggctcaggaaggagctccgcccggaccctgtctcaagctctggagctagcgcaggggcggtgcctccaagtgactgccgtgcagatccaggggagttggaaggtcacaggagttcagcctcaggtcaggcccgacggggcatgtagttagaagttaatgacagttgaaacgtgggtcagctggttcctaggcccgtgcacacgtctgcaagggacgttgatcctcactctccaatgcgtgtcagtggcatatgggggctggggtgggggaggggcggtatcttagggcttggatataggaggaaaagaaacagaacttttcaaggactggatgtgcagggtggtgtcaggggttgccgagaagggccctactgttttagtgactcgtttcttttggttgttgccccttccttccaagttgctcttaataagttgagtccgaatcttcaggcaggagtaaagatgtaggaggaatgggattggttgttgaagtctttggaatcaggtagccatccaggtggaaggcattgcccctgaggcctgtcatccaaggcttgtcatcagttgctttgtgtaatagtcgcagcatggcaagtaggttaaaagtcgcctgcaggtaatgtgggtgaaactgaagtttcctaatacaggaccaggatattatagtgttagagttaggaggatacctcatgctcacctggttaaaccccaggtttcataggtgaaagcaacaggcctcaagggtgaagtcactcctgaaatggcccagataagtgaatagcagaggtgggattggagggttcatgatcttgtgaatgtcaaacatgtggttgcctttttaggcacttgcatttttgtttacatcaaatatagtgtttttatattttaaaacagaaaacaaacgtttgcaatatttagaagttgctcacctgttaaacaggaatga

SEQ ID NO: 87093 - DNA, 1037 bp, Homo sapiens
ggctaattctctacttccaacataatccttttactatttgaattgtaggaaactaaatgtcttataactggagcattagaaaagtatccattatattttagtctagataaggaaattgagccactgttagaggtggttttctggaggagcttcaggaaaagccaagaatctcttgagtaagcttctttggagtcatttattcaaatgttagtaagcttggaaaaataaaaccgatattgcaaaagatttatatctctaattttaagagatcttacacatcagatcttattatagtagcaataaaagttttgccaaataagttttgctttttcatatcaaattgtttgtataaacaatggtgcccaacgctggtgagatgctcctttggaactggtgagaggaactggtgagagtacacacttggtgcacacgttctgcaaggtttgtaaaaagtataaagagccttaaaatgttaatctacttatcctaaaatttatctgtaagaaaacatttgtagtaaaaaaaaaaatagaattatggaccaattattctatacaaacataaatattctggaaattttttttcataaaaatatttggaaacaaatttttttggagaataattgagttaggtatggagtcttcataacctcagtataatatttagttaaaaataagaatacaaactatttataccatgtgattcccgtttgataatgtacagatgtatttatttacttaaaggaaatatgtcaaatattatcagtagatatttttggattatggggttacatgtcaccttttaaaaattctttttgtcatttttataaactttttaattataaaaaactattttttaaaatatgaagtaaaaatgagtgtggttgctgagatcctttttaaaaagaaataatgggtgagaaaatgctttgattcaagaatgtggaccaggctgttcagcgcttggacattgtattgatgaagtaggaaaggtgttgccgtgttatggagcatttggttcctctggagctctggcat

SEQ ID NO: 87094 - DNA, 1041 bp, Homo sapiens
tcagttttcttgaataattgctatttgtctcccttccaaagcctatgatgaaaacaagtgtgtatgagtgtaaatgtgtgggtatgtataaatccttactaagttcaattgtgtgtgtgaggggagggggcaagagagagaagatgtttatcttcctgacatctctcatcagaccctgaggtctgcccttctactggggcatccatggcatggcacataaggggttcagatagactagtttgatatttgctggttggaaattcttggtataaaatcacatgcttttagagctggaagattcttatggattcattttcaattttacattcattttttgccaggtactttcacatacatctgagattcctaaaccgggatgtatttatccctaggttataccacccaagctagaagacccttaaagcttcaggatctctagaaagattcagcatgtttattccttgacttcccctcaggccatggcacagtgtttacagagagggcttcattcatgcatgattaaccagtaacacggccttagcacatggatgcaagagttcatccaaaagtttatgttcgttcatttgtttctttgcctttgtgttgaaattaatctaatagccattgctttaattttaataatagagcctttaggcaaagctgagggtcaggaattgtaaattgccaccgtacagagagtgaaatgtgtgatggggcaactctaggccaggaccctcatggacaagaatatggcttaccaaggaaacaagggaactctcttgtactttggaatctagaaaggccttttcccaaatcaaaggaacttatatgatttgaagcagatttcttttgtttttcattttcagtcttttatacagaatcaaaaagaagcagttgttgaaaaattctgtcttggaattgataaaacaatgtgttgggtttcactatgccacatggctatttaaaatataacctctctcgagaactgtagctgcctatgtgacacccttacttggatgcttaataaacatcttaaactca

SEQ ID NO: 87095 - DNA, 1025 bp, Homo sapiens
cccctgcctggctcttaccaaaaccacaatcaggcaatccccgcaagctgagcttatcactgggatcctggcactgtcaaaggggctgacccaagcctgtcttacactgcctgcagctagttgcacaagccgctgacctacatggaaagcattgcatttcatgagaatgaaataggacattggacaagagctccacatttcctgccatcagatttacttcattttcgggaatggccctgctaacctatgatttcaaaggagtccaaagaattttggagtctagcaatcagttacactggtagtctcttttttcctctatgtctctgtgtggcatgttcctttctgcatgtatgcattcacatgcattcgtaaagacaggcttgaggaactctctgctccacatacaccaaggtgtcctgtggtatgtcagagcagctgtggtataacgaaaggagcacaatttttggcatcagaatacctggattaaaatcctaggcttcttacttgcaatgtgacctggggtacttctctgggtcttagcttttctaaatggaaaacaaagctaataaaccctacttcataaagctgctgaaggatttaatgatattacagatgggtgacagtgtgctcagtgtgctgtcatgaaaagagacctgagttcaaatccagaatctatctcctaaaggccatgtgaatcaggccaatgtattaaacttctcttttcttcagtttatgcatctctaaaatgggagtcctaatgatacctccacccagggtttggttttggggtcaaatgggacaatggctcaaatcctctagtgaggtccccagtatacagcagtgatgcagtaagttgctgtctttctagccttttttcagccattatgtgaaaactcattgtacacttccaagtggtgttcaaataaaagatgattctgtaacagtggtagttgccaaagtaagtgacatgactcattttaaggaacctagtaaaagacaggggtgtgcactttgaaacagagcag

SEQ ID NO: 87096 - DNA, 1071 bp, Homo sapiens
gggatttggtgtacagattatttcctcacacaggtaataagcattgtatttgatagtttttcagtcctcaccctcctcccaacctccaccctcgggtaggccccagtgtccattgttcccttgattgtgtccatgtgtactcaacatttagctctcacttatacgtgagaatatgtagtatttggttttctgttcctgcaataattcacttagaataatggcctgcagctccttccatgttactgcaaaggacatgatctcatcctttttcatagctgcatagtattacatggtatatatgtaccatattttctttatccagtccaccattggtgggcatttagattgcttccatgtatttgctgttctgaatagttcagctcatatttttaccatccctcaaaccatgatgtttttcagagaatagtatgtgtcataggtaactggaatcatttttttctgggtgatttgcttttacaacctgcaatatccttgatctgacaaagtgtggaattattattggagcagatctccttgctgtgaaaagggccacttatgtagtcctgtagacataaagatatataaagcaaataggcacctcattgtcactggggaaggagttttgaaggtttgtcaaaggccaccctatcccataccttttgtttgtggagctcaaaggctctggtgaaggaacgggtaaatttgtgtagcagatcagcagatccaaatggaaatcaatgctttttaaagactttacttttttagagaaattttaggttcacaacaaaattgagagaaaggtgcagagacttcctctataccccctgcccccacacatgtttagaccctcccactatcaacatccctcaccacagtgaagcattcattacaatcaatgaacctacattgacacatcattctcacccagagtccacagtctacatgaaggttcactcttggtgtacattctgtgggctctgataaatacataatgatatgtatccaccattaccatatcatactgaatagtttcactggcctaaaaatcctctgtgctctgcctagtcatcc

SEQ ID NO: 87097 - DNA, 1059 bp, Homo sapiens
cgccgtgggaatcaggatttcatagagtggtgtagaggcctgctttaatctctgctgatgacctaaactcattttgaggaaacaagctaataaataaacatccctgagtttgtgcaagcgtggcagctttgcagtagtcatttgctgagacgatgcatccagcctccactcctcagccagcctgcccttttgggtaataaaacttggctcctaacgttaatacagaggtttctaagtggtgcctgcttcatggccactgtatattttagcttttgttcctatcgattatctccttattttaaataaggaaaaatgaaatatggacaaattaacttttcccttcagccgcaaaactgatgggtcacaggttttgtactatgaatgtgcagtgaaaacaagtgtcattccaaggcagcacttttatgtcttttgctaatatagctgttggtaccatagcgaaatatactcaaaaagaacactgaaaggaatattccttttgacgcttggtctttcaggacatgtagaatcttagataagtgaccttgattaagccaagaatattttaatgtcttttatatacacactggacaacacatttttgtccttaaatattgtttgaaaataggtgaagatgtcctttgctgatgttggaaattggtaaaggagaatgctgctttgcaaatgatctattctaactcagttcacagttgagaaaattaaagcccgttaggtccactctggtaaaataggactggcctccaggatttccagctctggactaacacttagcctcctttgagccttaagtctggacatcttcattgtaatgggttttatttctgacaagtagaaaggcgcataaacatgcttaagaaatgaaataggcagtaaataggaagctgctttttaatttttttaattttttttgcagaaattctttcattagcatgaacgctattataatgtcaatacctgtttttaagtcttattttaaataattttacacattatcaaagaggcttaagaataaatgttcaaaataatgtattctagacaact

SEQ ID NO: 87098 - DNA, 1011 bp, Homo sapiens
agtgaaaccccatctctactaagaatataaaaattacccaggcggtagtagcacgaacttgtaatcccagctacttgggagactaggcagaagaatcacttgatcctgggaggcagaggttgcggtgagctgagatcatgccactgcactccagtctggtggacagagtgagaccctgtctcaaaaaaaaaaaaaaaaagtgctgttagattaaactgccaaatatgttcaaaccttattgctccatttcactgtgcagatagtgcatatattttatttgccaaatgttatggtaagtagtgataaaattatgttttattttttaacaaaaatgattgttttgtgggttatcattgagattatggtttaaaattagttaatgcttgtttcttccttccctcaggtgcatttggtgccagaaaacagtacatgatgagtgcatgaaaaatagtttaaagaatgaaaaatgtgattttggagaattcaaaaacctaatcattccaccaagttatttaacatccattaatcagatgcgtaaagacaaaaaaacagattatgaagtggtaattagagtttatttctctaatatgattgatttttaaaaagctgcttaactcattgtttgagatagttaagacagtatgtaagaagaattggtgccaggaataaaataaacttaaataacagatcaagaccaaggagagaaataaaatgctattatggtaagccataaaatcctacctagttcctagagatgggtcaaaaattttggctcttgagttctttcatgtctaaaaggaaattggaaatgttatattagtggtttccaaatcattgcctgcatctgaatgatttagggagctttttaaaaatacagatttctgagtagtaccttcattgccatatttgatttagtaggtatagggtaagtccaggaattcatctttttttttaaggtcctcagaagattctgatgaacagtcagttttgggattcatgattattgtcagt

SEQ ID NO: 87099 - DNA, 1257 bp, Homo sapiens
tagcctctaagcttggaaagcagtggaccccattaataatcctggccaactctcgtagtggaactaatatgggagaaggactgttgggagaatttaggatcttgttgaatccagtccaggtaactaaagaaaaaaactttttatattaatgttttcattttccccaaaatgcaatgattattaatgcttcaagtcactaatcacctgatcataggaaagaataataattacaaaaagatcagccatttaaatatgtggataaacaggcactcttgtgggaatataaaatggtacaacctctttagaagacatcttggcagtttcttaaaaagataaatataaatttattatatcttctagcaagtcctctactaggaatctacccaagggaagtgaaaacatatttctcacaaacatttgcatgaaaatgttcacagcagcattattcatgatagctgaaaagcataaacagcccagctgttcatcagctgatgagttgataaacaaaatgtgatgtagccctacaatggaataccatgaaatgacaaaaaggaacaaactactgatacgtatatattacaataaatgaacctcaaaaacatactaagtgaaagaaggcagatacaagggaccttatattgtatgactccacttatgtgacttgtctagaaaaggcaagtctgtagaggtagagaatagattattggttctagggctggaaatggggagtgattgcgaatggacattgagggatcttattgaagcaacaaaaatgttctaaactggatgatggtggtggttgtgcaattcagtgaacttaataaaaattattgacttgttcacttcaaatgggtgaatcttatatgtaaattatacctcagttttaaaaataaaagggatcgttaaaattgaatataattttactttgaaaaattaaccaaaaaacaaaaaaatacaaaaaaattttaaagacaacccattgtgtagcaattagaagtgcaataactttgtccttccaatttgtattttttacactttcaatattatacagtttaagaaaattataaaaaatacagagaaaatcatttgcaatttctccatacaaatacatcagttctcttttttcttgttctttccattaattatctatgcatttactttacatattaacagtactataacaataatctagatacaaatttgcattctgatttttttaattttaatggtataaatatttttccttgtttcaacata

SEQ ID NO: 87100 - DNA, 1079 bp, Homo sapiens
ccgagtagctaggatcacaagcacacaacaccacactggctaatttttgtatttttagtaaagacaggatttcaccatgttggccaggctggtctcgaactcctgacgtcaagtgatccacccgccttggcctcccaaagtgctgggattataggcatgagttaccacacctagccttgtatttcagcacttaattacctggacaatcacaggcaagtgatttaaccttcctgcacctcagtttccagcccaatagaatgaggctaactcttgctttgtaaagtcagtgtggggatgagctacaatgaatataaagagtctggcagggtgcctggcatattgttaaatacatagtagccagtaatgttatttaactgtatctctactcatctagagggaaatcatcattacagatgaaggaaaatgttggataaaaataatttgtctttttcttttgtttctaggtttttgatgtaactaaaactcctcctatcaaagccctacaactctgtactcttctcccatattattcagctcgagtacttgtttgtggaggggatgggactgtagggtgggtcctggatgcagttgatgacatgaagattaaggtattagtctttaagaactactacagaaggacttctaagataaatatactatacatatatatatatatatgggttttgttgttgttttgttgttgttgttgttttttcttgagatacagtctcgcactgtcacccaggctggagtgcagcggcgcagacacagctaactgcaacctccatttctcaggttcaagccatcctcccacctcagcctacaaagttgctgagactataggtgtgcgctaccatgcctggctaatttttgtattttttgtagagacagggtttcaccatgttgcctgggctgctgtcaaactcctgggctcaagcgatcctcccaccttggcctcccaaagtgctgggattacatgggtgagccactatgcccaacctaatatagaatatttttgctttatattttttattatgcagatgaatattagacattgccagcttcaaatagttaaaaat

SEQ ID NO: 87101 - DNA, 1050 bp, Homo sapiens
tatagatttccattgctgctcctagtggattccaattttaccctttaaaattactagaatggaggtgttggatagggccagaggttgcacaccaaaagtatcccctttggttgcccttcttttcatcagcatctagtctaccataaggagaatgtgtgcttcaacattcttaaagggagctttgatacagcgtattttttcttattgtttacagggttagattgttttaatattatattttctgtccatttttcataggcggtttacttattctatggaaccaaagattgtttagtgcaagaatgtaaagatttgaataaaaaagttgaggtaagctattaacactttttattttttaaagttttaggtggtctctggattatgaagactttttaaacagaaatgctaaactttgttaatatattttgccagcatacatagagtatttatttgtgtgccaggcactttgctacatgctttatacacattgtccctctaaattctctccacaattctataaggtatgtattatatattcacattatgcagaaaagaaaactattttaaatgaagtaatttgcccaaattctctcatttaatgcctaaatgcacatgtaatcaagatgtgaacccagatttatgtaaatccagtctgtttaactattagggtgagtggcctccattcatacatgataaataatttacagttatctaatacagtgcctgactcaacataaagacacagaggaagtttaaatggaaagtttaattcagattatttttgtcgggtatctctcttacataccaaaataaaaatgtataaatacaaaaaaaaaaaaattagccaggcgtggtggcgggcgcctgtagtcccagctacttggaaggctgaggcaggagaatggcgtggacccgggaggcggagcttgcagtgagccaagatcgcgacgctgcattccagcctgggggacagagcaagactccgtctcaaaaaaaactaataaaaaataataaaaatgtataaatagtaaaaatagaatattaatgatt

SEQ ID NO: 87102 - DNA, 2878 bp, Homo sapiens
atagaaaagggcagatgagaggccctgagtgagaggtagggagcatcttctacatgtgcatctctcatatataagcacatttatgaaaatagatgtgaattctaaatggatgtgtgtggaaattgtgtatcctgtagtcactatctatttgtatttctttaaagctagaactggatggtgagcgagtagcactgcccagcttggaaggtattatagttctgaacatcggatactggggcggtggctgcagactatgggaagggatgggggacgagacttaccctctagccaggtatgtacatttgtggtctgtttttttatgtcactattttatttaaagcaatctcttgtttatagactttaacatttttcctcaaattttcttttttgtgtatctcattagttataaatattttttaagttgatggtccaactgtgttaaaaagtaattgctctagcataactgattttttattgcatcatataatccatattttctttttccaattttaggcatgacgatggtctgctggaagtcgttggagtatatgggtctttccactgtgctcagattcaagtaaaactggctaatccttttcgaataggacaggcacatacagtgagggtaggtgaaatatagctgtaacaggctaatttgtcccaatccaattctaagctgttgatatgtaaaatatacatgctatacttttctttaaacagtggtttatggctcatgcagctggtcactgtacactagcggctagagtgggatgaggaagaaacagaaacatggctcaagatccatgagataaaacgttcacttgaaaaaagaattccttaatcaatgaataaaaacatattcagattaatattttctaaaaatgaaatgcataagggttaagggattgtggatggtattattaaggaagacctttctaaatttggggggactgacttttaaacattatttgttccctaatatcagctgattttgaagtgctccatgatgccaatgcaggtggatggggagccttgggcccaagggccctgcactgtcaccataactcacaagacacatgcaatgatgttatatttctctggagaacaaacagatgatgacatctctagtacttcggatcaagaagatataaaggcgactgaatagatggatgagggagtgaaaactttgcatagaatcctcacgcaagtagatacatgttcatccaaaagtattaatagaaattctctatcagctattcagtcttaatttcactagtagtataatgggtatacatttttgtaaatagcatccccaaaccagccagccttcagttatttacaaatgtttgttcttttttcagcaaaatacttcaaatgaatagtattaacttacaaaaagtcacaaaaacttacatgagagtgaaaatttgttatgactgttttgagagtgggactcactctgaagtatgtgctgtctcatgtcttatttttgaaccatgcatatgatggacacacaatggatggacacattatatctccaacaaggtgtgggtggaaagatcaaattaacctgcttttttgaaaggaaatgattactgtcaaaccagcatggttaattgtgagcatcctcctgcagcatgccccttaagattttctacaacccaaaccaagtgtatgtattgatttctaggaacccccaaaaggagaatagtaaaaaaagatcatacttaaaatttgtattacaatttttattttaggaacttattcagacacgtaaatgttgtttaattctgtaggtaaccatttgagctgcaattcaggatcttttttataacaccagtgtagccaaaagagaaacagataagtgaattggtaagaaataagattcagagcacttgggattgtaagttataggttctgagctgaactgtttatcagccgctctttttattaaaagacagtgtcaacacttcaaaaaacgtgcttaaaggagacaacggtgagattaattgcttagaaaaagctcaaggctgactgataagttttaaaaatttggtggtcttgtagtattttgaaatacagtagtcttttaacagaatttccccttagggaggtaagtggacagaaatctttgctaaaatgtttatatcatatttattttaaaatgagagagatatatttttaaattatttattatttaccttgtggtatggtacctgtgtttagtgtttacgttctgtagctttatttaataagttaaattgatcacataaattctgctagtcacaatcagatagaaatttagtctattaattaaaattctaatttaattctcctgacagaaatctagatattcttattcttcacaaatattcctcattgtattgaaaaatgaaggagggcatgaaaagcactagggaactacttttggataactgaaagctttgtttcattgttttatttgcccctcaattgccacaaacttactgaagggctagtttcatggttcccattagagggtgcttgttcgctgctgttgaccagcccaagggtcgtgacccacaggtcggctgacccagagggcatccagcctggtgtttttctgacacatggcccaggctttgtggtctttcatgacattaatctctgaaagatcagaatgtatcccccaaaataccattagctatctttgagggtctattatgaatctgtcatccatgaattgccataaacctaagtttgcctcacctcaggcccagaccatgttttcaaagagcaacttagtaatgtatacagtagtcagtacattttatgaaatactctattttgctaaattaacctcttgcagatctcctcaggtgatcttaaattctagtct

SEQ ID NO: 87103 - DNA, 1373 bp, Homo sapiens
atgtatcattatcttgtttttgcaaaattcacttactttttgggcacatttacccagcatttcaaataagtgtataggcatgtgccttgtttaagtacaatttataagacttcatgtttgcaagttacatattagggtagtgattgtttatattaccagggattctacactttaccaaaaaaaattgccataagattttcctgttccattttaaattgtcttgatatttaaaaaaataacttctacattctcaggaagaaatacatgaagtaaatcatatctccatgtctgtttccagatttctctaatctttttactatcccaatacattcctaattcctataaacgtagtggcttaaatactgaatacctggcagctcttaaagatcccttaggcagatgatgataattttcagtgtttcgtcatgtttaatagaaatcaaactgacttgtgttttaaaatacaagttgtctgctagtaaagttacatgatttaggtgtgttttaggttttctgcaacaattagctgtgaacccctaatgtagctaagtttatacaaattttataatcaaaattatttatttttatttttttagagtatgtcaaaaacatatagtgtttgctttgtgaaatacatttgcttagagttataaaatatactgtgactcagaaattgtaaagtcagtttgcgttgtaaaaatgaatactaccagcatgtcaaaagaaaaataatttacatttgtaatataaagtaaaattgtatttaatatatttattgaattttaaatttgcactaacttgaaaactttaaaggttatactaatttaatgattaatgtggacccaaatacataatttggccaaaaaagtcattagaatgggtaatggttttgtgtggttttccttcaaaatgataatattgaagcaagaaccagcattttatattgataatttttttaatatttctacccagttgaggacagtggaatataagtagatatatttaaaatatctagatatttaaaaagaaagaaaaggttgtttatcccaatctgaattcattctcagcaacaagacagaaaaggtggtttgggttttgcttttaaacagtgtccccctgtctttttcaatttttcccttgaagcctttctcttgttcttcagagtacgcgctgcaggctatctgcagcatcagaatgcctgggcaggctgttgaaagtatggattcctgagcccaacccttaacttaatgattccctgtctctggagatgcaacatagaaatctctgtttttattaacaagcgcctcaggcgattcttaagcatactgaaatttgaaagcttctggtctgaacctcatgtattcacctagggc

SEQ ID NO: 87104 - DNA, 1937 bp, Homo sapiens
gcagtgagccatggaggcgcctgccttctcactgcagtcaatgcagccacacttgtgtatactgagtgctgcttcagatctcagtagataaaataattccacatttaaaatgattctgctattttttataaagggtttgaaagccactactataatgactttgtcacctaattgattttctactaatttttacatattcagaaacttcgtgtttttttggtggacagaatattttggaggtctccgtcgctgtttagaatgtggccacttggctgtttcacagtttttaaagctattttattgaatagtaaagcagtgaacttagcctttgttctttgtgtttctaatttaagcatatagtctatttaatttttgatatgtaaatacacatcaatacatatatatttacccatgtggccctgtgtagtcagtgcatgaggcttgcatagcccagaaaggtacattccagggttctggggaaagaattttaaaatgccatcctctaatacagacgtttataaaacttaaatgaaatgattgggcttaaccatatgcaagaaagtctgcagaaaataaatcacctagaaactataaatagaaatgtgctgctgaggctgggcacggtggctcacacctgtaatcccagcacttggggggctaagggaggcgtatcacctgaggtcaggagtttgagacaagcctggtcaacatggtgaaacgccgtctctactaaaaatacaaaaaaaattagccaggtacattggcacatgcctttaatcccagctaatcaggaggctgaggcacgagaattgctcgaacccaggcggcagagcttgcagtgagcggagatcacatgactgcactccagcctgggcaacagagcaagactccatctcaaaaaaaaaaaggccgggcgtggtggctcacgcctgtaatcccagcactttgggaggctgaggcaggtggatcacgaggtcaggagatcgagactatcctggctaacacggtgacaccccgcctctactaaaaatccaaaaatttagccgggcatggtggcgggcacctgtagtcccagctactcgggaggctgaggcaggagaatggcgtgaacccgggaggcagagcttgcagggaggcggagcttgcagcgagccgagatagtgccactgcagtggggcctgggccaaagagtgagactccatctcaaaaaaaaaaaaaaagaaagaaatgtgttgctggtatcagatatcagaccaagaacacttcagtctctctaaggatgccctgagctacctcactgttaaaggacgacatcaacacagaatgcactaaacaggaaataagctgtaatctagagaatttccattatgtgttactttttggtgactaacatggaatgttgaaaaggaagagctggaaagctcagttgttttccttgttcctctgacattgtccaggcaagagggcatcctgatcagatgagtagatttggctgagaaaaaccctagagtaaggcaggcactttgtggaggtggatgatgatggctcataaaaacgtttgttctcagtccagttcagggctctgccagcagtctttcagatctgaactgcttaaacaaaccctacagataaattggcactctgatttgtaattctgtttgtacaagtttagagcagcctagctcgagtcctcaaccccagtcctcttagaagtgaactgattgcactggatccctaaacccacaatgttgaggacacatgtgatgactccacttgctcagccagctggcctcttgcactttcccctgcccaccacttgtaactaccacttaattatcttgtgttaattgcttttgttgtgttgggtctgtatttttgtggtcagtgcctgcaggcagaaatgtgaaagcatttggtatgttgaagatacttgcttc

SEQ ID NO: 87105 - DNA, 2589 bp, Homo sapiens
tggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtatagtcctgagttctgtgatttttagtgaatcattgaacctgaggaagatcatggtaccctcctgggattgtaggcagttggtcacaagcgctgatggcctgggatccccacatggggctggtgtctgaggtgagggcagccctgttggggactatgtcccttcgctggtggcatctgatctaactctgctggtcgttgttagaattgtggtgcggtacaccaggtggtgtcagaacagaggcggtgggatctgcacaccttgagtaagcccttctcgaccagcctgttggaacaaaacacactactcttcatgggagcctcctgagtttcttctcacctgtgtgaagtcccctttgtttactgtcctgagttttgttctcgctcatctccaacccctcttgtagttttttcttcctcactgtcactgtaaccataaaaatactcagtatgtcagtgatagacttgtctttctattcagagatgactcttcaactgtccggggacacttttttccaataaaaagttcaggatggtaatttgtgactccttactaaaggcaagctgggagtgcgtgtgtgtgtgtgtgtgcacgcatgtgtggtttttaagtcatttgtggtctgctggggtgacccatgggctaagtttggacttgctcataggttttacatctgttttctcatcagttcccaggcagtcttgaaatgccatagcatcatgaataaccgaaggatctccaaccgttattgaccttggagttgcagtctacctgtattttattgtagatcaattccaatacataaaatacaggaagactctaaaaaagcaaatcaaagagtgaaggggaaatgatacatttaaaaagcctattttaaagggggcaatttggaataaatgcacacacaaaatgggtccttttgctgatgcctctgctgccttattgagctgtatgtccttattccaggcacatctcctttctgagtcttaactttgcctgcattaaaggttccatgaggaccagatgaaatttttgaggtaaaaataggtcgacattta

SEQ ID NO: 87106 - DNA, 2627 bp, Homo sapiens
aatgaatgaatgaatggataaatggaaaggcagaaggatggatagataagtggatagatggatgaatggaagaatggatagataggtagatagatgggtatatggatacatgggtagatggatagatggatggatggatacatggatggattgatggatacatggatagacagatagatggatgaatagacagacagatggatagatgagtggatggatggaccaatgggtagatgggtgcatggatggataaaactagtgaataaatagtaccactttggcaaaggtctaaaagagcactttgggccccttgtaattaattccttggggtgatgttttctcagattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttc

SEQ ID NO: 87107 - DNA, 1675 bp, Homo sapiens
tgcatttcttaggggttctctggtgatgtcactgcagctggcttgggcaccagactttgagaacgactattttagccaaactcagttcctgtaggtagacactccagatatttttaaaagacttggcaagcatttttttttttttttgagacagggtctcattttgttgctgaggctggagtgcagtggcaagaacacagctcactgcagcctcatcctcctgggctcaagcaattcttctgcctcacctcccaagtagctgggactacaggtgtgtgccactaggcctggctagttttttctttttttttttttttgtaattttgtagagatggggtttccccatgttgcccatgctagtttctaacgcttgagatcaagtggttcctgcaccttggcctcccaaattgctgggattccaggcatgagccaccatgcgcccagcccttggcaagcatttttttttttctgattccctatttggtttttgtgttttttcctttatggaaatataatttacctgcagtaaatctcttttttccctgcagtaaatcttaaatgtgcagttagatctattttgacaaatgcatacatgtgttaccattgttcaaatcaagataaagaatttccctttctccagaaaattccttcatgctccttattagtcagtccccgcccccacgaccgctcatgctggtttctatcactatagattcattttgcctgctgactccttctgtttttcaaattaaaacatccttttatttgtctgggtcaaattcatgcacatgaatgttattattttgaaaatgtcattgtgttgtgccttaaaagaaattaaatctgaaaactttcttttgcagaagaggaaaagaaatccaagaaacctcgtaagttatgcatttctgcaactgttcgtttcttgagactgcccgagcacagaactaaatgctggtagtgagagtcgacctctctcatcagggttctgtgatgggttctatatgattccattctgtaatggcagcaggcctgaggctggaggggaggacaagcataagtgagatgaataaggtgactttagccttgtctgttttcccctgtgttgtcctgctgttcaggcgtgtgtttgtagaagtggctcttaatcagtgtggaagggagtagaggccatcccgttgctctgtatcatatttccctttccttacccccagcccctgtccctgccttacccagcaagcttcccacgtttggagccccggaacagttagtggatttaaaacaagctggcttggagggtaagttatcatgggcaaggagctttggggtgtccactctgagtttgttctgcaaatcactctctgtttcctctcccagctgcagccaaagccaccagctcacatccgaactcaacatctctcaaggccaaggtgctggagaccttcctggccaagtccagacctgagctcctggagtgtgagtagcttcggggctggtgcgcggttccactggttctgtctctcctgcgccgctctgtgcagctctctgtgaggccagctggccggctatatcagccactccccttcacttgtcctctactttgttgctcccttattttctcccagtcatcagtgcctttctttacttttcctaactagctcagatttcacaatcggtc

SEQ ID NO: 87108 - DNA, 1023 bp, Homo sapiens
tcctgcctcagcctcctgagtagctgggattacaggcatgtgccaccacacctggctaatttttgtatttttaatagagacatggtttcactactttggtcaggctagtcttgaactctcgacctcaagtaatctgcctgcctcagcctcccaaaatgctgggattacaggcgtgagccaccgggcccagcctaaaaaattttttttgtagagccagggtctcgctaagttgtccagactgatcttgagctcctggcttcaagtgatgctcctgccttggcctcccaaatcattgggattacaggcttgagccactgtgcctggcctgtctgatttttcttcaacgctatttccctagtgcctagcacagagcctggcccatagtaaatctctgttgtgtagtccaagattgggcttgaatctcagcttggcctgccgagtgtccttgcagaagggcttctgaaatcggtggcggtgcagccccattgtggaagtgctgcgtgggggcaaagctataggtggctggtatgtgggaggaggggagagaaagaatagtgggaaaggaacaagtgttgacccagcctccgctacatgaccttgatctcattcaggagtcacatcaaccatgagcaaggtgaagtcatccccattgtgtgctcgaagaaaccaaagctcagagaagtctcagaggccacagagctgggtgctggtggaaaaaagacttggcccttgctacattttaaaaagtcagagaaaaaagggaatacaccaaactggttcttagatcaccttgtttgtagctcttgtaagcgatgggatggggaaggtcggaggaaatggctgtctgtgtaaaccctctgcctgcccaccgacccatggcaaagctggctgctagggtcagtgagaggagccgcacacactgagcccttcttctctgacacaggtgaccctggagagcatgacccagcgtccacacacaaatccacacgccctgtgaagaaggtctccagtaagtagccccac

SEQ ID NO: 87109 - DNA, 1035 bp, Homo sapiens
agatattccctggctgcaatccacatcccttgagatgtccctgtctgttaccagaatgtgtgattagagctgttcccctaggattggggtggtcctgagtttcctgtgcttttccacctttagctggaaaagtggaaagaacattgtcctgggggatcggaagatctcagtcccagctgtgtctgtgcccctagctggtggagttcctgccatgtctagacctcagtttccccatctgtaagatgagtgacctctggggtcccctccagctccagattactgtgtcttcaagtgtcatttaaactcctggtgacctctggcctgtaatttgagaaggccaattggacttagcactcttgggcataggggagagcctcctggggttggtgaggactgagcccaggtccccgtttcaccagagctgcctgcactaaccccctggcatgttccagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccttagcagccccctatgctgccccctgtggaaccctgcaacccgatgggtcccctaaatgttttgggatgggagattggggcgtgatcccgagcactggggcctgagtttcagggctcctgaaacatccgccctctgtctggaggctggtggggagtctgcttcatcctgacattttaggatctttcctaaagcatttttggggacttgatgttaatgcttggactttctggacagataggctcttttggcctgtgatcttgaggccaacttggatgggttttgaataagctagggcttgttattgtgtttggtgggggaatggcccgtttgggggagaaatctagaattcctctttgacacccccttttcatcaccccatatccaatccattgccaaatttcacttctttcaatctc

SEQ ID NO: 87110 - DNA, 1892 bp, Homo sapiens
ctcagggtgtagtgctatgagcagctcttgaaagtgaagcagttggcagccttggggtgttctgaggtctcttcttgctctgaggccagcaaggccggatgtatgtaggcctggtctttggcccacaccttatcttggccactgttagaggccaggtcgaagggcagtgtcacagaggtcaagtttgaaacatcatgagcagcttgggcttttcggattgagttagtgtggccttggtccctgcctccaacccctacatgtgactgtcactgggttgttcaaatctagattcaagatcaggttccgcccagaatatcttgggtggagttgaagagtctgggaagtggaagagagagccagagtatgttgagcctgctagttacgggaaggaaattttttttttctagaaatctccagcatgctcagtttgggcatgtgtctatgattttaatatcgggatcttagctgtgccagttactagtagtgtagctggggcaagtcacttaattgttctgtgcctcagtgtccttgtctgtaaaggctgggtaattcctacctcatagtgttgttcttagctttaagtaagttaatacaggtaaagcactagaacagtgcctggcatacagtaagtgcataataaatactggctgctgctgttatggtggtggtgattttccttcccatttctgtgcagtattcatctgagcagggaggtaggagactcagatattgattatgaaaattaattgaaatcagatgaggatattagcttccttcatatacagtttgcctttgtttctggaggtggctaggactgagcagatttgcacctgggcttcagcccctgtgagctacttcatctttttttttttttttttgagacagggtctcactttgtcacccaggctggagtgcagtgatgccatctcagctcactgcaggctcaacctcccggaatcaagcgatcctcctgcctcagccccctaagtagctgggactacaggtgtgcaccaccacacctggctaatttttgtatttttagtagagacagggttttgccatgttgcccaagctggtctcgaactcctgagagcaaatgatccacctgcctgggcctcctaaagtgctaggattacaggcatgagccactgcgcctggctggctgattcatcttattcccagcccttggtggtcccagtctgcagtgagccttggactctgatttctgtctccctgccctgtgaggctgacaaaggctcccagccttgttctgggattggcagatgcctctggagagaacatcctagatatcaggcttatctctctgggcccccttcccccttctcctggaccttgacttcttaatcctctgcttgattggctctccagcatcttttagcagatctccccgctgccccattatttggactgctttcctggctgtttgcagtgggaggattggtctgagtggccccacctgccattaccgaagcagctgtcccagctcgttctgttcctgtgtgagcttggccacctttctgtcctccttgcttgagtttcattggctgtaaaatgggtaattagagaaaaactcataataatataagctggcatttagtatgtttttcctaagatccaggcattgggctgagtacttacattgtttcaattaatcctcccaatagccctgtgagctggggacagttgtatctattttgtgtccaagaaaactgaggtgaaggacacagttgcacagctgggagttgggactggaaccctggtctgtactgtcctctgaaaaggatgaagggaagtagtaagtattagaatgcttcaaaaagctccaagcaggcaagactcgggtgacaggacttggggtggcaagacttggg

SEQ ID NO: 87111 - DNA, 1071 bp, Homo sapiens
tcagcctcaagagtagctgggaccacagcctcccaagtagctgggaccacaggctcgctaattttttgtagagatgaggtttcgccatgttgcccaggctggtctcgaattcctgagctcaagcgatctgcccacctcgacctcctaaagtgctaggaggtctttaaaggcgtgcaccactgcgccccaccatctgatggtgtttagtagagggttttgaatgtcaactatgaacgttggaggttacctctgttccctcacgaagtcctggtggcacccaggaggtggatatgatttagtttcattttactgttgaggatactgaggtccagagaaatgaacttagcctgacctaatgcagtaaatagccacgcaggcattgtgacccgggttggttcgatttcatagtttgcatttcttcccatggaccagcctcgtatccaggtccgtagagtccggagcaccaaacagtccaggaagcttgaggtcatgtaagcaaaagcctttggtgggccggagagttcctgtgatcaggaagggttgttattagaggcctaagagggagggtgggcagcgtcccagtaatcactggatcagagccacagggagagccaacactcttgcaccatagtgtcctccgtcctggccgtgtgactttgagcatggggtttggcccctggacctgggtcctcaccagtatagtgaggctgtgggactaggtggattcctaagggcctttcaggtctgcaatgtttttaggtggtttggggatcataccttccccttgtggcctcaaagcagaggctgaaatcaaaccaccttttgttacatcagcctaagatccaaagcatggcctgatttcatttcattctcacagcaccttcagggagaacaagacccgtcttcgtgttgtcagaggagacagtagcctgagcaaggtcagagttgggggtctgcatccagctttgtgtagcatataaacttggctttttttttcttttcttttagagacagggtcttgctatgttgcctaggatgttcttgaacttccggcctcaagggatcctccca

SEQ ID NO: 87112 - DNA, 1587 bp, Homo sapiens
gattataggcgtgagctaccatgcctggcctctttttttttgttttgttttttaattaaaaaaaataatagagatggggtctcactaggtttcccaggctgatcttgaactcctgggctcaagcatttctccccctcggccttccaaattgctgggattacaggtgtgagccacagcgcctggcctaaagagttactatactgcaattgaactcagtttattggaacccaaattattcccgttcttcaatcattctacacagacggaaaatttacgtggctgaattaaccggtatgacctcaaaatgaagtgcctaaactgggtattttgtctttttcctcagatcactgtattttggaaagagttgattgacccaagactgattattgaatctccaagtaacacatcaagtacagaacctgcctgagtatgacctctccaccttatagtttatgaatgtcttgtttgtgaaagtgactataacccaaacttttttttttttttaaagaggatttggaagttgtatggatttttttgttatcttcactttactgcataggaaacaatctacctcatcatttaaaatgacatgggtgtcggttttgtagatctttggtttttttgtcaggtttaatttcagttaacaaaatgtaaaacatgacattccctgcagatattgttgtataccagtatggtttcttctctttctttaaatgtttttggccatcaagtagcagtcgtcagtaggagtttataataccaagaatgtgctgcgtatcttgtctcaataagttttaagtaacatttaaaaatattaaagcatgttatttgacctaattttttagcatttgagttgttccattaaatggagcatcttgtaaatttcaagtattttatacttgcaattgttaagagttaacaggtagttggatttgtcgcagacaatgagttaaggaatcctttcacgtttttcccaactttaaaattaaggattctcaggtccctgtgtagagcagtgaaaataagatgtgcgtatgtgtgtgtatgcctggagaattggtgtttcacttcagtgagaggattggctgtgagcttcagaccaggaaatgtgtcatcttgccaggcacctggctgagtgtgctggagtgaggatcttgaacagaaacttccttttctgttattattcactacgaagctaaaatggccaaatatataccgtgaaaattggtttcatttaacaaaagatcagatccctccttcagctgtacacatttttaaataaaatcatattgaactaaacatctctaccgagttatcatgttgagtattgcaaattattgtcttattttacaataacgtgagagattacaattttctgtaataagaaggtttgctttgactgatgagtctgatgttgcaaagtttggttcagtggagttcatctgatctgggagccactgtgccagtggagatgctggccagttttactttgcatgacatgaatgtgtttcaaaatgtgcatttattgatttgtaatgagaagtattactcccgaaaggatgagagtaatgtgaacggtgggatctt

SEQ ID NO: 87113 - DNA, 1052 bp, Homo sapiens
aattctggtagtactaatgacagttcatcaagcttatgaaggaaagattttctctgataaatggctgagaagtccccctggtccagagtttttctcaggatcccccagtattgagcaccctgtgctttcctgtacatacccagccttcacattaattgacagtttgtttgtggttgttttcttaatgatataaattccccatagaggaacatttttaactattgaaaaatgacttactctctttcctccctatcttcttgtttcagccttgagagaacctgggaaatttgatttagtttatcacaatgaaaatggagccgaggtagtggagtacgctgtgacacaggagagcaaggtaggtgtgcttctcttcttgcgttgcttggccattcgttctctcttgaccaattacctgtggtttggaaggtgacattgcactacaggccctggggggaatctgaccttcttatggtgtggcaataccagtgccaaatcagggcgccatcttggccctcatagagcctatgtgacaagatgcacaaataacaaacttttctttaagagtgtacagttgtttaaaattatagctatataaggattccagtaggaaagggtagcatatttagaaactttattggcatacacgttcagagaagtgcatataactacatggcttgaacaactttcacatgaacatacccatgtaaccagacccagatcaggaaatagaacataacacccactcccagaagcctctattatgtccccttgctgtcaccactatcccccaagtgttaccacagttccaacttttgtttttttgagagagtctcactgtgttgcccaggctgaaatgcagtggcatgatcttggctcactgcaacctccacctctcaggttcgagcgattctcatgcctcagcctctggagtagctagaattacaggcgcttgccacctcacccagctaatttttatatttttggtagagacggggttttaccatgttggccaggctggtcttgaactgctgacctcaagtgatctgcccact

SEQ ID NO: 87114 - DNA, 1736 bp, Homo sapiens
tgcaccagtgcactttggcctgggtgacggagttgggactccgtctcaaaaaaaaaaaaagaaaagaaaaataaaaataaaaaaaagaaaacggacagttactttggagctcggcctaataagaacctggcatttaccttgcttttcagctttgttgatgctcttgagagcatcagccaagacattcatgtgcaccactgtggtggtatggaaagagccagcgtaattttaaccagatatctggacgtccaatagcccggacaaattgatacataaaattaagcttcacagagtgttgtggaattgtacagatggctgtcactaccctagagaacataaattgtttagtattcacctaaattaaaacaggagtaaaatcttattaaagaaagaagcccacattctgaaacaaaatggataatcagcattatcaccttttagggtaggtgacatgcatattgtagaaagattgtgagtttgaagttagacaaactgaagtttgaattgcgtttctgctacttatcagctctagatttggggcaagtaacttgtctgagctgtaattttgcgatctgtaaaattaaaaatacctactttgtgttggtgtttagattagagaaaaacgtattaaaaatgtttaggatgcagtagctattcaataaataaaactagccatttgaaagttgactgtgagtaatgctacataggccattttgccagaaagagtcttttgtctttaagtgatgtgacattttttcattgactgatggtagttacattttgtagagtcatctcagtatataactatgtcctggagatgtgtttataaattgctcactctagctttctctcttgttcttttgacagagttaaattagaagagagaggagttgctgagaattctgtagtcatcagtaatggtgacattaatttatctcttagaaaagcaaagaagcgggcatttcagttagaggagggtgaagaaactgaaccagattgcaaatattcaaagaagcattggaagagtcgagagaacaataacaataatgagaaggtcttggatctggaaccaaaagctgtcacagatcagactgtcagcaaaaaaaacaagagaaaaaataaagcaacctgtggcacagtgggtgatgataacgaagaggccaaaagaaaatcaccaaagaaaaaggagaaatgtgaatataaaaaaaaggctaagaatcccaagtctccgaaagtacaggcagtgaaagactgggccaatcagagatgtagttctccaaaaggttctgctagaaacagccttgttaaagccaaaaggaaaggtagtgtaagcgtttgctcaaaagagagtcccagttcctcctcggagtctgaatcttgtgatgaatctatcagtgatggtcccagcaaagtcactttggaggccagaaattcctcagagaaattaccaactgagttatcaaaggaagaaccctctaccaaaaatacaactgcagacaaactggctataaaacttggctttagccttacccccagcaagggcaagacctctggaacaacatcttccagttcagactctagtgcagagtcagacgaccaatgcttgatgtcatcgagcaccccggagtgtgctgcgggtttcttaaagacagtaggcctttttgcaggaagaggtcgtccaggcccagggctgtcatcacagactgcaggtgctgctggatggaggcgttctggct

SEQ ID NO: 87115 - DNA, 1024 bp, Homo sapiens
tgttgtagagacagggtttcgccatgttgcccaggctggtctcgaatccctgggctcaagctgtcctctcacctcagccccccaaagcactgggattacaggcgtaagccactgtgccagccttccttcccccaccccctttaagcttcagctacagtgaattaattccagagttgtgaaccaggctattttctcttgctgccctttgtcgttgaatattccttaccctcaagcatgtcagattccgtaagatttcttcagaacatcagggaatttaatttggaacagtaactgcatctttaaatcaggatattatgatttattgaataatgttcaactgtttcaaatgacaatttgaaataatccaaatttcaaagagttttttttccccctttttattgactgtgaaataggtctctattctctctgcaattcaaggattatttaaatgttacaattctaaggattgtgtcccatcctattaagtttactttctgaactgtctcttgcctaatgagttaataacttgtgctaactataattatactttaatgaatcatgtgggcattacattcttcataatgaagttaacaatgacaaaaacaaaccatgaaaactgttataagtaataattacaacacgatgacaggcaaatctttcctaaatgcttcaaatgcacagctgcatgtggcaaaaaatacctctctagtggcttcagtggcaaatgggcagaccgtagaaaaagatgaatctggaaagttcgtctttgtttttgttgttttatgtccacaatcattgtttttccctggcaaattcacttttcttcagagctacggaagaacacatagtctctattctcaaagtacccaatattgttggactgggacccaaataatgagtctcatgcttttgtatattaccttctgtgatacagacaattagactgaatagttagaccaagttatatggtaagtgcagaagctggttgagaaaagggagatcagcatggaacaaaatggttagg

SEQ ID NO: 87116 - DNA, 1249 bp, Homo sapiens
caaaacgtttataacatacataactttaaaagaaaaataatttaaaaaatacatatctgaaaatgaaaccccgctgtttgccaacgaccagctggcttaatctgacttcgcagatgtagcagtgttggaaaacgtcggttcttttgctgagggaaggaagagatgggaggggtagaaagggcggtggttattccctttagtatttcgatccggtcacacaacctaaatccaacatctgcatcaaatgtctcctttccgaaatactctccctaaaatgacagagaacctggccaggcggacagaacggcccctgcgcatttgcaggggtcctggtgggcttgccgggcagagggcgtgcgggtctcagcaagctgccgggtccgcccaggccccgccccatgcccattcaggccccgcccccgacccgcaggccccgcccccgacccgccccgtccgcctccgtcacgtgatggggcgccgggtccagcctgttgctgatgctgccgtgcggtacttgtcatggagctggcactgcggcgctctcccgtcccgcggtggttgctgctgctgccgctgctgctgggcctgaacgcaggtaggttcaagcaagaggcgcaccagctgccatgcctcttttttctccaggcgtgagagtttgttactgggtttgtgcttttgaaaacatgtctcttttccccggttcttaccttgtgtaattatattgcttttgaatctcactcttttttttttttttccttaaaaaattcaaagtgctttttttgtccttttctggctctgggtggtctgagtgcttccgttctctcctacgcctagatagaagctgtgtgcagaaatgtatgatttggggaaactgctggtcaatgaggtttccccgattcaaaggccatgattggctgctaaatgaggatataaggtcgttttattttaagctgaaatctgcggtcaaaagtacccttacatcctaccacgaatgggacatttcattgagataaggccctttcttttcttgatcaaaacaaacaagataacatcttcccccacagcgatcttttttggcaaaaaacagatttgtgtttaataggatgacttgcaaattgattttcagcaaaacctctcctagtctgaagcaagcactgagaattggaactggccacaagcttgccttgtgaccttaggcaagttgttgaacagttttgttttccttttctaaaatggggatcatctggcc

SEQ ID NO: 87117 - DNA, 1083 bp, Homo sapiens
gaccagcctgaccaacatggagaaaccccatctctactaaaaatacaaaattagccaggcgtggtggtgcatgcctgtaatcctagctacttggaaggctgaggcaggagaatcgcttgaacccggaaggcagaggttgcggtgagccgagattgcgccattgcattccagcctgggcaacaagagcgagacttcgtatcaaaaaaaaaaaaaaaaaaaaaaaagtgtttcatatttattgttaaaaatccaaacattacagaaaagtgtagaggaaaaagtgaaagcccctggcctcctatgccgctgttaagtttggtttcttttttcatagccgaggttttttccttattcctgcaatgtactggggtggctaaattaccaaactataaaacaaatcatctctagcctagcatggctgtctctaccaggcttggaatttacctgtacattaggcactcttctggagagtgaaattgaacttctgtttcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcaggtaaagtagcttcccagcctggcctgaggtcaaagccaagtctcctctgtgtggctctttgcttgctttttgggctgatgtctcagcagtgaagggcggatttggtccagcagtgtgacctgggggttcggcgtgcttctgaggtaggctgaggcaatggtatagccaaggaggctaaatcagagggcgagggggttctagccttttgccagagtctctttatatttccagacggtcacaagaaggctcactgaaaactcctgatgatacatttgaatacatagtgatagaaagtgttttgaggccgggcacagtggctcatgtctgtaatcccagaactttgggaggccgaggtgggtggatcatacgaggccaggagttcgagaccaggctggccgacatagtgaaacgctgtctctactaaaaatatttaatacaaaa

SEQ ID NO: 87118 - DNA, 3073 bp, Homo sapiens
ccttcaaaaacctactacagcagacacctgggaccctgtgttatgcacgctggccatctccgcggcctcagacaccatggttgcaccctccagccacagcccccagtccttttctctctctcctatcctcctacttgtatcttgacttcccctttcaatgtctctcttgctgcccttctcacacctccccctcattcttatcgtctcttccttccctcacccctctgtggtcaactcccatatccttctccctttacagccttgccaaacccagccttgggtcactcccactgtccacctgcttagcccttacgcccaggctgcccatgggcagaactgcacacccaccctggggctgctgcacagcgtgggccccactcagggcttgtggctgttcctctctctgtgctcccactctcccggctgcacctattgctatgaatgttctccactttcctcagtgctcctcctccagcctccctctcgcattagaagctaagctttctgctctttttttttttttttggaaatggaatgtccctccgtcaccaaggctagagtgcagtggcacgatctcagctcactgcaacctctgcctcctggattcaagcgattctcctgcctcagcctcccgagtagctgggattataggcatgcgccagcacgcccggctaatttttgtatttttaggagagacggggttttaccatgctggtcaggctggtcttaaactcttgacctcgtgatccacctgcctcagcttcccaaagtgctgggattacaggtgtgagccactgtgcccggccactttctggtctttctttgtttttttttttctgtttttttgtttttgagacagagtctcgctctttcgcccaggccagagtgcagtggcgctatctcggctcgctgcaagctccgcctcccgggttcacaccattctcctgcctcagcctcctgagtagctgggactacaggcgcccgccactgcgcctggctaattttttgtatttttagtagaggtgggatttcaccatgttagccaggatggtctcgatctcctgacctcgtgatcctcccacctcagcctcccaaagtgctgggattacaggcgtgagccaccgtgcgcggcctctggtctttcttaagtgcttcctactcttgcctcagggtctttgtacatgctgtcctcttggcctgggcctttcctgtgcttggttccaacagaagtctcacttccaggagtggttgtagagtcatcccctacctccactccccacccccattgtccccaagcctcctagaactaaaagggccatatgagtgaggaccatggtcccagtcctgatgctgccactgcctgtccgatcttgtgaccttaggcacattctgggctctttctgggctttaatttcctcatcagcaagggacatggctggactgtgtcattattcaggatcttttatatgtaaattttataactttcaacctctttggaaaaggtattagaataaattctgctcttgcagtgtacagagaagccaggacaatgtggaaatttgatgcatttccaagaaaactgatgtgtgtccagactttgagtgtcctctggcttcttcgagttagtgcatagactgtctctgcatgcttctttctgcgctagtttattacatttagtacatttgtattgtatgaaaagcaacagcccagattatttgatccccgtgtgtgttaatctttccttcctgcctctccctttttttttttttgcggcggcgggggcggttggcctttctttgtttttgtttttttttctatgttcctgtcccttatttttaaaaatctcttttagcaacagggatatcatcaccacgctggtatcctcacatgtgtgggttttgctgagctagtagaaaatgatccaaagatgattggtgaccaaatgtctgattgcaacatttcgttttcctccgtggtacatagctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccaggtaagcaaagactcaggaacagctaagtaaagggctggcaatatcaactctacatccatcagcataaacctgaactgcctccagagtttaatgcctagctgatttcagagaaaactttttaattcccaagattgggttgtggacttttgtttctgtcatctctaaagttgatatttaacttgaaagaatgaccttggagtgagcattctaatcagacgcaataatcagatatggagtggtgggggaggaagacaaagcagatttgttttttctggtcattacgtgcaatagaaatttgaaattaatttgtgtgactcaaaaagcaatcaaggtagttaattctgtgtaattccttttcttgctagacagttccattctacattttctcagagtcctatggaggaaaaatggcagctggcattggtctagagctttataaggtaatggaaaataactttgttgttatggttttggacagaaaatcaattatgttacttttatgtactcacgtgctattaaatatactttgaatagggccatgtacatgcagagtacgattaaatctgtagtaataaccataaaaagtttttaaaagaagaatgaagattgccctgctagatctggaacaagatataaagcatgagtgagtaaaagaatgtggtactaacatagcaatagacaaataggttaattgcaacaggatacagaatccagaaacacacacacatatatatgtatgtgtatcatatatttgtattttatataaatatatatgatcatatataaatataagataacgtttcaaatcattggggcatggatataatgtcgataaatgttatggagacaaatacctatcactttggaaaatagaaaacttgtattcctgccttgtataaaatattaattctggatggattaaaatctaaacata

SEQ ID NO: 87119 - DNA, 2023 bp, Homo sapiens
gattgcttgagcccaaaagttcgagaccagactgggcaacatggacttagttcctgcagaactaagactacttgaaacctactttgagacactttgccttaaggagccattgaatacttttaagctaaggagagacatactcaaatgtgctttataagttgaggtccttgattctttgttggcgtgtctttcaatagcacttgtcttacctagtgatacagtatttaatagttgtgagcttgtctaaaccaaggtcaactactattctctttgaggacaggcattatgttactcacatttatatcttaagcttttgctgcctctagacccttagtaaattctcaatatgtttgtgggatgggaataagccaattggcaatatagccatttgcactgttgcaaactcattagtcatcttccttatttagctccttggcagaagctaatatctccaaactggaggagcaaataagatgtagagcagaaatgtgagggtggggaaatattttaagctgtcaaaaggcctagaggtccacagataagagcctccacctgcatacctacagcctgcctgtggggatgctgtcatcggcaatgactcacttgctggaccagtatcaggccaaattaatgtgccattagtcttaagagtcaacagaaaggcccccacacccttatcccaccttccagacactgagacatcagcccgcctcctgcatgggtacaggtgaattgaggagccttccaatccaaagccaccgggtttcttgcttctgtctctttcttctttagagagaagacagtaggtttgtctttggaaagacagaggtatgacatacttgatttgtacatatgtgatttcctttagattcggtgctctcctggggaccttacctgtacagcatggtaagtagatacacatctgcaccctctgggcaaacagcccagcagatctcttctggctgtgaccccaggaaaagagatgctggatgagtttgcctatgtggttgacactgctttttagggactagtcatccacatagagttggagacccaaagcaagagctcgcctcagggacaaattgaaagaaaatcagcacacatcacttttttccagatataagaaacacatttttccaatgccctaaatttttattacaaaaattttcaaatatgcagaaatgttgaaagatcacggtgaatacctacttaggttcagttaacaatttgctgtgtttcatccaataaacatgtggcttgtaacaatacactttgatatgtgagctcccgttctccttccttcccctctttctcctacccctccctaactgcagcaataccagattgacgttcccaagtaaagtgggtctttttgctcttggtttgcattccagtctcttctcgaagacaaaggtctggcagaggtgtctaaggttgcagagcaagtactgaatgccgtaaataaggggctctacagagaggccacagagctgtgggggaaagcagaaatgatcattgaacaggtaaaaaggggaaacactcagaggcgagcctgcttggctttttctggtgggtacagggcccatggttggtgttgtcaaacttggagtctacactgaggctccccacatatctgcaaatgattgcatgctggataataaatctcttgggtctaagcagtgatgtagtggctccttacagagtcagaaagccacccaggcctgcaagacttgcttgtccttcactaaatgtatggattctattaaaaaaaaaaaaaaaaaagactgtcttgcagaggtgagtgtgtggagaaaacacattcccttattgggacccttgccaagcaacattctgactccagagagccagaaggaaagaatgcgtaggctaaggacttgggagtgtaggcccctctgcagctctgttctccctgtaaattaacacctaggcccttggttttttccctgcagggcctgatcactgctcatatgagatgctcaccactccagggagagtgggctga

SEQ ID NO: 87120 - DNA, 1020 bp, Homo sapiens
cccaaagtgctgggattataggcgtgagccaccgcgcctggcctctttttcctttctttcttttttatttttttttgagactaagtctggctctgtcacccacactgtagtgcagtggcccgatctcggctcactgcaacctctgcctcctgggttcaagtgattctcatgcctcagcctccagagtagttgggactacaggtgagcaccaccacgcccggctgatttttgtgttttcagtagagaggggtttcaccatgttgaccaggccggtctcgaactcctgggctcaagtgatccacccacctcagcctcccgaagtgctgggattacagacatgagccaccaggcccagccaaagctctatttctttctgatccaagcagatatacaaaattaaacctgtccttggataagataaagagccatgtgtccttctgtttggcagctttgatgataggaaaatgaaacaaacagccaaataaacttttatatttcagaacacagatggggtgaacttctataacatcttaactaaaagcactcccacgtctacaatggagtcgagtctagaattcacacagagccacctaggtgagtgaaccttgaagttattaaagtccctgcctcagcctccatgcaaaaagaaacctgtttattaaaaaaaaaaaaaactttattaacatataatttgcataccataaaattaactcactgtaagtggttttcagtatattcccagagttgtgcagtcatcactacaatccagttatggagcatttctgtcaccccaaggagatcccacgtgtctgcttgcagacagttctcattcccactcccagccacaggcaaccactcatctgccttctgtctctctagattttccttttctgaacattttatataaatacaatcgcacaatagttagtcttttgcactggcttctgtcacatagcatgatgtttttgaagtttagaaaccagcttccatacaccaaattacaacatcagttcaagactg

SEQ ID NO: 87121 - DNA, 1022 bp, Homo sapiens
tcaaggtgacgcttttccttttccagctgaatctgaaaccctccctcttgctgtgcagcatccccagcagcttggtaaagatgtcctcatggccaggcgtggtggctcacacctgtaatcccaccacttgggaggctgaggcgggtggatcatgaggacaagagatcgagaccatcctggccaacatggtgaaaccctgtctctactaaaaatacaaaaatgagctgggcatggtggcgggtgcctgtagttccagctactcgggaggctgaggcaggaaaatcgcttgaacccaggaggcggaggtttcagtgagccgagatcgtgccactgcactccagcctggagacagagagagattctgtctcaaaaaaaaaaaaaaaagatgtcctcttggccttacttccagccctttgactcactatctaccagtttggttttagtttgtctttgtcagcgccacgtgagacacctacaacgagatgccttaagccagctcatgaatggccccatcagaaagaagctcaaaattattcctgaggatcaatcctggggaggtacttatatgacctaattaagtgccgtttgtacagttatggggagaaaagaggtgcaaattcagagacctgaatttgtagggtgggttttgttgttggtgatgataggttataggtaaacaatattactatccacgttttgtaggtgagcaaatagatacagagacagtaaatgacttgtcagggctggatgcagtggctcacgcctataatcccaccactgtgggagactgagttgagaggattgcttgaggccacaattaagcaacatagtaaagccccatctctttaaaaaaatagaaaaattagctgggcatggtggcatgtggcatatagttctaactacttgggaggctgaggtgggaggattgcttgaacccaggagtttgagggtacagtgagctatgattatgccactgctctccagcctgggcagcagagagaaaccctgtttcttaaaaaggg

SEQ ID NO: 87122 - DNA, 1050 bp, Homo sapiens
aggtttgatctggtttattataaggtaggcctacctgttcagaacttgaaacttggccctggtgttactcaaaaaaacaggaaaactgacattggcccaaagcacaatttattccctgagtgtaccagcctaatgagtatttcctgggcctctccctccctgtttccttggacagtagcctattccaggtgtcaattcctcattaaaaatggtgcctgctgtcatcacaagctctcaagagaatggaccacatgtgctatttatgtgtgccttacacctgaccagtcggcacaaatttctgggctggttcatccctgtttgtgaagcatctgtgcattcagtcgttgttcggtgctggagcccaagatgctctgggctgaaaggtacctcctgttttggcagattccaagctactccctctttctccttccccatgtgcaggccaggctaccaacgtctttgtgaacatggaggaggacttcatgaagccagtcattagcattgtggacgagttgctggaggcagggatcaacgtgacggtgtataatggacagctggatctcatcgtagataccatgggtaggaattgactctgagaggcacctagaggcagttttatgggttcaactggaagggaactggccttggacatgtcagtcttgcggtgggtgatgttgaaatgccaggtggaaggccatttcccattacatccgtctaccccgaccttgattattcaaagggtggggagctgcacgtggctgtgacccctcagaagcctgagcctacctgggtttgggggcccttaggtatgattaaagaaaagaacaccacctgtctctaccacaaaacttagacattttcctggttattgggcaaatgcgctgtttaattaagggagagcctcatttttgtgcgacatcacagtcgatgttgaccactgcagagtgaattaaaactaaaccctaatgactgtaaccctgaagacccaggggaaatggtctttgtggaatcctgactcctgccctatcacctaccacctgtttaatttgc

SEQ ID NO: 87123 - DNA, 1408 bp, Homo sapiens
cttccttcttccttgaacaggctaggtctagtatcattagcatgacccttaccaagaaatcaacagatcagctccaaatggagtagaaggttcttgtcttaaatgctgacttctccaggtccctgccacccagcccagtcagggcccagaagagctttcatccagtgcaggagtcattttcaggaaggaccctctctcagggatgtgcccaggtgtctgcacaggttgctgtcacagagctggctcccttttgggagcaaggtttcaggatgttgcctctgaccccagccccaggaatagcaccaggagcactaactcagatgttgtttttttctaggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaatggctgtggagcattctactttatggttgtactctagtttatttacaaaattcccagttgtttccgacaagtataataatttctagtttgttgctattatacatagtgctctgttgattcaccctgatagttagatttttttgtacctccttattttcttagaataaattcataaaagtgtaattatttagtcagaggattgccacatttccttaaaatcaaaataattagctcaggacttttaactttttattcatagctcaagatctacataaggaggtttgatgccgtggctcacacctataaacccagcactttgggaggtcgaggcaggaggaatgcttgagcccaggagttcaacaacagcctgggcaacatagggagaccccatttctacaaaaaaaataaaaacattagccgagcatggtggcacacacctgtagtcccagctactcaggaggctgaggcaggagga

SEQ ID NO: 87124 - DNA, 1378 bp, Homo sapiens
cacaagggcgaggggcggggcctgcgtcgcgctgcgggcacgtcgccgcgcgtcttcagtatttaatgtctctgtgttccacccgcctgggctagcacgtgggggagctgcggaagcgcggcgctgcgggccgggccgcggggcacagccgggggccggcggcggcgcgcggactccgcatcccgcaccccgatggtagccgaggagctggtaggtcgggggcagctgcgccggggaccccctgccggagacccgaaggcggcggggtcggggcgatggggagcctgaggtgcaggtgcagggtgcgacgcgccctccaggtaccccgggggcgggacgctccggacgcagaggtgtcctgggggctctcggccgccgcgcgctgtcaggcaggcccatctttccctccctcgtctgcgccccctctcgtccttccccgccggttgtctgcccgcgggctcctgacagatcgcgtgtgcgcggctctgggcggcgctctgcggccgcgccgtcctccccacgcgcgtcactgtcctcgggggcggggggcgagggcgcgacgcccgggtcgcctctctgcacctcaacttaaccggagcgtgcacacccgcctgcgaggctgacccgagcgcgtcccacccaaggtcgcccagccccgcgggcgtttacttttcaaaggtcgtgtgtacacagtctgagccggagctgccccttcacttctggagcctcgcccaacttctcaccctcggctcgcccgccggcgcagcccctgggagttccgtgcggcgagccaggggaactgggaagatgggccgggacatcggccggttgtgatccaaccgtgtttcgggctgagggaccgttcgaaccgaattggggtctggaggtcggaggctcaggggcgtctcggggggaatttgcattcgtagcccctgcaggcgtgtccggaggggtggaggccgtccagcctggggtgtctgccgacctcacgcccgggggccccgacggtcacgtgtccggccccgcctgcggcccagggcccggggtctgcgatctggagggaccgcgccagttttggggttacgatgtgctaggagaggcagtggctggatgcctcgaacgcgggctttctggcgttcaactcttttgtgccctagctgaaggtcttcctgtttcccttccagggagggataggagaagaaaggtgctgatcgtggtaggcggtgctgtggcgactcggaacggcatgggagccctgggcgtttcgggatcttcctctcctgggggatgtcctgggtggcggcgccttcctgccgccgttaacacaaacccggtggacttcgctccaggtgcgagtcgaggcctctcaagctgggta

SEQ ID NO: 87125 - DNA, 1437 bp, Homo sapiens
gctgctggacctggtgcaacagtatctgttagttactgatcaaggaacaccgttcacaaaaagctattaattctggcaactagtagccttacaagctcttgtaactgctaagtccttcccaaattagtaccttttttttttttaactctttatttagaaagcaaagcttggactcttagcaccacccatccactttgctcttaaaggtacagaacatctttgaaatgaagaaggctgcctgacttgatcatttatataattcctctgatcttggcattgaagtggttcacctgctgattatttaagaccctgagcactggaagcaagtgaagttatgttttgggaaccttttgacttgtgttgaacttttctttaacctctaactagttttgtaggttctgcataattcttgggtgtattctctttgaaatatggccctaggttagaggaggtcctctggatcctacaggcatgcaaatcactaaagcttgagtccattactggattaataggctctgtcttcatgcatgttgtcagatgatggctcagaacttgcaggtaacagatcctagccaatgagtgagacaggtctaatggatttgtgtctaggtctagttccttgtaggaatatctctcccatctcccagttgtttctaggaaatgcattctcacttggccactgcagggtgacagtggaggtgtctgttgtaagtggcctgctcaggtgctgaagtcgatatgtctccagtgtaaggttgctgaacatcaatatttaaaagcaatttatcttgctgcctggtaacccaaattattcttgagctttggacataggctgggttgcagccatattttaggggaaggctggtgttagcctctacagtattcccttttcctgtcctaaagacaaatggagatcatatttgtgatactggggactgtgataggtgcttaagcattgctcttcccctctcctccctgaacaatccctgagactgactttgtttctcttgaattacttgagtgacttgaattctattaaaagcacccctctccttagcctctgacccagaagcttgtttgggaggaaaaacgaattggtttccctaagctttgctggctagcctcctgctcccagcctgcaacatgacttgattgtgtgtgcatttcagggctttgaagagcaggcagcttgtagccaatgtacccagagagctggccgtagagttcccctaggtcactccttcctaatcttccctgtgagtctgaatgattgggcctttctgtagcttggtctgttttcctattgtggggaagtcagttgtttcaggtatgagttaataccttcagcttgtcattctcaggcgttttcttccactatggggaggtagtagatcctgtgggcatcttgtcccattgaaatcatctcatatactgttt

SEQ ID NO: 87126 - DNA, 1072 bp, Homo sapiens
atctcagtgcggcccttctcttaaacgaggttgtgttttcattctgctgtttccagtccacctaaatgttaggggccattcttcacagaaggtgttgggggagagtggggccacagcgtggatgctaacgtgttctgttgtggcaggggtggggagttctttgtttccagatgccccctcttctagtcctgggtgtgctttgtttgaaccctgctagattgacctttggtatatataatgtgagatctcttttcttggagccaggcagcataaaggacacttactgatgagcacctactggcatattagtggcttttttttttctgtgtcatttttattctctgtcagccctatgaggttagtacagtgattagtttgtgggtgaagaaacaagatccgagtagagtaaactggtccctggacacagcaagggctggactggcttggacctgggctggggcgtgctccccacctcctcctctgcccctgccgccccccatgctcattggttgttgcttatttactgcccctttatcaccacatcctcattcaggaaactaaactgggttttacaaagattaaaatcattgatcccacatatggagtctgacttaagtgtgttcagcctcgttacaactctgtgagggagatattccctattacagaacatcttcattttatgggaaactgaagtacaggatcctactcttaactctcttgtctttccaaagccatattttatcatcagaattatgcaaccatcgggtgcttttgaaatgcacaagtaatgactatgaataaaaaaagctgtgcctgagggctcagggaaactgctctgaagactgagctgattgaaaaagacaatcctgaagtcactaatttcccgacacctgtcagacctcacttggaggtcacagaccatctcctggccctccaaaggctgtcacccagcagtagctggcctcctgattagaggaggcagtaagatcttttcaagcacagccccagcccccatcccttctctggcctgggcctggatgtgcctttgtgaggttgggtcgatgacagatct

SEQ ID NO: 87127 - DNA, 1183 bp, Homo sapiens
tttttgtagtgatggggtctcatcaccttgcccagacccatttcaagactcctaggctcaagtgatcattccatgttggtctcccaaagtgctgagattacaggtgtgagccaccgtgcctggccccataacttcatttttgtgtgaagttgcccagcctaaaggctggccactaaatggacacttaaaaactctctaatagtgtggattggtgggcagtctgattcctctggcttaaaccaaaatgcaaacatgaaaggaggcatggccatagacccccggtgagaattctttactgtgatgacacagaagctgaagagggatgaaaaagcagtttgaccagcaagcttgctggttccctaggccaccctttcttctctccttttcagttcctccttccctctaacttggagctgctaactccagcccatctaactgtttctgattaagaaagcttcaagccttataaggccctctgttgcctatggtttatgttggctggagagcaaggttgttttttgcaaagtctgattcaaagaagtggcaagggcttacgtaggctgtgtgtgtccgcctcctggggctggactgccttattggaacaggttcctttgagggagcctgagagtaaggggggcttattatcccttacccttagtggtggctctgtaaggctaatgtgtggtgtggccacagggcttcctggcaagtgtattcgctgagaacttaaaggtaaaagcaagcccctgtttacctacacagtgtacctgtcatgctaccagccacagaggcatcctgtttcaggaatcaagtctggaagcagcttctgcttattaattaagaactaaagccccttggctcttcaggcacatcgctttcccctctggagaaagtttggtggaccgtgtcccttggggttcttgcgagtccgactggccttccgcgcagtgatgttggagagccctttttctgagagccatgctctgcctcatcttcacctcccctcttgctacctcttgagtcagccaagcctgttcctgccttaggactttggcacatgttcttcctgcctggaactttctccccgctctcctcctgcttccccccagatcttggcacagttctcaagtgttccagttctgatgccacctcttccaagaggcattcccgcctcattctgtct

SEQ ID NO: 87128 - DNA, 1116 bp, Homo sapiens
gtagctgccagctgcaggtggagagttcaagttaacctaaagtagaattcagtgccctagtcacactggtcacatttcaagtgctcagtaacctcccatgactaagtggctgccagtattggatagcagtcactcttgagggtcaccgagacctttacctcttgtgacctactctactttaccatgttgcaactgctgcgactatggctcctgtggcaaaggtcaaactctttgtctcgcctgaccagcacttcagctcctaggatttcttcctgttttactttgggactcactgttccctcccatgcccaaagatattagaacctcaatttatgtcctgtccccctccctacccacccactgcagcctaaggaaatcctggccctctttgagaaagccttcctgggctccctttgcccacttctcagctgcttgtggcgcaggggtgtgtgtgtgagtgagtgagagagattgattcttccatcagaatcgtgtgcttctggtgatcagaatcttctgcttatagcaacttaaacatatttgaatgaatgagcaaggtgaatgactgtgacctgatgaggaaataggtaaatgcatctgatacaagccaagaggcgcttttggaatcttgcggagaactccgagtttgtgattttcctcgaccaaactcccatggaagggagtatgcctctgcctggccacagactgctgtcattctctgaatgcagtggctgaagtgctgggctttaggttctgattccctgcccttggaagacccccttcaaggggaagagtccctcagcaggaacttaatgagctgggcactctggaggtggagtgtcttgggcaggctccttcctattggtagaacacctggggacagcctttgtcagtgtgaacactggaataatggaagaaatgttcaaattccagtgtaaatgttcattcagaacgcaaagtggatgtggcttcactgaccaggcccaagcccacattgggcttgttgggcacttggctcctaagctgttgtttttatggtggactttcccatcagttacatgcggctctttttgcagtcactgcagccaaattggcttagtcactgggaccaacact

SEQ ID NO: 87129 - DNA, 1451 bp, Homo sapiens
cagtatgcatctattcccaggcaaatggacctgctaaaaataagcaggcagctatttaattccaacagattcaaaatgacagagtgtcctccccaccaaccctagggcagggctctgcagcatccttctgggaggcttttctctgactgcagacaggtctgcccttagtcctgggcctgggggaggagccagcctttgattagcttgtgagtaggaaggctttggggactactgtgataccacttaaatgttgagaagttcaggtttacaaaaaaaaacacctcagggcaaagagagcaactccgaagagtctggcccagtgcaggaaggaagatgtcagaagagccttgtaaggctaaaggggtatgtgtatgtatgaaaagaggtggcactacctgggcactcaggaaagcctgatgcattttataccacctcttgtagccctgtcggaccacgtaaattgggcaaaatggcatcttaccaattccaagaagtctgtttgactgaggtgagagtggctcaggggtgagggagtgaggggctagctgatttttttttttttttttttgagacggagtctcactctgttgcccaggctggactgcagtggtgcgatctcagctcactgcaagctccgcctcccaggttcatgccattctcctgcctcagcctcccaagtagctgggactacaggtgcccgccaccaagccccgctattttttttttttttgtatttttagtagaggcggggtttcactgtattagccaggatggtcttgatctgatctcgtgatctgcccgcctcggcctcccaaagtgctgggattacaggcgtgagccaccgcacctagcctagctgatttcttgactagtgggaagtgggggctggtagaggggcatctgtgaggtgtctcctggcaatgggtgcccttagtgagacccagccaaggcctgctgatcccagggtctcttggctctgttcttgttggaggatggttcacatctctaggcacaattccctggtaacaaggaaaaaaacacatcttccactctgctcttcggggatctggtaatctctgttctcaagtgctggtggagcgcttcaagccaggcagtttctgttcctggaagcaatggtgtgagaagggctttatcttgagccactcactgcatagaagcagtgacacctggttcctgattgctcagccttgggtctctggctctagtccagagtgcggggtgaaggctggggagagatgggcactgggaatttaggtgggacatcctggattctgtgggttgggtgaaatgggtagcagtattcagtgccttctaggaggccatccctggcttggaaatgttgtagaaaccatgttttccaggcagtaattcttcagtagctccagtgactataggggtgactctagaggtggtggtctgagggcttagag

SEQ ID NO: 87130 - DNA, 1122 bp, Homo sapiens
aaatggttagaattagtgagttcagcaagtttgcaggatacaagatcagtgtgtagaaacttcccctctcctacaactgaatggcttgttgtgtgtccttcccagtttttccatgggattatgtgaacatagacattccatacacatggtggtctgtacctttttgttttacgtatccaggtgattttttccatgtcggcacatgagatcaacttctttcggtaacatcggtatgtcagtggattccataatctacctagcagtgattcccctgaaatgtttgttaatcccaattttgtttcaaatgatgcctcagcctgtgcagaggtacgtgggttaaaaacattttgaaaaaaaattttttaagggactagtctcactgtgttgcccaggctggtggcaactcctggacttcagcgatcctcctgtctctgcctctttaagtagctgggatcacaggtgcttggctttgtggatttttctttgttgtggttttgtttttgtttttttaatttaaagatgccaagtgtgggatttcagagttgtaggatgtggttatgagcttttaagagctatcataaggctctccggaaaggtagtacagacttccccttttcttggctcatatagcgcctcttccccacagttctagaataatgggttccagatttaatgtgggagagaatttaggtacccatcccttggctgtatgccttgagcttttttttttttttgagtctcgctctgtcacccagactggagtgcagtggcactatcttggctcactgcaacctctgcctcccgggttcaagtgattctcccgctcagcctcccgagtagctgggagtacaggctcccgccacaactcccggctctctctcttttttttttgtatttttagtagaaacagggtttaacatgttaaccaggatggtctcaatctcctgacctcgtgatccacccgcctcagcctctgaaagtgctaggattataggtgtgagccaccgcacccagcctccttgagctattttaaccttcaagatagtaattcatttggctgggcaccgtggcctgtcatcccagcactttgggaggccggctggcggatcacctgaggtctcg

SEQ ID NO: 87131 - DNA, 5247 bp, Homo sapiens
atggctccagctctaccctgttgactgtcttgcatgtgcggttgccagtatcctcctacctggctctgtaacatccctcctccccgctctcctgctctccccaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggtaggagggtctcgggttcgtttagaggatggggcgctcccagtatttcttggagaaaggctgccagtctgcctctcccttctgctacttgtgcagcaaagtcatagtgctcttcagctctttatcgcaacctgcagaggtctggacacggcgtagagctggtgggtaactgaggagttagattgccctgaaaccccaagtcatgggagctgtaacttggttcctcaaccggtgaccttccccagtgagcccttcccaaggaactagcgccaagttgggctcgctgattaacattagtgtgcctctttttctttgtttaaaaaaattattattattttggtgcagatggagtcttcctttgttgcccaggctggtctcgcactcctgggctcaagtgatccttccgccctcggcctcccagagtgctgggtttataggtgtgagtcactatgcccagcccatttttttttcttttttaaacactaacctctttgtgtgtgcgtgtgtgtgtgtgttttaatggagaggcctccttagctttacttcccttgagtgccaggtatgggtgtgagtgttttgaatggtttttatttccttttaatcatgtgcttgttcccatgtcttcacctgctttccttctccagaagctcttacagggtaagtgcccaaagaacggccacagctttgaatacttgtgggaggcttgagcttcctgagttgtcgctgtcacctttgcagaaagcctcagccattttctttctgtgcagttgcagctccacccccgggaaagcggggcactttgataacgaggtgtcctgggtttttcgagtgctgaccccagcgtagacagttcagaccgctaacttacaggtcagcagctcctgaccctgcttctgcaggcaccctggggtgttttcatttatctcatggagagaggccacgaatatcccgagtggctctctgacttgtttgtcctggagccattccctcccatttcagctccgggtaggttgggaatctttattgggaattttaccactttcagcagcatctagtttgtaccacacgctacattttgtcacctccaagatgctgttaagacactactgtttttatgtaccttggaaagaaaaaagtgctgccagtcatgattatagaaggcaagatactatatgatgcatcctaatctcgggatgtttaaatgtttcttaaaatactgcatctgaaaatgggtgatttttattttatttattttttaagaataaaggagtttccctttgcttactgcccctcagctgaattaacaagccccgcagccttgtctgccaactctagatggatagtagtagctactcagacctgttgaagtcttctgagtttaggcttgaacctaagccgtggtgatgggcagggaggtttagggatggcacgtggaaatgaggtaatactgtccacgagcatgcggtgggtgccaagcacgaggttagtgcctcgcatgtaccttcatgtcagccctgctttgtttgtgaggaagttgaagctgagaaggggaccagggaccaccccactgagggagctggaagctggcctttgagtgcagcctgctagagtccgggtgtggttctgagccactgctgggagccatcgggatggcaggtgttagccagtcccattctgtggggcagaggctggatactgtgagtgagcagagctccccgccccctcgcccagcccctgtcagcctgttatgcttcccgcaggctagccaagcagtcttcccccagaaggggtacttttccctgcatgaatcctgttcgaagcgcctagtgttaaggggggaagtcattttgaaggtgattcttccttagctgggagcaggatctcttgggccttagttctctgcatccagtgtatgggttacttggcaaaggattatactcagggtttggagaaaccatgtggaaggtaacctaattggtagactctcaggagtgatctatttctggtgattgagtcatccatatttaagccagggccacttctcttgagctgatctggacccgcttttttgtgacggtccctttggcacgctcttgagtgagagtggaacagcccaggtcgggagcagagtctgttcccattgggttttcttgggcatgagctttggctcagtcttttgaccaagggagtatttgagccagaagagtgttcagagttgcatgaatcaggcctaagcaaagggaaaggagactctccttttttagtccacatatggcagaggaacgagcgggtccccgctaggtataagaatggggccctcaggcaggccagtgaggactttgtctagctctgctgggctgaaggccagtacctatgaccctgggactgggccctggggacaggagactgacccttggtctgagggggtaggatagttggaagggtgtcaaggtgtttgtggtccatcggtctggctctcaggaccatgtggacctcaagcgtgtctcctcccccgccctctgggctccccttccctgggcgcagtctgtctcttccaagttcaccacttgtgtctctgctccagcagctgtggctgggtgcggctgccaattaagcaagtgggactgtaagtgacaggctaaaattaggtgtatcgacacccccagttctcctttcattggggttgttctgagccttctagactgtaagttgacagtcacctgccaagcttgaggagcgggtgtggggcagggcctcctgggaatgtgagtttgggaagttcttggttactggctgctctgagtggggtctgtgtgtgtgcgtgcctgctgcttcttcccctgcaggttctgacaggaacagcatggattccgtggatagctgttgcagtctcaagaagactgagagcttccaaaatgcccaggcaggctccaaccctaagaaggtcgacctcatcatctgggagatcgaggtgccaaaggtaggggcggagtcccccaggctggttctgtggtaagcccaaagctccctggggccagggccattagacctcagggagggagggggctgggagagggacagtaaaccagaaggagccctgggtcagccaaaggccgcagggaaaggacacgctacactttgccaaggctcagagagcttcctgcaacatggaattcctccagctgcctccaggagcatcttattcttgtacttctcaaactcgcaggcctgtgtgtctcccttgggggtggttcttgcatattctggggctcagatctatttggaaaaaaaacaccaaggccgtgggggccagccagaatcccttcactgagctctgctcaagtgctccaagtgtattttataattgagcaaagcataaatccatattttagagaacttgaaaag

SEQ ID NO: 87132 - DNA, 1808 bp, Homo sapiens
gagcccagggttcttagaccttcattttcaaatcgagcccctttatctttggatctgagtagacttgagggagaggggcacgagaaatcgagaaactgtgtgctggtgaaacttctcagcatggcttttagaggagaagatgctgctgcctttgcagctttccgggtctgggccacattgttgggatgaaatgggaactgcttggtcctggagccagactgcctggttcgacttcctggttagcagctgtgtgaccttaaggtagttacttagcctctctgggcttgtttccccatatacagaatggtgataaagttatctgtgtttcacaggtactatgagtaaatgtaagtgcttagaatagtcctggaaaataaatgctgacatggtaacagctaatatgtttgagcatgatcttgtgtaaaacagaagtaggtctttgggtgtccagggaattggtttccctttaaccctctcatctctttttgtctttctggaagcacttagtcggtcggctaattggcaagcaggggcgctatgtgagttttctgaagcaaacatctggtgccaagatctacatttcaaccctgccttacacccagagcgtccagatctgccacatagaaggtcagtaacatctgctgcttgtattgcctcttacctgaaatattaaatagaagtgaatagcatctgagtttcaattgctatctttttggaataggaaaccctgcttctcatcccagggaagggagcattaggtatcttccctgcagccttttccccatttcaggtgcctgcgggagactcaggtccctccctactctgatctttggccaggagaagtgtgggtgcttggttgggcggggcctgggtcctgggttcatagtgcccaccaccccataaaggcttctctcaaagcagaagtgccctgtgtgcaattcccccttggcattttcacagctgcctgcctcttctgttgcattgaaagcatggatcataatggcagaggtatcatttgaaaggcttagatgcctttcttcctaaagcagagcttaagtgttttgttacctcaaagatgcacttgaactctatgcaaagtccagtggagtggggtctgtggctgtgtttttgtgagtgtgggtgtgagtttcctcttacagtgattgtatgtcctgcccccatccgctatttaggctctcaacatcatgtagacaaagcgctgaacttgattgggaagaagttcaaagagctgaacctcaccaatatctacgctcccccattgccttcactggcactgccttctctgccgatgacatcctgggtgagcgtgctactgggtgatccggacttcttgccactttcccccaaacctaccccaaacaagaaactccccagacctcaggctaagaaggccaagtgcacatgagtgcctgcgccctctcttctctggcctctgctggtcggttctgctatgggactgtgttctggggacagggcttaggtggtgatagcgctggcaggaaaccagaggcctcttggtccccacatgggaggactacttttcctggctctccccctgggcaccttttaagttttctaggcgtttgcttagaaaggatggtgtagttcggacaggagattgggtgtgtccagggtcgccgttcaccacctgagacctgggtgggactagaatcatgggtttggatggcgcttgttctttcttctggttgagtcaggccttaacagtggccctggtgaaggatctccttccccttcccctccccaggaggtgcctaaattacaaagaa

SEQ ID NO: 87133 - DNA, 1041 bp, Homo sapiens
gctggagcacaccctaggtatgaggatgctgagatctgctgcacttgatttcttcagggactttcttttaaatgtaaggctggccctggcccccattccccgagtgctatatttacttggtttattcctattcatctgtgtccctcttgggtcccagaagttttggagtaatggatctagactgaatgcttctcagtctggatggcctcgggggcggcacacttgctaggctgaacttctcacatccaggtttttccctcggctggtcttgggcttgggggaggctttgcttggggccggttgctgttcctgtcccctgcactgtggaggttgcaggcctctgagaggtaacgcagggaggtgggtagtggccaggtggcccttggtgccctgccctggcccaggcgttccacgcactctgctccctaccctgcagtaacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtgagcggagatgcctcaggcaggcctacgccctgcttgttctgggatgcgtgatctctgcgtggctggctcagttgtgccagggcttgggtgagggttacttcttccctcctgctgcctactgtgttttagcagagtctgatagaaacaaactcgattactcgcttagccaaactgagctagaaggcctgtattgtggaagaatccccagcatcatccttcaaaagtgaagctgggccaggcgtggtggcctgctgcaaatcccagcgctttgggagggtcacttgagtgcaggagttcaagaccagaccgggcagtatagcgagacctcatctctacaacatcaacaaaaaaggaaaaaagtgaagcaggctcctttttaggaatttgtcataggaagtccctctgaggtcaggcttgcagcagggtcggctggctgtgtttgggtgtgctg

SEQ ID NO: 87134 - DNA, 1045 bp, Homo sapiens
cttgggaactgacctttcaatgccttctttcctgtggcttggccctggattgaccagcagtatttaaggaaaggtgcatgaagtagctaatacttgatattagtctgttctcacattgctgtaaagaaatacctgggactgaataatctataaaggaaagaggtgtaattgactcacaattctgcgggcctggggagacctcaggaaacttacaatcatggcagaaagggaagaggcacgtcttacatgatgggcaggcaagagacagtatgtgaaggaggaactgtcagatacttataaaaccatcagatctcatgagaactcactatgacgagaacagcatgggcacaccgcctcatgatccaatcacctcccaccaggtctctccctcgacacatggggattatggagatgacaattcaagatgatatttgagtggggacacaaaacctaaccatattattctttccaccccccttcttcaggtgacaagttacagtccaactggtcttcctctgattcagctgtggagtgtggttggagatgaagtaagttctgcccttcttttccttctgtgttgctggcccgaagtaatggattgattaggagctggtcctgggatttgtttcctcttgagttaatcagaggatataactgtagacaagcacctcctagggaacactttggatgtcctgattggcagtggtgatgtcagtgtcctctagtgggtagaggccaaggatgccactaaacatcccatagtattcaggacagccccccacagcaaataattatccaaccgcaaatgtcaatagcgccaaggtggagaaaccctgtgcgagactttctgggaccttctgtctgttgagtttttctgtcctctatcttatggtatgaaagcttagatttcttcagcatattaaaaagcctatcctggccaggtacagtggctcacccctgtaatcccagcactttgggaggccgagacgggcagatcacttgaggtcaggagtttgagaccagcctggccaacatggcgaaaccc

SEQ ID NO: 87135 - DNA, 1551 bp, Homo sapiens
gcctcagtaactgggattacaggtgcctgccaccacacctggctaatttttgtatgtttaatagagacggggtttcaccatgttggccaggctggtctcgaactcctgacctcaggtgatccacctgcctcagcctcccaaaatgctaggattacaggcatgagccactgcgtctggcctacactgttactctcatacatctgttgcctgcagtggcaaccggggaggggagaactcatgttggctagggagatggccccaggatgccatggacaaaagctttaagggaactttcttttctaggtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatgctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaaagtaactcattgaattaacttgcagtggtgtgtttgattcttttttagactggcttcagcattgtgcagtttaaaaataagtaagtaacttacataaatcttcaattgtatgaactgcagctttgagtccatttttttccagtggtgaagaattggcggggggggggtggtgagtgtggcgagctggatcacaggccccacacaactgcctctgcaggagacccatggttttttgaagacaatttggccagaaatttctatctggcc

SEQ ID NO: 87136 - DNA, 2714 bp, Homo sapiens
gggtgaggagccgcagcaagctccccgcgcctcccctcccccgatccacccgccccccgcagcccatgtgatccagggaagtcggggtgcgctccccctcgccctgcgccctgccggcccggaggcggggtcccctccgcccgcggggttcgcgcgccacccttgtgggtccggccgtggggggccgagtgtgcgcgcgcgggcaggcgggggccgcacgggggtgcgtgacgtcaccggcattggttacacgacgttctagaactccgccccacgtgcgccggggaggagggggaggaggaggaggagatgggggtggggaggaggagggggagaggtggggatgggccgggggggcggggacgggggggtgtgcgaggcagcggggctgagctaagccgagcccacgtgtgacggctctcgccgctgccccggctccgccgctcgcagagagattcggaggagcccgggcgggggggaggaggagggggaggagggagcggagatctcggggctcggagccggccgccgctccgctccgatcgctgtggggcttggttttttgggggtgggggggcgggggggctcagatatggaggcaaatgggagccaaggcacctcgggcagcgccaacgactcccagcacgaccccgggtaagtttccagccgctgcccaccgcgccgccttgggctcgctctccttgcagcggcggggacggcggtgcgcggagccgggcatctcccgcgcccccccgcctctcccgcgcgccccccccgtggaagttacacacctttggattgcatttcgccgtcaccttctcccccaccccacctcccggctctcgctcgctcgctcccccccgctttccttttagcttttgtaagttacacgtcaaaatggccgatctgacatcggtgctcacttctgttatgttttctccctctagtaaaatgtttatcggtggactgagctggcagacctcaccaggtaagggagggagggggggacgcctgggtcccccccttcttggcttctttattgctctttgttatcccggtgtaggagcccccccccccccgccattggctccccacttctcctgtgcaaggttattttttttaaatagcaaatcctttctgagccctctatgcgacctctgttgccgaatttcccccgcgtgtgcaaaaaatgcaaaaacaaaacagaataacaacagaaaactacttttggattttgtccttgatcaaaatttgcattgctttttttttccacaccttctctcccccccccatctctctctttctctctctacagatagccttagagactattttagcaaatttggagaaattagagaatgtatggtcatgagagatcccactacgaaacgctccaggtaaaccattcccttctggattttgtctttattttagaacaaagtttaagttttatttttggaggtgtcttcggaagtagctaagcggattagaatggggctcaggcgcgtggctgatctcgaacggcgctctataccacccccaccgccccctagtaaccccagaggttattgttaattggagctgaactctggatacagagatacccatctctctgcttttaagtcattttcccgtcgcttctttttctctgtttaaaatgacattcagcttcatttactttcgcatagtttttttttttcttttgatcttaatgtgtgtttcccccacactcccagctccccaaactcttaagatccctcttagaaagatggtggtaaatctcttctaagtgccgggctttcttcggaataaaacaaagcgttaagaaagggaaggggaggaggagaggaaactgaggtggccaaagagtggaggcaccagcattttccaagttacctccaccctccctgcccccgttccacttcccccgttaaccttgatgttttttcttgcgaggtggagggctgtaggcaggaggggaattggaggaggggagtgggaggtgggggtgcgtggggggcaacttttgctcctcattcagccttaggtctcactcctggttgctttcaatggtgtcacattttcttgtttgtttttctccctctttgtctcctttcagaggcttcggtttcgtcacgttcgcagacccagcaagtgtagataaagtattaggtcagccccaccatgagttagattccaagacggtaggttgctttttgttgttgttgttcgccccttttcaggaacgatctgggcattgacagccccatttaaagggacagtgccttcttttgcttctgtgctagaactgggtagttttaaactgagctagcgagttggctcaaaagtttgctgctgtggctggctttggggttttctttttagagcctgtcccattgcagcttcagaggctgccaaggttaggcttggggaggagagggttcggctcctggagagtctgccttcccggcctggggactgtgcagagaaactccaccagagagcaaatgcaacttttctttgtcagccaagcacagcacgcgttaccaactgtggctgtggggatcagctttgagaaggcacagcctgctttgtggccaagggggacagcagtgggaaggaggggagagggcgctaattacaggtccaggcaacaggtttctcttggggcacttgggatttggaatgtgctttgggaagggaaggggacgctg

SEQ ID NO: 87137 - DNA, 1059 bp, Homo sapiens
atttcgtggctagccatttcaaaaagctagtgaaattaaagaggaaaatcttttcaaggcaaatttgggaatttatcatccaccccctcttgctacctgggtgggagaaacagtatttggtttctgtggtggctggtgggtcatattcctctgtatcaggtgcaaagcctgcagtttccctctctgattgtttatagacatgttttggtcactattatttagtgtaacctagcttttgactttgtttcaacgttcagtgcaggaggcagaagcggttggtttattgacatggaaacgaggatcttgtttactgttaccttaaaagctttgtttaggtaacggccattcacatccaaaatagtaccctagtcttttcctagaggacttgtagatacagtaagtagagctgtacctaactaactaatgttttaatttttggtagttttcttttttgtttgttttttaaaaaatagttgacagggatgtgcaaaaggttgggatttgccatgcttaacttgacccttcctctccttcagagatctcagcgtgtaaactttgcacactgaggaacttcgatcatgatataatgctctgatacggccacacaccatccaggagttctgaattggctttttcgttttgtgatttaaattttctttagtacttcactttcttcattgcaccttacttcttccagctcctggcacctccctcaacataccccacacctgttaccccataaacaaggtgatttctgattgcaattgtgtgccggccaactaaaaaaaacaccctctggggagtatttataaaaagacacctctgtcttacgtacgtcaacagaatggaaaatccacacctgttgtatttctcttgtagacaagcgctagtcagtgctggacacacctgtagatgcagtaatgttaatctttatgaaagggtagttttctagatcagagatttttgtctattttagtttttgaaaagtaatctctcatttctcaggtgatgtttaaaggtagggaatgcaatgcagacttttattaggtctttaagccc

SEQ ID NO: 87138 - DNA, 1022 bp, Homo sapiens
gaccctgattgagcatcatgcgttttgcaagtgtgtgatttggactggaggatgtttttccactcggattgaggttggggtaggggaattccctacttgttgcactagattctgactacttcttgtattcagtaacttttttttttttttggtgccctccccatgatgggatttcttttctaatttgggtttaggttgcttatagatttttactccctgttgtttttaaaatccaggtggatttagctcacatgcttcattttctttacttcaaaaaattattttttatcttttgaggtatagctacagaacagatgatctttttggttaatcctgggtaactttacttttgctaaaatgaattaattaactcaagcagagcactgtgttggatgtctgtggggagtttttggatgttgttgatttaaaaaatttttggaagctcctttccctcctgtgttgtttagttatcatcagggagaagaaataccatccaattacctactgctagagaatacttacatttaattttcaggttatgatttttttcccaatgataatgatgctcccatcttttctcccagccacgcatagcaaattagatgtagataccatttaatattcagtgtctggaagaagaagcccttgcctaaataagaattacatgagatctggtttattaagagcatcacacactgaaatgcatggtgggtcatttcagaaaggctagctagctatgttagttacctgatctgttggagggatggttaaagttgagatcaaagtttaagaaacttttgagttgcctgagaagttactaaaagctggattataagcctgagaaatgagtgattaataattaggtgattaatcatatattttttccttaaagtactttattgactcctgcttttctattttttttcccagattgaccccaaagttgcatttcctcgtcgagcgcaacccaaggtaagtaggagaataaacagtaggattttagcactcagagatgattgcca

SEQ ID NO: 87139 - DNA, 2019 bp, Homo sapiens
taagtcagggcatacttgaaaccaacagtgcttcttatttgtgcaagtgctggtgcctgggtggagaagtcctgaaaatgttgtaaccttgtaggagtggcactacaagacttgcttaaagaattgagatagggcttcacttttttagaagtgtgtcgttaacatagttttcactgagcttgccaggtgtggctatgagaacacagttgcttgaagcctaaggttaaattggaagggcttatggcttacatgttacatttacactttttagttactatttttcttccttatgtagcactggaagaaatgctttttatgtatcttcgggatttgtcattcttttagggaaaggggaaaagttgaagcttctaagtcggaaaaggttgtggctttagcaaattcagtttatttctttatgcacagtctcccagaagtggaaccttttaatcgtgtaaagagaggaatggttttgcacattagtatagaaaaagttggtgattgtgatggtactttgagaatttcaggtctggggcataccacttgattgattgattccttccttccctccttctttctctccctccctccttgttctcttctcccttttttaaagatggaaacacaactttttaagtaaatacaatgaaatattttcttcaggcatttttttgtaatgcttaagcaaatgataggaattaatgattaggttatttttgtacttagcacaaactttggaattgcccttattgttttagttacttcccaaactgtctgtgatccttcacatttcagagggcttcccagagttagcagtatttcctgggtttggaggaattgctgtttcttccataagtgtgaatcttcaaatttccaggttagtcatttgatcactcagagcttggatcagattacccaagagggaagctggaaaaatcccttacttggtaaaaccatgggtttgacctgtttttctctcccctttgttgtcccccttccttaactttgtttttaaatgagaaaagcaatatttcactttaatacactctgcagtgatgcattcaacttgaaaacgagacagaatgtttctcaaacttgtcaaagtgtgcattcctttcccaaccctcaactccacatctggaatgtttgtaggtgaattaacatgaaaccacttgggggagaacatctttccatgaattctagggatttaataataacaccttactgtgtatgacatacttcactttacggaggacttggctgttcattatctccatctgaattccatctcctggggcatttggctgttgtccctaaccttctctcagtctcagtgtgctcatctgtaaagtaggagtgatgacatagctctcccagaaggtttttgtgtagagtaaaagagcatggtctgcgacaaaggtcttcgtcattgtcattatttttcttgtcggttttctcatcattgttccggttgttgtttgcaagtgggacagcctgggttcggatgctggtggtgccactccttagctgtgtgaatttgaacaggtcgtttaacttccttgaaccttcgtttttccatctcatagagtttttctgcagattacgtaaattaataaaggtaaagggactgaaaaaaaaaagacgttgcatggtaatgccatagaagcgttaacctgctatcttatttatttatttatttatttttgagatgggatctcactgtgttgcccaggctggtcttaaactcctgggccaagctatcctcccacctctgccccccagagtgctgggattataggcgtgagccactgtgcctggccaacctgctatttttttctgccatttttattaagtcctcacatcaatcctgtgagaggttgagtaataataatgatactagttgaatttatatgccaggcactattgcagagactttattaatccatttaattctcatgcagccctatgaggagagtactagtatgagctcattttgtaaatgaggaaacggaggcacagatg

SEQ ID NO: 87140 - DNA, 1263 bp, Homo sapiens
tgggcccttcaccactgtgccatgctgtgggggtacctcaggggatggcccctctgctatgcgacaggagatgggctcggagaggtcagcgggctgtgctgagggaaccatagccagaggcccagtactttgaagttctgcgttcctgggcctaggtgatttgccttgccccatcatgttataccagtgtgtgacactgtcttgtatcttttgatctgacccctcaggccatcttttcagatggttctggagttactcaaccccagtgaggcaacagagtaaatgccaaggttgtatggtggttgggaattgggacagggtggggagaaagtgtcttccctgtctacggttattttccaatagaatttgagcctggccaccgggatttcagactggagttagcgctgggggccaaaacccaggagcatagaactttaagtcgaccctgatttatttatcgattatctcccttcaataaaacttctgtgtttttgtgttcaggtcacagtggcagagggaaccctgcccctcctcgtgggatgggcgaggagcttgtaaatgatatgtcagtgtgtgtttcagttaaaatgagtttctctgctttctggctgtccctccttgctaacgctcgccagagaaatattccgtggaggtgttaaaacaagactagtggaaagaaatggtaacttaaaaagaaagaaaatccatggcagtgaagaacagatttcatattagtactgtcataatattctctaatgtatcatataaataaaaatctgtttagaccagaattttaataagtcaccaaaggaaggttttgaatcctacagtttatgtatccccctttgcgatgtaaatgttcacatctcaagtgaagtagagtggggagacgcttcggagactagaggctgttaattagtgaggtatattttgatcagggcaagaagactggttcattctatatcttcgtatttctctggatgattatttcattttgtaaaatatgtaagagttcccccccagccccttatctttttaaaaattaaaatggtcatgctcttctaaaaagatgacttaatttgaaggctttggagacatgaggatgatggggatccatcactccctgttctttgctccctttggactggagtgttggctgtctggaagagttttgcttgagctcgtgggttattttcttctatgtggaggaaccaagagactctttagcatctttcagcaagagcgaggtctgggtgtactcac

SEQ ID NO: 87141 - DNA, 1787 bp, Homo sapiens
gctgggattacaggcatgagccaccgtgcccgaccagataattattttaatagaataaaaaaaagtacaatggtgaaatgactgaaggaaaatcttaattggaatgtaagctccctgagggcagggaactgttggtggctgctgtttggtaactaaatgaacgaactgagtccagcctgcttttttcaccgtggaggtagctgctacccagtaaagttacgttggttgcttcagatccacacttaggttgtagcagggctgagctagcagtcaggttttcctgttcctgtcttgtcctctgacgtggcttcagggccctggaaggttctctgctaagcacgcatccagatgggtgcaatggcagcccgagcgtgtacacgcacacctcctgttctgggggagtggtttcttggcagcttctcaagggcgaagggtgagttttcggcatctggccttcccttgctgctgtgggtcgggtcattctagcatcttgccatcttggatgatctgcagctgtcatctcggcagccaccatgaactggcctgccagtgggttttctcgttcccagcgaggatgtggtggtgtgtctgcagcccttttccacagcagcgaggacctgggaggattagtggcttagcttctttcttgtcggtgagcaccgctccttcctatgttccaagtcagtagcaggtgtcagcttaaggaggaggggcaccttgtcctacaaatgtcctttccctggattttgccgttcctcacatgctttcgtttcattgttgaggtcagtctcctaggactatgaagctcctgtgttctttgtcagatgatttttggcagacaggtgagcctcctctgctgcccgggaagggaggagaaggcagtctcggaggaaccagctgaccatctcaggtgccgcttggggcagcgtccattctttgtgtcctattttgtatttttaaacccggacaatcttcggccgaaaaccccgagaacacacaggggagatgtagttcatcatctctctcttcccgtttgatctagtgtgttcatttaacaagagctgggttaatccttgttcattgccaactgtatgcgtgcacccacttttggagggattcaggaaatactcggtgcttcctgatgtgcatggaacacagtctcgacgtcttagcttggtgcttaattaaggtccttcaaaatctgtaccagggtcttttccaccttatctctcaattcttctagtttttgctgccttgaaactgaatgctcacccttctttgagaaacctgtccttttgcagatttccctctctgcactgcccttcccttctctgtacacaacagaccctctttgaaagcccagcttcatcattatcttttccacgaagctgtccctgcccctttgtggaaacagtcatacttctttggatttccacagcacttaccttttctttggttaagccccttccaacaataataaattagcagaaacttgtggagcacatacatctgttgcatgttgtgctagacattcactcattcatttattcaccaaacaagcaccgaccgtttgccagatactgtgcaaaattcgggggatagtgtggagaatatgacaaagttcctgctgtcaccaaacttttgctctagtggggcaaataagcagtgagcaaacagataagtttatgacatgctctcaggtgtgatcaccaaagccagggaggagcgatggcgggagtggggtggaccatatctatggtacagtcagttgccactttcagtagttc

SEQ ID NO: 87142 - DNA, 3839 bp, Homo sapiens
ggtgggtcacgaggtcaggagttcaagatcagcctggccaagatggtgaaaccccgtctctactaaaaatacaaaaattagccaggcatggtggcgggcacctgtaatcccagctactcgggaggctgaggcagagaattgcttgaatctgggaggcggaggttgcagtgagccgagattgcgccactgcactccagcctaggtaacagagcgagactccatctcaaacaaacaaacaaacaaacaaacaaaaaacaccccatccttagcccttacttctgcacttttgtacatcgtggacttccatttaggtagagcgaatgaaaaatgccagaagaaacacagttcttgtctttaagaacatcattagctccaggttgggaggagggggtgacctgtgatactggaaagggtgggataagcacagtagaagaggtaggaacagcattttgaggaagggcaatctaagcttctaggaagaggtggtctttgccccaggtcttgaagatcagataggaaggaataatggcaggaatgctgttcttccttccggctaggcactaggaaaggtcagggtgtgcaggtgttgcaaagggtatgtgctgcagagtggcctggcatgaggcttgcaaagtaggttggagccagtttgtagaaggcctcaagggcccaataaggcaaactgacaggtgctgtggggaacctgttgtgtgtctgtgcgggtgtatggggatgccctgtggaatgttctgagctcattcagacccatatagaagctggggtcactgataggaccatggcggatgctgttgcctggagaacttccaacctgggcttgtggcttaagcttaatgcaggctatgttctctctggccagagtctctcttgccatagactcttcttcttcaggagtgatgctcttagcagatgccacctctacctttggggtgtgtggctgcttacaaagagctctctcattctcttgtttctaccttctgttctctcctcttttcctccttaacaagggaccatgatatagatacaattccaaagtcctgtactttgtccttgtttaagccgtgatcgtgacctcaccatgtgtagacagtgagatgtcatttctcaatgtggacatcacagattgcctgtataaccccagtgtgtgtcccgtggctcagagcagtctgacctgtgacttcatagatggtatctgcttggggtcgcctttggctgagtgtctgcttggtgaagaatatgcatttttggaatcatgatctctgctttccgtgtggtgtgaagtgcgcaggtgtggtcttggggctgagcaccctgtggtatgttgtagcagcagcctcacttggtcggtccagctgggacagttgtcccactgggtccagagtaggataagatattttccattctcccttcttttgaagatagcaccaggcttccaaccatctggaatgttagccttagggtggatgcctggctgctatcttgctttattttagctgtgagattttgaatagttaaaaagaaaaatcctaattcagaataatgactgtcatttattgtgagtttatatgttataggcatagtaccgagactatacacttagtcttctttaatccttacaacaatcctttgaaatagttggtattatctccgtttgacagtgggtaaactggggcctgagagggcagacagctttctagaaccatagaactagtaaggttcagggttggcctttggaccaaagtctctctgaatcccaaggctttgttctcctctctgctaagccttgctgcatccaacatgagtgggcagagttgaggttgccactttgcctgatggctataaaatgctcaggctgaggaatagaatttgtgatagtctagctggaaagcttcaggttaatttttgttacctgttttctgagagcttgtttagcataggtaagtgccacttaccagctatggcattttagacaagtcacttagtggttttgcacctccacttgtacctgttaaatgggatagcaaccgtccctccattgtagaattgctaagggtaagatggactgagctactgcatatgaatggcctagggtgatagctgcatgttgtgggtacagtataagcattcatcatctgttactgtccccgaaaaatgtccctgcccccatcatcaggggaccttataaccgagcagctcgtgggttgattagcactgttgctcctttctagggtgagggatagaacagcacattgagattggaaaattctgtgtcagtggcttggcctgctcatgaggtcctggctctcgaggcgagatagcatgcagcctttatcttggggatgcttgatgggcattaggaattcatttccttttccgtatctgatgcctgtgtttttgctgcctctgagagtaaagtcccggggagcagctagggaacagctgagacactgctgtgtgagaggtctccccatgagtcttctctctccctgtactggtctttatctgcccgggggtagctctaccaatgactgatctgaaagcatcacattcatttatttgtcactggctgtgacaggcaagttaatgctaatggattctttttttagcctgttgtctgggatgagtttctctcaaacgtcctgaaatctaaggcattaggagaatgtgtaacttttatggcaggggaggatttataaaataaatagggttttgtgtgcaaggaccttaaatttaggttaggggtatgagcagccaaggagcgggggtgtcgggcaagcacagagtcttctttttaagaaatccattcaagagctctaaattgctgtttctgtttcaattatgtgacaatttcaagggtttagaaaaatctaataaaatggtcttgatgatgcattctggggagagagtgcttcagaagatctaggagaataaattccttgggggtcaagagattctcgttcctgccaccttgggccttccttcatctgggtttttacatttttattgttttgaagggcagaaaatggtgtaggaatgtattcagggcttcatccataccctccaccgaaatgaattattctcttttggcaattgcaaaatagacgggccactgcaatctttttttttttttttttttttttaagctgacatattgtaaacgactttcagaccatgatttgtgtgtgtagtgatgttgaataaagcaccaaagaaaagaaactgaaggaggggaaagagtgaggagggaggcgctataaaagtttttttcttttctgccatcaaagcttttgatagtttcctaaagcacagaagtttacaatggaagcgggcttttgggccgcctaggggaacagagtgcagaaagacctagtgtagcaaaatgtgatgctgagtgacattaatgaggtgaccgctctggtgggagggaggcaaggaaccagccaagtagcagttcccatgacttgctctcagctgagtgtttccttctgcatgcttgcatgggcgcctgtgtgtgtttgtgcatgcacacgttgtgtttcctaagtcttcagatggaatttttaacaacaaaccctgtttggtttactgtggtgttctccaccctaaagaggccgtgaatgttgagttttgtcctttattcccacctgctgaaaagtaaagttttcaacttagcggcattttgtttttactttctggatacctgccggagcctggctgggcggcgtgtcaggccaacatcacagagctgggcactgttggaacaccaaaccaagagtgtgaaaagtcaatattctcatttctgaaatgaattccagggagag

SEQ ID NO: 87143 - DNA, 3472 bp, Homo sapiens
aaagtaatccgtatttccatgttgctcttgtgcaagaatttccactcactcaagaacaagaaaagctgcaaccttgggggtagaagaaggtgagaaacctaggtcttgctgatttcctggataggagctcgagagtacctggctcagttgcgaactagtttcagaaaggaagctcgtattttcatcccattcctcgccatggcattagagtgaccattctaaacagtactgggcgagtgttctgaaaaactgctgcgacatcttaagaaaaatagccagatagggcctggtgtatagtggagtgggtggaaacacagtgtgtatttactgatacactctattttttaaatccctttcaactcagttccctctgggatatctctcaaatgtgtcctttttgtagctagaggcaaacaagcaaaaaatgtttcaactttcagatatactacttaataaaaactaactagtggattcatcatgtcttctacctggggaaaaaggatcaaattaggatgcttgcacctaggagagaattgggttgtgaatctccacgagattgctacatgtatatgtttcctcttctgttttccaaagaagataattggttttagtaagaacttctgacttgattagggggcccttaggaaattagagtgtgtttgaatttcacaagtataattttaattatacaaattttgcattttttcactagggagccaggttcagaacttgttttcctgtactaataggggtagtaaagctgattatggcagaatgctttacttaaattgctttgaaaataaaaatccttggatttgatcattgtttttccctgcagtacacgatgttcaggttaatgtccatacacgtcccatattcttgttaaaaatgatttttttttttttttttcttttactggattcacacaactgcagaacagactgacatagtggggatgtgggtggggggggggacctcattatgaatttttctgctgcacttgctgaaagaattcaattaaagttcttttgagcacaagtcctgcctgggcagtttgcgtttggcaggccatcgccttagcatgttgtgattgcctttattgccacgtcatcctgtttgctcaaagcctgtgcattcacagcattagccctccaagcggcccctctgcagcatgaccccagtggattagagtagaaggtgccgtggaaacagtcacctgggtctttccccaagctataaagagacggtggagtgaggatgatcagaccccctgggcatcccaagagaaggactgattgtgttcatgggaaataactgtttttttcagggctatccagacaaaacccccaagtgtcagagcgggggaactgctctgagagtttgaactcaagcatcctcaaacatctaccccagtgtggggctctaaaaagcttcctagagacctgctcctggggccttctgggccttgtctcagatattgacaggagagattcaatagaagaattcgttcacaatagagaaatcatgaaaccagcttgtgaatgacgtgatgccacataggccggggcctgagaatatgggaaaacaaaactgcaaatagaggctggatcctactcaccccccatcaccctgcattttacacattgaagtaaaatgttatttttactgtcgttatttttattactttctctccaggtgttctagctgagcgtttaagagcatggactctggaaccagactttgaatccttgctctgccactgcagctgtgtgaccttgagcaagctatctaaatattctgtgcctttgttttgtcatctgtacaatggagatgatgatggtatcaccttcatggggttgtcataaggattatgggacttaacataataaagtgtttagaatggtgtctgcaacataaggaagtgtatgggtgtgtgagttgtggggttgttagaaaggagcacgtcctgtggcaggtttgggtaagtgctccgtgcctgccttacgtagtagttggagaacgctaagtactgctgtcttctgccttacgtatttttccttaagtaatgtttgagaaatacaaaagaagacacacacacgtggttgtgcgtttatgcatataaatgtatgtgacacgggtagaattgcagtgtaatttggattcagacaaattcatgtgccataacgaagtgtgtggtttgttggcagcacgggctttggactcagagggacctagtttgaaacttgataactgccactaactctgtgactttaggaaggtgttccagcctttctgggtttcaattctgtacttaaaaaaaggggaatagtagggttgtggggattaaatgagccagtataaataaggcaccaggtgtatgatgaatactgagaaaatgtgaattcttttctccataaacaacaaaagaaaaattttaaagccatctcgaacatgggaaagatacaaagtgttctgttcttgctggtgatgagagtatctgaagttagttgataagtccttagaggtctgagtagagaaaagcaggccataaaagagggtgttgtcatccttaatccacatgccaaagggctgttttagcaacttcatttcacaaaagccacattttcaagggcagggaaatcatttcagttaggaaccttagatggtgtccccagcctttgaagatgcctttgttcctttgacacttggtaggaactgggagcacagggctggatggtccaagaggagagagtaacttcagagacatgaaagagccccagctaggagggagcgagggagaaccttgggattgagggcaagggttactttttcatagaaacttttgcttggggatatggaatagtaggttttgatctacaaacccatgagccctgtcctgtgagtgggaagaagattggtagagctcaggaaatgaacacagttcccagccattggcctgggagatgctgacgctcagacctattgtcggggctgggaaagcccccagaccccttggggcatcccctgtatgtgggtccctttcacttcatgtccactgggtggaatttaccaggtattgctgggaacggggaacaagatcatgattataagtggatcctggacaggggatggagtgcgtgtgaatgttagtgtgtagaggacggaaagggaaggagagaaggggtggccaggaggagggaaatagcagtagattacattgactaattatagggaaaaagccatatttgctgctccattaagtgatcactaggctatgaagcagtttattgtaattaatgcagaaacagcaagtaagtgtttgagtttggagtggagggtcttcaggaccccctccctccttcagttctctgtgctcactgtctccctcccctccctcaaattcattatccttggagagaaagagtcttgggggagcatctctttgggaagggctgtttagcacagtcttgga

SEQ ID NO: 87144 - DNA, 1124 bp, Homo sapiens
tcattaaacaacttattgcatgattcactacttttctttttctttcttttttcttttttttgtgagacaagatcttgctctgtctcccaggctggagtgcagtggcacaatcaaagctcactgcagccttgaattcctgggctcaagcggttctcctgcgtcagcctcccaagtagctaggaccgcaggcacacatcactgtgcctggctagttttttaaattttttgtagaggtgggtatctcactttgttgcccaggctggttgaactcccgtgagctcaagtgatcctcttgccttggcctcccaaagtattgggactacaggcgtgagccacagtgcctggcctgattcatgattgaagtaccattaccataaatgctatacatccatgcattggatgttaaagggatcataacaaaaaaaaaaaaacagtgtcctttgggttttgggaaggcttcctggagaaataacgttgaggctgagcttgatgtagggagggaagtagcagggtgcatttcatgtgctgagggaagagagggtggctggaatgcagagagtgaggaggacagggggacaggcgaggtcacacttgcgttggcggggataaaaattcttatcttaggagggttggggaagccatccatttaaaagtttaagggatgggatgggaaatgatcaggtttgcgttttgaaaatatctctctgacagtctacacgaaaagtggcttgtgggtaccccagggggctgtgggggaatcagtgagtaagttgttgtggtgatccacttgaggaaggatggctgcttagctgagttcttggaggtagtgatggagaccagtggatggatttgagatgcatctgagaattggagcagcagcttggtggtttggttagttgaggagtagcaagtgttaaaggtgagaggcaaatttgacttctcattgatgtgagcagagcccccaacccccacctccgtgagattgagagtgttggcccatgcaggggacaggcagggcaggtgtgcctggctcagggggttgagtgtaaccccttggctggcaatcggcatactcttagtgacggacccctattggtaaacttgtttttgagcttgcactgtat

SEQ ID NO: 87145 - DNA, 1668 bp, Homo sapiens
aatgctttaaaaagccttgtttcccaatatactgcgtttcagttttccacgagtgcagccatgctcgggagaggcgtacgagctgcttttacatgtgagaggtgaacaaatcaaaggtgagcccgttctgcctcagtgaggccttttgtgtaaaaagggccttctggagtaaagcaatcaggttgactgacaactgccgaggctaccagtgacagtcctgctccgtgggataacttggagaaaaatcagggccaaaagcagacaaaaggatgtccagaaactggaggtggggaagcctgagtgagatcaaacaacctgaaaatgtgtcttccatccatttagggctttatgtgcagcgaggttggagtggctggctgaggatgtcaacattttaaatttgtcactgctttgacttccctagctttatctcccttcagatcaaagcggggagactaggagttgtcactactggatttggtttcagactatgttggtgtacccttgctttatgaccttggggtttcctgtctttgcttggggtgacgggttcatttcaaacaagtgagatgtgtgttgtggtcttttattcagagtggggagctcttagaagcacccacagaggctttgaaaggactgggaagcagcttggagggccagttgcgtattttccaaggattcctgaatatcaggaatccagaagtttctatttgttagccttgctgctcctccaaggagccatcctgaaggcagtttagtcctgcactgggagacaaggcacaggcctgaagaattcctgccccctgctgtataataaatctgatactaaaattagtgctggcctcctgagccatatttcttgctgagatgataaagaagtgtgtgtgtggcaggctcatctttcaggattggaggatgttgctttatgtcagataagtgcccaggtctcgagatcatttttttatggcagcctctcccccatttccctgcttcctctccctgttctgttttgttaggggtaggagtaggtaggggtggataggggagaaatattttagcttgtcttctggttttgtgtaagtctctgtcaccgtaggtagatgttccttgagaatctttctgaaggttttataattgagtcttttacctccgtgacaagatattattcactttctctaaagcgtttactttatgcttgggctggggttggggggtggggggcagactttttttttttttcagggaactctgtctctagaagagacttgccgtcagggcagttgaatggccagcttacgactttaataattgaggcggcatctgggccccttgctgaacggcagtccttctggcagggcgattttgcttttaaaataaccatgttcacctttaactgcaaacggctgtgacgagagttgtatttaattttaaattgcccatgtccagtaaccctctgtacctctttaaataataaaatgtttttaatcttcctgcagctgtgttctctgtgtgggggcttgccatttttggaagaggagggggcttctgtgcctcctctccactccctttcttttccctttcaaactcaccgggacttctagaaaatgccatttcactaagggcggaatctggcccgtaaagtctctggagtgagtgctgggaagtttataa

SEQ ID NO: 87146 - DNA, 1134 bp, Homo sapiens
tagaagtttcttcttttcaccttaaaaaaaattgtttgcatccttccccttagataaggaaccgtcaacatccttgttagagcccagtgcggaggggaccctgaggcacatactgttttcaaggttagatagcaacaaactttcagagtagccggagtttcaggggagggagggttctttgggttcaaggttacccatttttcccctgctaggaagaaagcctttttgttttcttttgccgacttcttccaatagcttagagcaaatagattagcaacccagcagaaaccaaaccaaggaacaaataaaggggaagtttgcagagggcccttggctgggggctggctgctgctgaggaggccaacttgcggttttccattttcacggtgaaccgcattgtctcagcgttcgctggtattcacaaaatcagaaagaaaggaaggtggtggtgggagggcgcacttttcaggagaggctggggtgtggggaaagtatgcccagctgcatgttattagcagccttcaaataaagtttgtggaaggttccggcccccacagtcatgcctgggaagcttctgtgttcttagtaggtgttttgaattctgtgggatggaactgaatgtttaaaaacagttacaggaacgtctccccaagtaggtattcctgagaatttctgtgtacatggaactctattttcttagcaagcatcattatatttttagaaatgttttcttttctccttgcccgtcagttagccaagcctcctaccactcactttctgttgtgtagttctgattttccgaacaggtgtttagatgatgaggggttatattaagaaagtactaaagaatacgtcttatcacgtgaatcagtatctttttattcaacatggatggagtgggagtggagaccaatctgttttatattcctgcaatctgatgagggtaagaaaaagttcatgctgttcatattagctagccagcctctttctgtctttccctcccttccttctttcttctttattttttctttctttcttttgtctaatacctaattccttatctcatttttgggattttgagagaataattttcatgtggggcgacagaactagtggttgtagtttcacttgttt

SEQ ID NO: 87147 - DNA, 1825 bp, Homo sapiens
agtctggctcattaaaatgccgaggtaggtttaagctgattgccaagtgcgggtcctgcaggtcagagtgtgatgcccagaaacaaagcaaggcctagggagaggctggcctggaggcaactggctcgcgccgcagagagttttgaagccacatttcttcattggaaatttaaaaagaaagaaaaaaagcagccccttttgctccatatttatcatctctatagtaccctacaaataagtggtctcaaaaagttgtttttttttttttttaatttgctgaacctttataataggaccctttctgagggccccgtgagcccaagaatgcctccttgcaatgtgagtgtgggaaattagtgcaggcccaaggaaaggaagtgtgaaactgcttccctcagtgaacacccagcctggcgaggctgtcctgtgtgtcttggaagccctgctgggcctgagtttgggtgccatataatttgctggcctagcaccccttccatgggtccctctcggccagcctcaaggaaggggtcctgtgggggacagaatagtgtgtgtgaggggctgtctgcgggtggaggactgccggggcttaccatcctaacttgttgctcagtcgcggagtcttgcatgttgactctcctgggcttggttggccgctgctgctttcctgtggttgttggtttgtgttaggtgtttggtcctctggtttgctttgggtactgggactttagcccagggaagaggcctgtggtgcttctctgcctttcggctcctacgtggggcattggaaagccctttccctgcctggttgaaaccttcgcaaactgcacacctggccggcctggcagtcaaatggattccatggcagcccctgcctagagcggagcaggatgtctgtttcggccggttatgaatgaaatcagagtcctgtgctggcaatgccattgtgcgtaaggagtgcaaggaatgcactgggccatcttcccagagagaccctatagacgaaacagatgtggtcagatgagcccctggagacagcagtagtggggagtgtgggagagcaggccagggcggcaccaggaggagcaggaggagctccaggaggattctgagcctcctcctcctcctttattcctccatccctctgtctggggtgggatgtttgggagaagagaggcaatgtggtatggtagataggcctgttctttggagacagttctgggattgaatcctggctatgtgacctggccaagtgacataacctctctgagcctgatgtgtgtcatctgtaaaatggggataataagacttgtgtggcagctctgggaacagacagaactttctgtagagcacgtagcacaattcctggcatctgttaggtgcttagtcagtgttgattatgcagccagcctggacccagctgttgtcgctgggacagggaggaggtcgtgcagttaccgaaccctacaccattgattttactgctttggaccgagaggcccgagtgtgctgtttagccttccaggccctgaaaggttagttgtacccttctgactttctctacagaatcttccccctaaccttcctggtgtttgctaaactgagagttagcctcacagagtcccagcttctcctgggtcatcatccttttctctggcctctgcctgagagcagcgtgcaccggagactgagggaggttggctgtaatcagcacagacccttggctctcagctgagggtggatcccagtgtctagatgatagatggtgcagtttggtttctaattcctgcttgatttagagaggtgctgggagtgagtggtgtta

SEQ ID NO: 87148 - DNA, 1751 bp, Homo sapiens
ggagtgcattgtatctgtagtaggatgtttagcggcatccccggcctctacccactagatgccagtagcaatccctccctggttgtgacagctagcaattgccacgtgtctcctgggggacacagtcacccttagatgagagtcattggtctagcactataggtcacttctctataagaaggggaaatatttgtatgttttctgaggttctgttctgcatggattggaacctggacaatgaaatattcatgaaattcaagagcaggaaagtgcctggagagatcacctggtccaggccccagcctcccgcaggtggctagccacatgccctgggtttgatttccacggctcctgctggtcttcccttttggttaagtgaaagggcagggagaggggacgtttccacccaggccagcatctctatagagctttttggagtgggaacttcttttagcagaatgactctgcactcctgggctcttggcagtcctgtgtttgggcctctaggagtttggttgcaagctccacgagtttgatttgctctctcatccctggcacacacaaatttgtcactcagagggactggcttttctgcatgcactgaatggatttttatttgaaatgaattcattaaaaaaaaaaagttttgcttgccaggactctgccgtcctctcttcccttttatttctctctgtcgtctgtaagacgagcctggaaggagctgtctggtgggattggttggccagggatttttctaggccctgattaaaggtaaattatcagatgaaagttggaggttgctgctgtgcttgtaaaaaagtcacttgtgtgccataaaatccatcacagctcccttggtgagaaggaggaggccgtgaaacactcagtgatgctacttcggcttccagtgatttggcttccctctgctgcaggagtgctgcccggcagcccggtgcaccctgctcttgtgagaagctcgctgaatcacgttggtgggaagctcagagacagaactgtgtgttgccggcaagttgccatgaagtagttttagatgttggacttaggagaaccagatggctttatggagtagaagcggagcccatgatgtcttggtgacttttgcctctcttttgcttagaaccaaagaaggtggttgtccagttggagagggtgtggggagtctggccttggagaggcagtatagcccatggttgacagcatggatgcagggaccagactgcccagccagttatagaggtgggactgtgggctagttatttaatctctctgtgcttcagttttctcatctataacatggggatgagagtaatagtacctactctggggtcatcttgaggaatttgtgcaagaaaagggctgagcctatagcctggccaggggtaaggaagtcatccttaattatattatcattggttacactattctttttaatttattttagtttttctttttagagacagagtctccctctgttacctaggctggagtgcagtggtgtgatcataactcactgtaccctccaactgttggactcaagcagtcctcccacctcagcctcccaagtattggcactacaggcacatgccaccatgcccatttaatttttaaaaattttttgtagagatggggtcttgttatgttgcccaggtgggggtctctaactcctagccccgagtgatcctcctgccttggcctctccaaatgttgggattacaagtgtgaactactgt

SEQ ID NO: 87149 - DNA, 1018 bp, Homo sapiens
cctggccttgtcctgcttgtggccagaagtttaagtggctgcctattgaataggttttttttgagtgaaggacgggggagctggaactgaagaccccactgtctacagccataccaccctgaatgtgcccgatctcatctgaagaccccagcctcattctcccccgccattctaactaaccaggccaggcaggagaggatttgttcatggagtgaactcactgattgagcctttaccatgggcagagtgctgtgctggagattgggagtcagggatggaaacaaaagctagacagtccccctcctcaggagggctagtgggcgagacctgcgtgaaaatgcaggatcgtagaggaggggacgcattcaccgagaaggtccagtggattgggggctagggagaccctcggacagctgcctgggggaaggggctagagaatgggaggggaggctggactggtgatttaggggcaagagcaggaaaagttctgcattccgctcaagagatagagactttgcctgaaggcagtctggaatcctggcggcttaggagccagggcatcatcacattgatattttagagagaaaattcttggcagtgttataagtcatggactgggggagaccagggagctaagagaacagggcctggaccagagcagggggcagagtgagtatgaaaggaggaggggtgagaggcaaactctcccatgtgccttagacctggtgactccagtggggttggggtggcagggtacctggaggaagggtggatttgtgagcagccagtacttccatcagaacccctcgggggtgcttgttagaaatggaggttggtggggggtccctcacctgtggatctccagttgctaaggtgcctggacatctgtgactgaaaccaggtccccaaaggatgctgaggcctggaaaccttggtctcacctggagatgtggctccacgatgcccttgggagcgagcgagtcatttcacaaagtgttaggagggaaaggagcctttc

SEQ ID NO: 87150 - DNA, 1483 bp, Homo sapiens
gcgcttggctgtaccttgccattacttgattatttgcagaattagaaaaggctcaagtatctgatcataattttttcctggatatatagcacatcctctgaatatgtaatcagtgctttattgtttttttgtttttttttttgtttttttttgttttttttgagatggagttttgctcttgttgcccaggctggagtgcaatggcgcaatctcggctcactgcaacctccgcctcctgggttcaagcgattctcctgcctcagcttcccgagtagctggggttacaggcatgcgccaccacacccggctaattttgtatttttagtagagatggggtttctccatgttggtcaggctggtctcgaactcctgacctcaggtgatctgcccgcctcagcctcccaaaatgctggaattacaggcatgagccactgtgcccagcctgtttttttttttttttaaaggaatatgggctgttagatgttgtaaatggataggcaatgcatgttcactttttctgaggcttgttcagggaaactgaaaaaagttcctctgtcaccttgtgtgcatctctgtggtactgtctctccagggtagtgtgggatttagaggagaggggctggaggggaccctgcagatgtccctatgttctggaggcggacttgtttatttttgacagaatgaatcttggacatgggaggatctggctctgaccagccacaaattggatatttgtttgacctttttattccagtgagtgggaagagatccggtacctcctttatcataaatcttgccttgttgtttgctccagtatagcacttcatctgggtgctgtttgagcatctggctttcatttttaagtgccggcaggtgcaggggcaggcatatctcagggggccgtggcagatgaacgagatgtggcaaaagctggcgtggcactgttgggggtgagtttcacgggagaaaaaggagttgagcttattcttgggcaactctttgccttcctgctaatgtttccaagtataccatgcaagaatcaactccaaggggctagctgaagctggggaaggtgaagaagtgagtctgagttgtctagaacttgattggtaacatctcagggtactgccagctgctggaccaatgtggttctcctccttccctgcctctcaccccttcaagatgagttgtcttgtctctgacccatcctacaacagccacaagtcagtcgatcctgtgtttgtgctcccgaaggacttggcgacttggctaacaaggagacatttgttatttcatttcctcatccattattcatgcagtgagaggtaattagcatttagtaatgtggtttctggggtaggtgagttgggttcattcattgagcaaacatttcttgatcccctgctctgggttgggtgcaggccagggggctagggttacagagatgagggaagggcctagtttgcctttgagtgtgtgtctg

SEQ ID NO: 87151 - DNA, 1376 bp, Homo sapiens
ttttctttgttctagccaatgttttattgctgatatgaatcactgaggggcttggagggagaaaggaaagggtttctgtataaacagctgtcttgctgattcaatctacaaagtggattttatagctaaagtatttgttcttgctttaaaatgccaaaacagcaccgtcatttcctcagcgaaaagaagggtctttgagaatatggggctttctgctcccgtcacaaatctttgcttgggggagaggaggaaggaattccatagaacttttctttgaactggtctttctaaaagaatctcatgctcagaggagaagaattttctttacaaagtttgagttaccagttcacgcagccttccttttttttttttttttttttttttttttttttttgccttactacatgttctggtttaaaaaacaataataatcctctctggtcatcacagctgactacctgcttaatgtttgcatatagatatttcattttctttttttatgcaagatttcatcgttgcattatctgagatagttggttgccctgagattattaataaattgagacagttaatggtgtgtgactcagaacatacatttaaaaacaagttggaatagaaataggtcttttacaaaattaattttttgttaggctcctctcttgagcctttttgtttgaagccggctggctttgtagtgttcatatatggccgactgcaattaacataaattacttttaaataccagttagttgctgtggagagaggccagggtggtggctgcttatggaaggttaagaggcttggtcattgtctgggtttttatctcactgtggatcaaattctgttccctttggaggccagaagatcgtgtcaaagattgctttctttgacgatagggagaaggattaagtctttgcccagagtaccagtacttaccaaggaagaataaataatcataaaatgtttacatatttaaaaacaaataatattaaaatgcaacatgtatcctggattggatccttgaacagaaaaaagacatcagtaaaaaaattgatgaaatccaaataaaacatgtagtttagttaatagtattgaatattgaatcagtgttaatttcttagtttgatcaatgcatcgtggttatgtaagagatgaacattaggaaaagctgaatgaggggtatggggaactctaagctatttttgcatttcttctgtcattcaaaaattattttgaaatattaaggcttttttgttttttgagatggagtctcactctgtcgcccaggctggagtgcagtggcgcgatctctgctcactgcaagctctgcctcctgggtttacgccattctcctgcctcagcctcctgggtagctg

SEQ ID NO: 87152 - DNA, 1050 bp, Homo sapiens
atcatggtggaaggcgacagtcatgtcttacatggtggcagacaagagagaatgcaagtcaagcaaaaggggtttccccttataaaaccgtcagatcttgtgagacttattcactaccacaagaacagtacaggggaaactgcccctacgattcaattatcttccactggatccctcctacaacatgtgggaattatgagagctacaattcaagatgagatttgggtgaggacacagccaaaccatatcagtgaggcaggggacagagtgtatctctcacttgttaggtcctagaaagtctttgtaagctcctgtttcttctctgggagaggcggggctgtgaggagttcttagacacggagaccttccttatgtaacaaaacatcccagaagccttatcagtgttgttacaaccccagttagtgaagtggtgtggatacagggatttttctagaataaatcttgctttgtggtatggatggattgattcatttccctttgattttgtgtctccttgatagaagtttgacttgacacaagggaaaaaggtggtagtaagtactgagcacccttaagaagtaggtttctttagagcggatgcaaggtcccagaaggacagtgatggtgctgagaggagaggagtgcaacctgagtttagttgaattttccttcctcacatataaaatatcgcatacatacaaaaacatgtgagatctccgtgtaaataggaatactcacatagtcaccatccggcttagaaggagaatattaccaatacctttgatacccctgggtgtttcttcccggttttacctgcctgccttcctatcacatttgggtttgcctgcttttcacccttgtattagaatacttttttccattcatgtggtgtttgtggcattcattcatgttgatgcaggcaactgcagctcatttgttttcattgctgtagcgtgttcattgaatgaatgggccaccccttgtcttttcttcttttaagggacatttgagttgccgagtttaatttttggctagctcaaaccgtgctgc

SEQ ID NO: 87153 - DNA, 2475 bp, Homo sapiens
ctcgaactcctgacctcaggtgatccttctgcctcggcctcccaaattgctgggattacaggtgtgagccatcgcacccagccaggagaagctattaagagtttacccagaattcctccctgagattcactatttgtcagtagtcttaagctatttttgggtaggtcctctttcagcatagggtgaaacctctggaccctctcctaagaaaaatccccttagaactacaagaggtctcccacagaggggttttcttaaggaagactccccacagcccatccttggcagtgtagcaaatatgtatccagcatctactgagtgccagatgttttgtgggacggggggatacagtaaaaataagacaagccaggtcttcgctctcagagagcttatagtctaaatggaaggacagatgctgaagacgtgattacaggcaggagagtgttattaggaggtagaccagatgcttgggaagagtgataggtggccccagcctttaggaaaggccccctcagttgggattcagaatgaggatatttaggggtacagaatcccacggtgtgagttgcagaagggcccgagcatctgtctggtggcaccttctcaggaggaacctcactgaccggcatgggtgaaccgttcagctagggtcttggggaaagtcaggcatctctggagcctccgatgttgaggatagggtaagagcagcattgttctctggggccctttttccttagtaacacacactcacccggagccagttgtgccttcttgcaaacaaacagctttcaagaagagttaataaattaatcttctgggaaaaagaatctgctctgcgccagcaagacctctagcagccagggccagagacttgggcaatgtagtcaaaacacacgctgatcactgtgtgttactgctgacgaggttttaggcagccagttcggtgcgtttgatatcgggcagttcaggcagggtgaaggaagataaagtgtgttaaatggagctctcacaacaaccctggaggatctagtcccattttacagatgaggagcctgacacacagaataaaatcgacttaaggtcagctacgagtccctggaggctagggttgcgtattctgttccttctctgccattgagttggctttccctttatccttttcttccgcttaataataataggtaacatgacccacaaggtactgtgaaaagctctatgtaaaccatcacttcttactagaaaagcatttcaaaccatctgctcaatctatatttaaagagggtgtaatgcccatactttattaaggtctaactgtattaaggtctggatatactgattcattcaacacatatttattgaatgtctgttatgtgcccctaggacatgtcagtgaataaaactgacaaggatcctggacctggtggggctttccttctgcttggccatacagagtagagagaagcctggcctttgcttgctctgggggttggggaagcaactgggagcctctggggacgctgaatcaggtcccactggctcctctggctgatgaggaagagcttctctggctgcctcttgtgtttccttctccttgtgccttaccacctgcagaccttctggggcttggagttcactgccgcctatagagaagatcccttccttcctactaatgagagagagagaaagagcttcccactgagatctgcttgttaaaaagttagactcatctgcaatttcaccaaacagatgaccttacagtgattaagtcacaaaacgaagtcctgtccgcccctttatgttggcttcctttgtagacacgtcctccccacattatcttccctctccccagtgtagattctggagttcccatcagggttctgcaacttgctcaaatgaggatgaggttggaagattcaagggtgtgacactgtcatttgtcctaaatggaggggcaggaaagagatcctgtcacccctcctgttcccaggaactgggggtgtacctggtgacagttagatgtgtatacatgtcatcgctgttcacatgctctgctgccaattttattttgttttatctatttatctatctatttgtttgtttgtttatttatttatttatttttgagttggagtttcgctcttgtcgcccaggctggagtgcaatggcatgaatcttggctcactgtgatctgctgccaattttaatattccttagtatacacaatgtgtctgccctcatgaaaatgtggtgtgaggatacccatatcatattcaaaagcaaagtgatgggctaagtaattatttggtgttcagaaagattcactggagctcctttaactagggggtccccagtttgtttacatgaggacttggtctttgatacatttgtgcagtttttgaggaacattttgagcttcggatgcctgcttattccttgggctgtccaacatttcctaaatccttaggagtttttcct

SEQ ID NO: 87154 - DNA, 2140 bp, Homo sapiens
ccttggttccttagcaggctctcctttacctccttggtgtggtcccagggacccagcctgctctctcttcctctggcactgccactccatccctgagagtcttctcagagactggctcttgagaaggtacaacccccctcatttccacttccacgttgtccttgaggaggagctgtttttcctggtgagttttattgttcatcattgaaggcagaagtttcagtgatgccacaggcgagggtacagttgggctattttcttttgtccgtggtaccatggaggaaactgagttcagttactcgtgcaaggccacagagctgtcacctggcaggcttcccaggttgagggctgcctgtattttcatcagcatgaggggatatcacctcctcagctattagctcatgtgatcctacaggctacaactgagtcttctttgtagtctcaacgcaggttttctgtggactggagaaagcctttggaaagaaatgttaatactctttaataagtgaaaatgcactgtagaagaatctttgaacataagtagttctatagatcatctattctactgggcttaatcatcataggggatttttgcctcaagtttggggctaaggaacttgtaagcatttctgtcttacccatgagctggaagctgtgttcagagcaagcttctcttatacttggatcatgcccctggtgccagctttattctgaaattgctttgggctttctgacagctcatattccccctctgccaccagttagcttccaggatgggcttgcagaataagtggctttaatcgtctgttggccacttgttatatatccctaccatggggaaacgtgtgtaataaaacatgaatatattggggcgggaggactttgtatgtgttaaacatattgtgtaggtgtataatggtgaaagaaaagtgcatgcaataaatattgggaaatgtttgcacaaatgagcaaggatttagtctttgtgacttgatcatccttgaggggaattccttctcaggaaagcaggtgttagtgccagatggtcacgtgtcagtttcctgagatcctgctcaggaaggagtcgttggggaagaggaggcagagagggccctacttggggagtctcaatggatgacacagccagaagagaggagagagggaggcacgactcagtggcagaagggttctcgaggcccgagtggagtgctattagtaatcaatagattcagaagcagcctgggcctgccacgagaagctggcagtgttggtctctgtccgctgggcctcagcttctctcctggcagacggtgatgatgggggtgcaggggctggggagtatgaagggtttgggctttgatgagtcagtgaatttagcatttgtgtgtcagttcagacccggctggcctggaagtccaggtggcagagggcaagtcaagccctttctggtactgtattctccctctttccggcccagcaggcctgcctggacctgtgttctgcttctgtatcctggactgagaatcactgtgctgcctcctgaggagctgctgctggagtggaccttggggcagctagcacattgcctgtcttcctaaaggcatcggtgcacagggcacctgggaatgacagcgggcctgagagcagagctcagtggagatgctggacccctgaaggttgtgttattttttttttttttccgagttggaatctcactccgtcacccaggctggagtgcagtggcgtgatcttggctcactgcgacctctgcctctcaggttcaagtgattctcctgcctcagcctcccaagtagctgggactacaggcacacaacaccgctcccagctaatttttgtatttttagtagagacggggttttaccatgttggccaggctggtctcgaactcctgacttcaagtgatccacccgcctcggcctcccaaagtgctgggcatcagccactgtgcttggccgactgtgtcattttgtacttgcagcacaggaaggaacttgtcttttcctcgtgaagggttagaggcactttggttcttcattgggcctcagtttacctaccagtgccacggggatattaatgagtgcctcacttgactctttctcccacatggatgctgtgcaga

SEQ ID NO: 87155 - DNA, 1089 bp, Homo sapiens
taagtgatccttcccaccttagctgcccaagtagctgagactacaggcatgggctggctgctatgcccggtaatttttaaaatttttttgcagaaatggggtcttgctatattgcccaggctggtctcaaactcctggcctcaagcgatactcccaccttagcctcccaagtagctgggactaatgcaaccacacctgattaattttgtttgttttgtagagactgtggggatggggagtggttctcattattttgcccaggctagtctggaactcctgggatcaagtgatcctctcaccttggactcccaaagcgctggaattacgggcgtgagctatggcatccggccaggtattgccttttgatacctgctttctctggagacaagtcatagcactcaagcctggaagggtgatcactgtgttcaggtcggagacagagcacagtcccagcagccgagccatcaaccaggatattgcagggagaggcccttggccttgctgtcagagagttatggagagtgcaatgtcaagagaactacattattgtatagtttcttttcgagagaactacattattgtatagtttcttgatgcctgaaggcaactttgcaggaaggaaaggccttaaatcttaagactgtgttgggttgtgtagcaattcctgcctaccttctatacttccttcctaatttttctttttcaaaactgccaactggaggaaacctggtgtggtggtgtttgagaggctccgggtgggtgctgacctctggcttcaaggctgcaggctccctggggcccgggttgggatgcctcccctggggaggtgcctgatgagagagaaagcaccctgctgcagtttcaaggctgaccagccttgtaaccttcaaaagagcaaaccctgcagtcttccagagtgtaaattgaagagaaagtgaccctttcatatttcaggtcctgtgtgagaaggaaaagaaaattctctgaagatgcctgggctgtgtttttttacaggcttggaagccaccataacttttaacttgactccctcctctctgctctttgcttgtgaaggattttaggattttg

SEQ ID NO: 87156 - DNA, 1746 bp, Homo sapiens
ctcctgactttgtgatctgcccgcctcggtctcccaaagtgctgggattacaggtgtgaactcctgcgcccggccgcgcctgcgtttttagaagatgccccaagtaaatcatgtgcacagtgaagtttgagaaacatgagtccagagctgtggttctcagccttggctgcaggttagaatcatcaagcggagggatgctggtctctgaaactctgatttacttggttgggggtgtggattgggctttaggagcttttgaaagctcaccaggtaatttttctgtgcagccaggattcagaactgctgtttgggcagtggggagccaggaagagtttaaagcaggggtgcgatgtggggtggaaagtatagaaactgttttctgccctctcttgaccaagagcaggagctcatggtctttggagccaaaagcagccctgccggataccaatgtcttgtcctggtgtcctttgcctggggcaggtcaggcgagtaaaggagaaacacaggcccagctgatttgcctgtcattgggggtgagggctctgatttgagtgtgtcctgtcgactcaaggaccacagacgtggggcatttgactccattgctggcagcgtttcttgggggcttgggggtcggtggaggggagcctgtgttgggggaggcagggcagatatgcgggtggaagaggggagttcccagccaggttttctggaaatggtacattcttatttcccatagtaccaaaggttcttgaaggctgggcccactcctcagaaaggatgctttttgtggctgttgcatgcaccagataagctctccaaagcccactggtggtaaaggtgatctagagcaaacaaacatcagtgaaaaagcaaacaaacccgaacacccaaacagcatttatcccagtttagcggcgagacttggattaggcaggtcacatggcccacaactttccttcaatccttgggagacttcttccgtggaaacctttttcggcagctttgcaattctgattttcagttaattagatttgtgctgtttgggagacttggttaatgcatttcaccccacagagctaatttgcctctgtctaaattaggtccttgctgtggcggagggtgtacacgggctgtgtgaatacagactcacgtggggtattgagagaccattagacagtaaacaggagagggctttgaaatcacatttgtcatcatcatcattattatggaatatctgaggtcccaccgagagaatagaggtgttcttcagagaaaggccatcatgtgagtacacctggtcttgttacatgtctcttgaaatacaaccaggtgccctcttgtactgttaacccagggccatagcatgaaggagaagggaaatctatctggagggtacaaagtagtagatactgctaagtaatacatttacaatctctaaatttttagggctgagagggaccttaggagctatcttagccagtccctcactttataagcccaggaatctgaggcctagggttattgctactttttttttttttttttgaggcaaggtcatctgtgatctctgtcatccaggctggagtacagtggcatgatcatggctcactgtacccttgacctcccgggttcaagcaatcctgcttcagcctcccaagtagctgggaccacaggtgcatgccatcacaccaggctaattttttaatatttttgtgtagacaggatcttgctatgttgtccaggctg

SEQ ID NO: 87157 - DNA, 3255 bp, Homo sapiens
tcgggaggccgaggcaggagaatcgcttaaacccaggaggcggaggttacagtgagctgagattgcaccactgcactccaacctgggtgacagagggagactctgtctcaaaaataaaataaaatggaaggtggaaggtgagaaggtgagaaggtgggaaggtgggaaggtgggaaggtgggcaggtgtgagcatgtcctggaagaggaggaccatagaggtgaggtgggagacccggggaggtttttcactgttgatggactctgtgctctgagtgctctttcatcggagcctttcccccattccggattcttcactggttgtctgtgtctctctcatgggaccgtgtcctgaatgtcagtctgaagactctttcctcacttctgaggctacccctgggctctggctttgggggagtgctccagttttcattttcttcgcctgtttagagagtgtggccaccatatcacagaggactgggaatgggccggagaaattgtgggctgtgtcagggttggggcgttggtgctgctcataagaagcttgaaggcagagggtgctgggaccttctgtgtgaaacccgggtctgaaaaggtgcctgttgtggggggtgggggcggagggtcccggggagaaaaggtagctgacatagaagcacatacagcacgttcctgaatccaggccttggagtccgaggagtgcctttgtggcaagtttccccctttttaattttcttgtgtcgtttctcctgttaagtgcaaagaagatgcctcgctgcaggaacatctgtgctccttaggattccgtggctgatttgttacatataaatttcctaatgtaggttatggagctgttgagggagagaagcagggaagcaggctagggaaacatccttctccactcaacttaatattggtgcctgtggctccagggccagcccaggccccctgcctttaggtgtgtgggccctgaaaggacaacttttgtgcccactggaaagtgtgtgtggggagctgtggccgtagtcttgctctcttctgagctggtgatggggagcagccggtgattatgcagagcagggccttctgactctgggcgggctgagacaattgcttagatggttgtaaaggaggtgttcagaaatagtgcgacaggggcgaagcctgtgctgtcactggtgactggggatgcttgttagcattttctagggctgaactggttatcatttctatctcttcatgccaaggaagctgagattcagagaagcgaggtgaccttctcaagatcacacatgtgtttcggtggcatggccaggacgggaacatgaatgtccagattccccctggaaacaccatatttcctcaattcagaatgcacttttgttcacatttgcacttgaaaatccagtgcatcttacaaatggatggcatcatgtcagaatgatgcatcttatgatccacctgtgttagattcaatcaaatatggtagagacttttgatcgagagctgctttatggctggtattgggctttgaacacattttctcaattaatcctgaacaaaacaaaaccctcttgagtaggggtttgtttttgacagggtctcactctgttgcccaggctggagtgcagagacacgatcatggctcactgtagcctcgacttctggggcttgagcgatcctctcacctcagcctccctagtagctgggaccataggcacatgccatcatgcctggcgaatttttgtatttttttgtagggatagggtcttcccatgtcatccaggctggtctcgaactcctaggctcaagcaatctgcccaccacagcctcccaaagtgctggggttataggcacgagctactgtgcccagccgagtaggggttttctgctcagtggtaaagtggagcgagaggggcgactgcagctctcagatcccttattgttcctcaaatgagtgagctgtgagtcccccacccctcctacttggcccttccctttgcatcgtctcactctcagcttctctggaatgacagtgctttcttcctttgagtgggcaccaggctgctgccttgagttttctggacacttgctgctgaactgtgttccgatcgaaagaaatacaattactctctgagatttgaggggcgattgtgagctcttgcagtcaccttcttgttcaatacttgcttggagtgtctctcttgagaggactggaaatgcatctttgggtggaggttgatctgtatgaggactggctctatcacagggacagggatggtctgctttttgcctctcttggggagggaggagagttatttttatttaggtgtgaatgcgggggcttgaatccagggcagaggtgatgtctcacttctttcaggtgcaagccagtttgtaggaagataatagggaggattgttaggtatgctggggctgttttggagaatcctcaagggagaagccacgaagaggaggcactgtcagatgttcctcactagtttgcagagtgcttggaggtaatattttaagacagttgggaagggtcagaggtttctacccttagagtctcatcaaagcgctgagtgatgcccaaaggggatgaataattcttccagaattcggagtcctaagctttcctcttgctttcttgttgaaataggcaggctggttgagggatgcccctggccccgtcttagggtacatacagaaagaaatactaagcggactcttgctgtctttgcaaccaagcaaaggggtcctgcagagggtgtgtcaggaagggagaaagaagagacatgggtacaaagggctctggcagctgtctcagccatatatgtggtcatttcctagagatgagagtggacgtcttgtcctcctgcagcctgctccctgccatgctgccttccctgcatctgggcccctttatccctccttgttcccctcctacctttcatccagccctctagattctgtaccactcacctggagctaggtgagaaggatttaaggatatccactggctgtcttactctgggctataattggcggtgggggggatggatttgggggcctgggatggtctagcttcttcccatggactctgagtacccctaaaccctccaaacgtggctcagccagacaggctgggaaaagtgaccaggagtctcttattccagcttctgagactgctgtgttcttggtgagtctcccgcccgcggcttccaggcccaatctctccgttgttactgtgcac

SEQ ID NO: 87158 - DNA, 1030 bp, Homo sapiens
ttccataatcaaaatggaaatttaagtcaatgacaatggaaactatttttggccatttgcagactagggaggggagtgagagggcagaataattcagtcattgtaaattttaggggtgaaataacagcatagaaataaaaactccccaaggaagcataaatcaacccttaatcgaacataaacaacaaaccacgtaccactcactcaaaccaggagctgcatccctggccgtcagatttgtgcttggctgttggagtgacgtgccgcccacaaggtcttggctactaagggacaagtattgggttttctctcttctcctgaaaggctcttgttgacagcagacagcttctcagagcctctggtcaccgacctgttcttcccttcctttctcctgtgctgttttcaagacagaaagcccagctgtggcaactgcaggtctttggattagtttgacacctggggggttcccaggtgaaaatgagggctgcagggcagggagcaaagcccacttgggagttatgtgttgtgttggtgagaaacaggttgagaaagaagcagctgctgagaataatctagtgtatattggggcggggagcatattggtggggggagagggactgtgttggtcgtgagtgaccctgagtgatgggtaccgggggttcattctctcaatctcatgacttttgtgaaagtttgcaaaggtcagaagccagaaagaaagatcaaaagccaaaaagaaagggagcagctgaccccaagattcccacccccaaggcattacccccttgaatcaggtgtaggtctgtttcctcatctgttccacacagattgagtctacaaagacccaggtctcatatcctgcaggaaagtggagaagaaaaaatgtgagactgattttttttcagagttttgactgagagagtccgttttcccatggacttctggacatccatgcctgagaagcaccttgggttttccctgctcccaagtcggactgagctcagggaatctccagggaaatgcgggggtc

SEQ ID NO: 87159 - DNA, 1313 bp, Homo sapiens
ttttttccctcattttgcgggtggagtctgaggccttggaggaggggtggccgggagagtctctgagcagcacaacatgggctgaggcagcgccccgccggagcccacaccctggtcctgcgagggatgcaggagtgcctgacccaaggaggggtaccgcatgaggtggctgcacagacaggaggcagcttttcctcatcttacccgctggctcccgcggtcatatactccccggtcagtcacagacacctctgacctctgatgggacattcagtgacacttcccttgtagcccttggcttttcagttcctgaaggagccagcaggtaagatggggaaaagctgcctctgctgtcttccaagtggctgtgcatgttggcccatggatacttatatctatgtcaccagctgacacctctcttcttctgcctggctcggaaggtgttttgttttagtttggtttgtctttaataagggagcagtggccatttcagagatgggtggctgtagatcctcctcctgaaccagcagaggccaactccattccatcctggacctttccctcctccttcactttcttccagcctctcctcttgacctgtggctcagaagggcatgtgacaagtgctgtccccacctcactgacccactgattgctcttaccagatttgcttctttgagccactggggcagggactgactgggccacatgcacctgactgctgaactttgccaacctgcttgtgagctggaggagagcaaggcaggcatgcagaagaggagggttgagttgccacagctcagagcccagtgctgccaaaatcaccactttgtcatttggtacatcagaaagtggtatctacctatgtttatcacagcacagttcccagttgcaaagatatggagccaacctaagtgcccatcaactgatgaatggataaagaaaatgtggtatatatgcactgtggaatactacccagccataaaaaagaacaaaataatgtcttttgcagcaacttggatagagctggaggccattattctaaatgaagtgactcaggaatggaaaaccaattatcacatgttctcacttacaagtgcaaaggcacacagagtggtttaatggacattagatgctcaaaaggaggaaagtgggggagggtgaaggataaaaaaactacatattggatgcaatatatgctattcagctaacaggtgcactgaaatctcagacttcagtatgcaattcatccatgcaactgaaaaccacttataccccaaaagctattgaaatacaaaaattattaaaaacaa

SEQ ID NO: 87160 - DNA, 1405 bp, Homo sapiens
ctgttgtgtttcctgaacattcttcactgattgctacctcctgcctttgcatctgctggtccctctgctgggaatgcccacctgcctagttcagtggggctcccttttttccttcaagcggcagcttaaaccgtgcctttttagcaaaacatttcccgtcacccccattaggttgtttgctgctgctgcttttgtagcctctaatgcttcgttgctgtatggtgcaggttacagacccttagctacaattctcatatcccccaaattttgaaagccaaactttttttttttgtaattcatctggctacaaaatctgaactgtcttcagacacttggtagtatttcttgatcccgcttagtgtggctatctgtgggttttgcttactcccagcgggtttgatcacaggtgctgttccaagccctgggggagaggaggtgggtactgtaggctatgtgatacatgacttattacctgtctgcaagcagaaacacctacatccaaaccgatttggccccagggcttgggataagagatataggtctgtatttcttggttcaagttggcctcttcctactaaactgtagggccttggactatgtcctagtcaatatctttgtgtttccttagaggcctcatgattaactggcactgtgagagtaaatacccagtgagactgtcttggtgaatggataatagtagctaacatttatgaagctctcactgtgtgtcaggctgtgttctaaatgctttacttatttccgctcatttgatcttaacactagccctatgagaagttacttatcttatccctgtttgatagatgggaaaaccaaggcagctgctgctgaagtagcttgcctggggtcatgtggcttggaagtggagagggagatttgaattcaggaagcctgattttaaaccacggactagtagcaattggaaggactataccttgtcccactgcagtgtttgtgccttctggctgtcacagttggaatagaactgctcatctgagagtgtttttgatagggtgataaaatgactagacatgagagttaagaagggaaaaacctcccgtggttattgagtgttttactgagtgccaaatggagctcggtacttacagaaacagaccatccactggaagtaatagctgtcttcatggtcatcttgtccaacatctaaaaagatgacaaaccacagggctgggcacggtaatccaccgtaatccaagcaacttgggaagctgaggcaggaggatcacttgaacctaggagtttgaggttgcagcaacctatgattgtgccactgcactccagcctgggtgacagagggacaccccatctctaaaaaatgagaaaaagaaaaagtgacaaatctgaggcccagagaggtaacgtgact

SEQ ID NO: 87161 - DNA, 1133 bp, Homo sapiens
cccaagagtgtgttctgtcctttaaagttgctgtgttcaacagtaaattatttgattccttctaacaatacccctgtgtgggaggcatgtataaacttccattaatggcaaacaacatggtaaacccaagctcagaaatgtgtaatttcttacccctctgggtgggccagaaactcatagtggggttttactaggatgtaactgtgggtgtttgtgtggggagggttagggggtgtgtgtcactgagggtatatagaggttttctcaaagacttatttacatgagttagtgaaaaaaggtttgtccttcttctctccctctttccccggtgtttgagtcccttgtgaggagctgatgtgcacgatgaattcatctcagccagcaggctgtttaaagtataatcaaatcagaacccctgttttccgagttacgtaattttgcagaacggacacagaggctcctgggaaaaactgcctgtccgcctgttaatattaaggtccatttataaaattagaagctatgttgaacagatgaatctgaaatggaacttgcctattaaagttttttgtttttgtttttgttttttttttttggtcagatagccttatttaacctttctgtgtctcagaggttggtggcctttgcctatggtgccttcatggaaaaagttctaaatatagctcctgtttgttgttgaataatgacttgcgagggcggatggtagagtttccaacttctttaagtcagcaaactggacaagagggcatctagtccgaaggaaagccatgtgcctgagtgttcagcactgctgctgtttttactgtggtcctgggtttagtggatgttcagtacactgtgcctgtctctcttgattgtccttctcctcccagtttttacctccaaaagcctgtaactttttcttttttttctttttttttttttgagacagagtctcactctgttgtccaggctggagtgcagtggcgtgatctctgctcactgcaacctctgcctcctgggctccagcgattctcctgcctcagcctccctagtaaccgggattacaggtgcttgccgccggctaatttttgtatttttagtagagatggggtttcgccatgttgtccaggctc

SEQ ID NO: 87162 - DNA, 1711 bp, Homo sapiens
agtaaggccaaggcttttggcctgagcaaataaaagccttttcctatgatgggagaagactgtgaggaatagctttggaggtgaaagtcagcgtttggaaacctttccacattcccagttttcttcttctcttactcgttttctttgggaaagagttggaggaatgactccatctactttactgcttcttttttcggggtaatacaggacttgaatagtagttaaatcacctgtgttaccaatggtctttaaaccaaaactgcattactcaatcaggaaatatatacaggtaacctgcctttccttcattctgagacttatttcttgttcataatgcttgtgaaatctgaatgcatttaaataatgtacatatttaatatgatggcatttcattcttgaaaaaggtgttattaattggtgttgcatcttatggttgttataacatacagtaattaaagaaatattataggcattatatattgagctcttgcgtgcgaggaactaaaatgtgtgttatttgcctactgccgcgtaacaaattaccccagaatttagcaacttaaaatagcaaacgtttatcatctcacggtgtctgagggtcaggaatctggagtgggcttattagctgggtggttccactcagggtctctcatgtggttgaagttaagcagctgttctgggctgcagtcatctgaagacatggccaagcaggagcttcgccttccgggatcccttgcagggttgtttgctggaggtctcggccactctccatgtggggccctccagaggctacctgtgtctgcacagtgttgtcattgtctcctccagagcttgggcaccaccatttcttttggctcttaaaattctcttctaggcttgggattttaacccaggtttccagatgaggaaactgaagctcaaggaagttgattaccttcttcccaacttacagaagccagtattagactagggccctgaccctgatcagcctgacaagaaaacccttgttttcttttccacggccccacagagtggcccatgtttctcaaatgctgcaatctaggattgaccccaggaacccctttggggtcattacattttacttccactgtctgatggcattggtgtggtccatgcgaatactcacagctttaaaaccatctgattgtctctgagactcattttctctccactttctcggcctctagccttcacggctgggtgtctcagaggctgggctctctcctctgggaaggctgttgtctctgtgtcgctggctagcctgggtctcaggggcagtgagaatccctggcggctgtccctgtcgtgtttaccaccttggcaacaagcgctgctcttggcaccacggtcgagtccttagctggacggtgactcgggctgggggctccttcttcacatcatgaattggtcttttgccaagccaaaacagcggctgcttgcttttcagaaggaaaggttgttcatatttattttttaattagaaaatgaatgcatgctccttacagaagattcaaaacatatagaaaagtgcaaataaatgaatgttttggtatattatcatttttgtgtgcatacgtatttaaaaacagaattggaaaagaacccagaattagaatcacgctgtgttgtgtgcatgtgtatgtgcttttgcatttactagtacttagtaataattttcacgtgttactag

SEQ ID NO: 87163 - DNA, 1064 bp, Homo sapiens
ccggggagctgtgcctgcctgtcagcctctccatcttgttggtgctgaaaacctctcttcctcattttggtccctgctatggctttttattcaaggctgtggtttgagttctaccacaaagcagataatgtggcatgagcagctcacgcagggactgccctgcctccctgtcttcacctacaggggctgccgagatggggaagggccccacccctgagttcccctttgtcttccttgtctcctttgcaaggagagtcctttatttgttcttttaatgcaactggcctctctgaagaggctttccagatcaatttggcttgtcaggggtgccaggcttaagttttcaggcatctaaagaagtggtgggggagaggggatcagacttttctttctctttgtggctttcaaaagaaaatcacggacgttaaaataaatgacgcaaatatctgtattttttgtatcaaagagacaaatggcataaatgcagattatagggtattccttagaactgtccatcacacaggagctcctgggaaaggcaagcagcccgcgaggcaccacccggtttcactgagcagagggtgagtggtggcttcgcgtttgggcagcctccagggggtcggcatatttagatcatcgtctcacggattgattcaggattgtcttaaaagccaactcggtttccaagtgtttcattcttgcatgcacgcttaagaaagtcaaagccatttccattgtcttctgtttgatctgcactgaccatccttcagctcctgcctccacttgcgtgatgctttctcttctggttgaagaactggcagcgttggtttgggctgctcctccctccctcgggccccctccctgtggcacggacttgccctgctgtcgtggatgatggtctgtgtgcaaggggttgagtcccgtttgccatgctcctggtgtttctaacttctcagcctttcgtttcacaccctgccatgatgacagtatatccatttttcattctttgggacattttctctccaaggaaagatgctcatgcacgtttgcagtgggtgaactgt

SEQ ID NO: 87164 - DNA, 2952 bp, Homo sapiens
gtgttttttcttttcttgctttattttttttggataacggcaaaatcaccgcttgtgggcaccgccacagataatacaaaaaagccatttgaaaagagctttatgtcagcacagagtacttggaattgaagacctccagggatttgcctttgttgctcaacttttctctctcctctccctctttttttccccctttcttttcttcctctccttcttcctccttgttctctttctcttttcttccttctaacttgccatggaaccagagtgagctacatattgccctattttcagctgatttgcatgttagagcagagtaattggtgtttaaccagaacaaaagaggatctgttttctaaaagaaaaaagaatttttgaagtagatcctattgcatctactgcctttgtctctcctctcattaggaattgaataggatggccccgtaatgagaatgtgggagatactgctttggttgtgatgctttttgagctaattggtttgaaaattatatttgatacagatctgagggatgttggcaaaacacctctttgatacatggacatccggtccctccatcagcaggaggatgggtagtgagaggcagggttggaacgctgtttaccttcctggttgaacgctctgagaggccaccccctgagattttggtctttctccaaatcttcatgttggtctgtgcctggatgaagaaagccagggagcactggaggacaaagtttagtagaaaagtttgtagctcatgatttgacttctagtgtgttttagcgaagacatgaagttgaagaatgacttttcctcttgttcagaggaaagtctaaatctggactagaaaattgagaggatattagttaaaaacttccagactgtccgttcttcattttatatgcagaaatcactttgtcagctcacagttgcagtctctttcttctggagttaactggcatctgatggtatcatgtctttttgtgaaaattaagtgaatttttgaagactttcagtaatgtttcagtgaccacaaaaccatcttaaaaaattagaaaccaaaatactactacatgaacttcgaatgatagaaggggaaaatgagttataatcacatcattctaaataacagctgttttaaattttaatgtattaatattaccctgtcttttgccattataagtcttacttacatacacacacattttgaaatagtcattgattactttggggattgtgtttaagcaaatatttatttaataataccagttaaagagttctgtgacatttattccttttctgaggtcacccaactttgcaaaagttcaatattatcttgcaaaatctgatagcagattttaaaaaaagagacacgggtcatgatgacttctctcagaaaatgtgactacaatcaattttgctgtctgtacgtttgtttgttactttatctttctgcacagcctgtgaggtagggaagggttaagccctcttgacccactttgcagatgaaatggagctaagcttagaaggaggacagcaactgagatgagcaaagttcgaagccaggaggtgcagtccccagctttatctaccaagtcaactgtctttccttctctcccttttgctttttttttttttatttggaggtaatttaaaacttacaggaaagtttttaaggataagttcaaagaacatccttgtatgctccactcacatatatcctttatcagcattttaccctctttgctcaatcagttgctctctttttcactaatagggttttttccttgagtcattagggaataattgtacgcattgtgaccctccactcctaaatacatcagtgttcctaatggggatattcccttaccaacttcagtccagttatgaacttcagaaatccagcattgatacagtgcttttatgtaatctaccatctgcatttcagttttatcaattgccccaatctgtcctttatagaattctttttccctcaagtacaggatacaatggaggatcaggtataacatttaggtttttttgatgactctttcgtctgctttaacctggaatatttccctagcctttctttgccttttatgacattgccatttataaagaatacaatcctcccccaccttttcccaatagaacattcttgtctagtatttcctcatgactagattcaagttatgctttcctggccagaacacgacgtaagtgtttttgtgtccttctcagggtatcgcatctggagcacttgatgtccatctgcctctctttgatcacctggtcaaggtgttgttagatttctccactgtatagttactatgttttgtcttgcaacgaagaagcagtctgtggggagatgctttaagatgttcctcatggaagtttcctctgaaagctagcattcactgatgattcttgcctgatctagtctttacagcaatggttacaaaataattttctaattcctacatcccctctttatttaccacttggcccttggcatctgcggtaagcaagatcccctccttcttacccactaattttaaaatctatttcttatagatatggacccatggagtcctagtatttcaatggcttataatcattactgtacataacaattttggtgctcaaattggcccacacttggccagtgggaggcccttcattctgattccctacaacatgatcctgcgccggagtttatttttaagcacttctttactttctggcataacaaggtgttccaagctcatcttgtgtctcccctgctccagacctggagttactcacttctccaaggagctggtttcttgtagtggggattgcatttagagaccaagataagaaggttactagagcgtctttgctcaatgttactggagtgtcttcgtctctaggccatttcagtggagagatataggaaacatgagtgtaca

SEQ ID NO: 87165 - DNA, 1458 bp, Homo sapiens
ggcatgtgcctgtaatcccagctactcaggaggctgaggcaggaaaatcacttgaacccgggaggtggagcttgcagtgagccgagattgtgccactgtactccagcctgggcgacagggcgagactccgtctcaaaaaaaaaaggcctactaaaaaggaagggttcaaggcttgtttgcatttctcttgcatccgacaaccacccccatcccagctaaagacctagggtgcatagttcaaccgtgtgttcctcagtcatttggattacctcttccctccctcccacctgcactgtggttatggtttgctgtcagtttcagggttttcttccttttcccttcccatccttgttaatttaattttatttaatatatgggacattcatgtgtgtttaaaagtttactgagagaagccctgctgccatatctagatctctccttccctgtttcccaacccctgagaggtaaccaacctcacccttttctgatttgtcttgtgtttctttttgtaaagataaacagatatatgtatattttcttatttccccttcttatataagaggtagtgtagcatatactctttaaagcatcttattatttttaaaaattaactaaagtccagctggatgtggtggctctcgcctgtattggggactgaggcgagtggatcacctgaggtcaggagttcaagaccagcctggccaacatggtaaaaccctgtctgtgctaaaaatataaaaattacccgggtgtggtggtgcatgcctgtaatcccagctactcgggaggctaaggcaggagaatcgcttcaactcaggtggtggaggttgcagcgagcctagatcacaccaccgcactccagcctgggcgacagagtgggactccgtctcaaaaaaaaaaaaaaaaaattaactaatgcctgactttattccaatttccctagtttttccttactgtcctttttctgttctaggacatcatttacatttaatagccctgtcttcgtaggctcctcttgcttgtaacagtcgcatcttattttttgaaatgtatcaataggtaggtagcggttgaacaagacggagaaagagaaggtgaaaggtgagagatgaaaaatgttaggtccatatcctgcaaatgttgttatttatcacttctgtgattttctctatatccacctgctacatgtattattatttacttaatacttttctttttgttgatttattttatcaccataaaaacattttgtaagaaaactttacatcattactataaatgagaaaccacttgctcacttgtatttcgtgagaattgcatagaaattgcagcattttgaagtttaaaaagtttaacagcgaagtaaccccttctcatccttatttttaacaggacttgagacatgtaaataacacattttgggggggggggtctgatttttttcttaatgaagatgta

SEQ ID NO: 87166 - DNA, 1411 bp, Homo sapiens
tatgtttgtgtgtgtgcacagtttacatttactctggttatctttaagataatgccttaaagattcagggctgcatcttaggcagatcaaacacatatcagttatgcttatgtcttttcatggagttccaaatagaaaatttcccagcactctactgtagtgacttcttaattaagcagctattagttaatacccttcctcaccattgttcctggaaatgagttctagaagccctggcccttaggttgccatagataataaggatgcagtgtgtttcagactagcattgtagaaagaagtgggaattatcagagcaccccacagtgtaccatcttatcaagatttgaattatgagacctgtattccaaaatagctcttttaaaatgatcttagccgttattttaaaataatgagtgtggcattatagcaccacttttcaaattttaagtgaagaaaagaaacacatctacccatcatcctgcctgtgggtctcattgctttccagccccatccgcatgtgttcagaccccttcatgcaggcattattggagtacagatgtacatgcttctgtcttgcgtttctctctcagcatcatgtatgttgaaacccatggtacttatattggagttgttctgtcttcacgattgtacatgtgatgttcagcgaggtcactccctgggatttctacccccctgaaagcaaagaagtggaaattttgtcctggtttctctcttggtagagtaggtttgtctctaggttctccacaatacctgcttccgtggaattggctggagtcgatgatgttagcaactccttctcaagtcatttcagcgatccttcagtctttttcaggacattgggtttccacgtatctgaccatttcttctttcttctgttcactgaaccaacactcagaggctgtgccctttgccaggccctgggctgactatggcgatagagcggtgagcaaggtaagtgcatttggtctctgcctgcgggagctcacaggtcatttgcacagttgtgtgcacggtgcccttgtgctgcgctgcgtgtccagcctttctcatctgctcatggatgcacacatcgcattagaaggggagagaaggtgacgtggctgtaggaagactctactctgcctttctaaatgctaagttctgtgcatgctttggcaccttcctagtggtacaagttgcttgtgatacatctcacttggacatatctatggtagtccaaggagtatgagggtggttagactaggggttgagttgggagtcacaggaggcaggcagggagtgatggatgcctgggttgtcccttgggacaagaggccactgctcagtttcaggagttctagtgttcagctcacttctgtacccagggaggatgactgatgtggttcggata

SEQ ID NO: 87167 - DNA, 1903 bp, Homo sapiens
cttctctttcccaactcacatcccctctcagggtgttctggcttcttagctttctgttactttctgaattaggaaagatctgatattatttacactcgtgcctgttaactctcccaggtgctgtccaagccttttatctcaaattgtggactgaaaagctttatctctggtttaaggcttcaagtcctggccagtagactaaggagatatttaggggcacagagaagccttcctgaagttcctgaaataagagcattctcgggctgccctcctccatggttcctggctgaccacttgtcttctgcctcggggttggaagcctgggatgaggactccaggctctcgtctcggagcccttccttctcctgttactgggattctcctcagctcactgccttctcccttttggtcactgctgcccgactcctgacccagcagcccggggattttcagtgtgtgtctccgtgtgtgtgtttgtgtgtgtgtgcacgtgcgcttccatccctgagctcactagagaggcatagggcagcatgaacactcacggagaacgaatgctcatgagaagcgtgtggtaaactcaaagtttttccatttggcacagttgaggagtaacgtttaaatcttcttcttaattaacatttatgagtgatcctgacagtgattaaagaaatataggaaagctctcaacatatgtgtatgtcaattatatgtactgggggaagaagaaagatgaggaaaaatgaaatacttgaatgatctgctttagaattgtgtacatttgtgtctaagtaccatgtcatgaataatagtgctaagagtacttaagaagatgaacagatcaccttttatcagttttatgacaggagtcaagttggtgcactgcacatgtgtgcttagttccagcctgtctgctcacaaccaggaaccacacaaaaagagttaacattagtcatggtaagcttagcaagcagatacacttcaaaattttttctccttgaagctttttaaagccaatttcaggaagatatatactgaaaaactcaaaggagaggtgacggttgggaagccaagaaataattttttactctaagaatattctagaacccagtagtacctgaaaaatctctcaaatacatcctcctttgctgcccttttggaaagattaaagcatatctggtgacaccagtaggtgtcatctgatgggttcttgctgcctggcgctgtgtgaattataaatgaaccatatggaaccactttatattaagtaacttacgtgttccagtgatagttatttaggttgtaatcttctcagaatctgttgttaatgactggtttgttttcacctgaggttgttaatgctccaaagcctattgttaacagtgccagaggtaggggtgtgtgtgtgtgtgtgtgtgtgtgtgtgttcatagaaggatgttactgtggaccatatgtaatgggctgatagcttttatttttttgccttagagtccagacatggtgctctggaatagccgttgtagggattatgtttatttgtcctgcatgaatgccaattttcggtttgtgcaaggaagggatgtgtctggaaacacttggagtactggatggcctctccatgtgattggcctttggagaccgcccattgcctcaggataaagtccaagtgctgttgcatggcctggagggtggccgtggtgtgttcctccctcctccccagcagggtcatttctccctctcacaccccaccacactgagccactggcagtgccctgatcacactggctgtttatgcttccctgcctttgcgcaggggatccctggcccggaaagtgctcaaccccatcttgtcaatttggcttcagcatcacttggtctctgagcgcctcctgatcccctc

SEQ ID NO: 87168 - DNA, 1930 bp, Homo sapiens
gtctcttcttggtccatgtggatttaacttggatggaatccctctggctaccagtttgccttggccagaaggagaagggctcctcctagcctcctcctctgctgcttcagccctgctgggcactgagcaatttcacagggcggtgttaaggatcagggtgtggagagtaggaaattagtaatgactggactgggtgagggtgactcttgtaattttaaagaaatgtttaaaaattaatcggttctctgctctgcagctttaaaaaagtcaagatggagaatttcccactgtgacgccttttatttctggaaagttgagtcatttaatgatgatttgaatatcaacagttcattggcccatctttccccagatagctcccgaaaatgcgctctcctccagagaaggacacttttcattcctttagttttctggcaactcaagtatagcctggcctcctgtgtttccccagaccattatcggagttgtactgaccaaatgggagtgggttttcacttgtacccactgctcctgtttaagtcttccttggaccaactgtgggtaggtgtaaagcaggcatggctgtgacttccacattggatggaggcttgattgattcgatgtgattccttgggttttcttggggttgtactaaggacttgtgtgcccaggaggacacaaggctaaagatggacttggtgcactgatacatggttcagttaggaacagatagtggaggagctcctaagacatttacctaagatattctaagggaaatcgtagactcttatttcctttgttatttagggagtagttggtggagatgtaggtggtaccagtgatgccatttctcttgtaggagcatttgctgagtcaaagtatctatttcctctggagggtccttgaatttaagagcttccagtaccagtagattgaagatttagtctgattataattttttccttgggtctcagaacattaagagtattcgaagacctggttctcttgtttcctcattaattttggtcctggatggtgcaggggttggactgacctattaagtctccttttcccccatccatgagcagtaagtctgtcatggggatcagcaaactctttttttttatgtgtgtaaagggtccagatagtaaatattttaggctttcagggatcaggatgcaatattgaggattttgtgtaggtatttaacataacaagagagaaaacatttacggagaatttttactgatgaaattcaaaatataatgacaattattgagtacagttttttaaaatacacatttgctaatgagaagaatggattttgtttcagggggcataacattttgctgaattggagtacaaagttactgttttctattatcaagtcagttatagatgtttgtcagtaaaaaccattcttagttctcaggtaagagaaaaacagatggcagacctgatgtggactgcatgctatagtttgccaacccctagtcagtagcatagctctggtgatgttagttttggtgtggaaagtgtaaggacgtggtatggcccaggaccccatgttgctctttgaatggctgggaaggtgtttgaatgccacaacactggaattttgtgtatttaataaatagtggtagagaggccaggcaatagaaatacagaagtgagcaggatggtcaaggtcaatgccctgggagagcttacattctaagagagatgataagtgaatataaaatttgattccaggtgggggaggggtgtttaaaggatgtctctctgggaggtgatatttggatagagatctgaactaagggagggaatggtcgccagaactttaggtgaggcagcagcagaggcaacatcttgagataggagaaagcttgataagtgtgaacctccaggaagtgcaggtgagagcagagagggt

SEQ ID NO: 87169 - DNA, 3075 bp, Homo sapiens
agctgctgggcagagtagactctagaaggcaagagtggaagtggttttatggggccacaaaactgagtgttgaaaataaagatagtctgaaaaatgtggagtctgtgaccagcatatttttaagattgtcttctgtgtcataagtcaggatccttctggtttcaaataacccaactcaaaggaacccaaccagaaaggagaataccttggcccacataactgtaaagtccaggagttttcctggttttgtcacagctggtcccagggctccggtgatgtcaccatggctctctctgtccctcatctctcctctctccttttctctgtgggttggcctcattcactccttttgcacgtaaatgttttccatgagttggtgaagtggccgtcaggattctggatgcacataggagcttggcagctcccatggaaatagtactgctttctttcagcatctgcatatcactgtcaggaaagttccctgattggccttgcttaggtcacaggtccagcccttggaccagtctgtgatggatagtcccttggaactgggtaggttccctgaagacaggggtgctgaacagacacaacagtgtatgtccagctttggtctgtcctctttggtctcccttatttttctcttccttttctgcctcagacctttctgttagggatgcgtgccaaaactcaagtggaactggtgtctttaccctcaaaacacagactcctgaattataatcacatgctgattttcgtggttaccactgatcatgaccacatgattcttttgctctgagggttgggccaaaccccctcccttgttctggcaatgctattttgagaggccatgggggcaggcagggcctggcgggttccagactctggctcaccttttaataacttgctctgtgaccctggatgtgccatttaacctttctgagacttagtttctgagctgggtgcatcaactaagatatccatcaaatactttggaagatgtaaagtggcatttagatgacataggctatgtttcccaggctaggacatgggctatgtttcccaggctagagtgcgatggcacaatctcagctccctgcaacctctgcctcccgggttcaagcaattctccctgccccagcctcccaagtaactgggattacaggcacccacccccacgcccagctaattttttctgtttttagtagagttgggttttcgccacgttggccaggctggtcccgaactcctgacctcaggtgatctgcccgcctcagcctcccaaagtgctgggattacaggcttgagccaccgtgcctggccagtcttttttaatcttttgcttaggaaagagagtgacggggaaagaaaggtttaattctggaccttactacccacacataccagatctcccctctttgcataacttcttttttggcgggcatgtttcttcatttttatcttcttgataactttgatgccctggttggactcttaagcagattatccttgggtggggacgtcagcagggagaaccaccccagactaagacaagttgtgttttgtctgtcagccaaaagcactcttagcaatccgacatagacatcattttagatgtacagagaagaaagaacaacacagtattgataagatttcagcaagatcccccctcccccaaagacgaaaacacacaaaacttaatgcattgctctgtaatgccttggttcctagtttcctaattaggcctgtggtttagcagagtgcaccatctcaatacacagatggtttttatgtaaaaaaatttttttcaaatgttaatttccagtgactgatgttttatgcctaaatcattttccattgtttatatttgataagaactgtatttgaactgctcctttataagttggagtcttttgtaatgggatttaacttactggttttacaggtgtatgaaaatgttaagccgtgtattgtatttgagagtttgaaaattcttcgttgcagctaatttaagaaaaaaaaaattaaacaggtgattagcagctgctttcggttttgaatgtcctcgctttggggttttgtgtttgcttattcgtgtgcaaattggtgtggttattttggaccggttgagacgctccaacattgcacctcccaggccagctgcccagggcccattcagtagacccttccccgcttctcggggctgatttgttctcatcttgtgtgctcgagagcttgctctctccttaatgattcaggccttcctgagaaaacaaagcagctctggccccgtttctccttgaggacagccttgttcactgccacaaagaccctgctttctccccaagcagaggaactgcctctcggggcagccaagaaccacagacccaggcggctgcagctcctacttctgaacttctggtctcccgagtgacagcttctgcatggtcttaagctccaggacccccaaggccacccagagtcagagtccaccgccggtgggaaaaacaacattaggaagtgggtggtgtggtgtagaaggggctgcttagagcttctggccttcggagctggatccagccacttgagcttcattcggcagcacacagacacctcccctccctcctgctctgccccagaccttgtgctttcttggcaccgctgggtcgtgcctgctcagacctggtcagtgtgcttgccagggcgaggagagctttgcataggccgctgctgcttacttattaacgatgacgctggtgggagctgcgccaccagctccctatccaggcctttgtggttgcatcctgttcacataaaggtgaaatcatgacctgcccgacttgatttttcagttgaggggcttttgtgtatgtgtcgttcttgatccagtaagaggattgtgctttcattcacaaagatttgatcagtaaataggaagagaaaatactcaagggagaaatgcttagtgttccgattaatacattaatctttttttttgatgagctgaaggtgctctgttgtttctcttgactgagtctttgcccttacctttgaccttagtgacttgatcatccagcc

SEQ ID NO: 87170 - DNA, 1901 bp, Homo sapiens
tctgtgtgtgtgggggggtgtgtgtgtgtgtgtgtgtgtgtttatggacagcatttgtacctgtaaaaccagaatgactccttcaggcattttttctcctgggtggttgcattcatgggctgaagctggctcttctgaagattgcaatgatatttaaggttaagggcttgccaggtaacaccttgaatgactcaaggctctgaggccaggctgcgtccatttgaaggaaggaagcatctttttctgattcatgcaaaggcatcttatggactaatggtcatcctagaaagtcatcactagtacaaggatcttttggaaaagtgagattggagaaggttgagtatgaaagtgatgtattagaaaggtgaatatgggatgtgagatcctagtcattagcgtttggagggggccttggaggtttgttagatcaaagctttcattgtgcaaatgaaatggcccagtgaggttaaaagagggaaggtcacacaaattccatgaaaaccataagtacaaggtttgaggaaaataattttaggacaaataaaagaagtgctgattttcattgcacttctaacagttttatagaagtgtctgtacctaaagtgttgtacatgttaaaatgtaaatatggtcaagaagattgtaggtgaaatcgaagatgatatgttgctagggcccagccctagcaacgtatcatcttttgaggagtgttcctcatactttgagattggttttatagagggctgttccttatactttgcgattggttttatagagggcaactctgttcacccacaaaagtctcttgatgccattgctggccagaacttgggtgggagaatgggaactgttcagcagagcaggtgaacaggtggtcctgccatcccagtggcaggggccccttcctttctcccgccactcccggaggaatgaccctgcatcttatgcactctctccgattccccaaatcccctaggtcccactgcttgggtttggggagtggggcacatctctgctgagagccagcccatcaagctgtctgggtctcatggtggcatatctttgttccaactcaatatgggcattttaatctttatttatttttaaaatttaattttattgaattcagctttaatattattgaattcagctacaagggagatagaatagggtgattgatagttaagagcatgggtcttaaagtcagaaagacaaaggctccaagtccagttaccaacttctgtaattctgtaattctggggggcggacttacctgtctgagtcttagtttcttcaactataaaatggatgtcccagtactgcctccctgccaaggttgtctgagtgagtcctcaataaaagctggtagtgagattaatagcacttgatggcaaagtttgtacccagtcatgggtaggggaattgcatctgccatccagtggctgaggtcaagtgatgacaccccaaactataggatcctggcagctacagcaggcattgctgcttccctttcggaaatcccaattgttgaggccctggctgaagccctgtcgagcccttggtgaccccactaccatttcctttatggttggcttactctgctttcttttgcaatgaatatagtttaaaatttctttatgagtgttctcctatttgctgccttagcctgtcacccactatgctgagctccccacccctcgtgatgccactcagcacctttatttgtgatgtggggtattctgggaaactcttcacaggcaactcagggagcctggccctccatcttatctcttaggaaatcctcaggtgtcccagggtttggcaccagagaagtgctgtagaccctgttttccagaaagctccgtgccttcacgtgtggtgagggagtggctgcccagagc

SEQ ID NO: 87171 - DNA, 1118 bp, Homo sapiens
gtgttgttcaaggtttgactgtacgttctgagcccaaaattggaacacatgccctaaggccctgtcctggatcattttatatatgtgtatggtcaggcttacaaagatagaaaaatggaattccattttcttacatatttctacaaattattttggtcaaaatctagaaaatacataaaactgaggtctcctggaaaagccagaatttatctctgggattgggataattggctattaggaaaggggtctaccttgttggcctgtggtcttgacttttccttctggaactgagaatatgtgaatggctcgtggaactgcacggaacccagtggtgggcagtatctttgtaaacaaaatgaggttggctttcaatggccagggaatgaatgtggaaccaaattgcagtttgtagaaacagagctgggctcagacatttaaattaaacgtatatttctatttgcacttccattttgttcggtaatagtgttggatatgggaaatcttgtctttgtttatatttgagggaactgcagccttcatttcctaaacggaagatcctgtggcattcctgcaatggaagctcaccagatgatcagaaaagggagagatggcgaagtaacttgtctctggttaccctcccattgtggaaattaatatctgacccaattctgtttgcccagtgagtttatggcttgctaagtggctgttgtaatgatccgtcaactgttgcaacagcattttctaacaattttattttacagttctgaagttttagtccataaattttttgaacttaaggctttgagttggaggagccatgtggttctaggggggaaaaaagtgccagatttattctttatgtctgtgagctgtgccttccccccattcttttccctctttacatgccacccctctgatattttctacttgaaaaaaaaattcatactaaagtgcttgtctttgtataatgctactcatagaatatttgtatgaaaaaagagtcaggagatgcgatgttcaacccaagtgcatgaattatgattataaagtttccatttaaaaatgaaggctgttggaacccttacgtgttgctgatggaaatataaaatggtgtagcc

SEQ ID NO: 87172 - DNA, 1028 bp, Homo sapiens
tttttctccctgctctggaaatgcgcttggctccaacacagcaggtggccgaggaactcaatctgtggaaggcatcagtgctttcagtgcaatcaaagttaagtgcagaaatttaattaaacggcatcaaggatggcagaaactttgtaaagctgcaatgcattgtcaaattcaacaattatttcaaggaacacaatccacagatggtgtctaattgataaattaaggttctgcttctctaatgggcttgtgtttaagcccgttttccacccatacaataaccatcacctccaggatgccccctttcccctctccagcttggacatcgctgcaagaagaaagcaacccagctcccccagatgacattcgggaagcctagggttgggtcctgaatgtttagtgggaaagacctccagctccttttcctgtgatcccaagctcccttttgggattgagtcttgtcctaaaaacagaaacaataggatttcttcgggcctgtgtgtccttttctgctctgctaacccggatgtgttgctcagagatggctgggttatttatttattcattttttttttctttttcctttttagcattgctgactttcttcctccatggcacaggatttttgcccaaaacaaaagtctcaatttatttgttctttaaaaaaataaaaaccacactgaacaaaaacctctgtttttcagaacttgcttcctgtctgttaatagtagatacccagctaacttacttttatttcgtaagaaaatatttgcgatctccaaacatccagtcatgtgcagagaaatgtatcctgtgttgagatttcatttgaaaggaaacctgaagatcttgggtgtttaccagaacttcattttgcagatgagaaaactgaggcacaatggttttttatataccttgctttgggactagttctgtgaaacatgatgtttctaaagctggaggagaggcagttgagcacatctgggctacctactttaaatggttatttcatccattcgtttgttcta

SEQ ID NO: 87173 - DNA, 1549 bp, Homo sapiens
tcccaacttttcagttggggaagttgaggtggactgaaggtaaatctgctggccccaggtccgagaccaccggtggggtgggtttctgtgctggacagcatctgtctcccccagcctgggcccttctcacgcctcttccctcccctgaagggatcacacgtttgaatgacttggagacttggagacacattctgtaattcataactctgaccacatgctgctcttaaatttccaccccgtgaaggaaagaagaaatgagagacaacccctaactttttatttttacacatatagtagaggtggagagggccaagtttacaacagaacctttgcaaaagcagcagccagggctcaggacctcactgggtacccttggccttgtctttgctccctacgggttgtcctggaacaggaaagcaaaggggaggagcgaagaggtggggacagccaaggaacagatcatatttacttatttgtttgtttatttctaacgagtagctgtggggaatgccactgcagaaccctttctaattgccttttatttatttatttttgccatagcgtgggtggcttttgaaattgcacgtaatttacggaggcgaggatcctgtgcctgggataccagatgatgtggctgaatggctgttggctgtttatttgctagtctgtcgttaccaacacagtattcttgagttcagaggcacaacagtgtttgatccccctcctctctcctatctaaatatatccaactagtcaatcagacttggcagccgtcagggctgtggctgtcagattgagtttgccttggctcctctgaactattggcttgttttccaagctcgaaagtgtatacaaatagtgatatctaaattagacttgcaaacacacacccaggtaggggccctgaaggggaagaatgaggcagcattttggtatgaaaatgacatttccttctcctccactatctgttggagagcacagacgaagctacactgaggggaatggcttcacgcttggtgaacaagatgcgtgggtgtgtttttctgaattgtgattaaaatgtttttttttccttcaaattttaagttgtatcaggagatacaagtggaatattaactcagtagatgggggaggtctggagtgtctcccatctgcttcccttctgaagggatctcagctgaactgaatgaggtatatgttgtgagcagttaatatacggttggtccttgtgatgttgttgtcttggctgaggattcaggaagactcttgggccttggagaggcctttggttccatggcctgccccattgggccggaacagcccctttcctcaaagctgcctcaggcttttcctgtagcttaggaacagcagaccgagctcctgggcccctccctggaggcttattaagggggatcagtggaaagaaaatcagagcatcttaaatccctacctgcaaggtacccttaattctccagggagaaaccttttataaataaatgtcatgagtgctcatcccccgagttgaagcttatctgcagagatgcttcac

SEQ ID NO: 87174 - DNA, 1050 bp, Homo sapiens
atgtttacctagaagtggaattttggggttaaaggctatggatattttgaaggagattttacatataaatatatatgaaaaatatataaaggagcttatatatatgagatatataatctcctttacaatatcaaaaaatttgtaatatatatacttatatataatctcttaaaattttttttatcttacattggccctcccgataaggagaatggtactattttctaacctcaccaaaagtttgagagattaacttaatttaaaaaaaattactgtttttgtaaaaatgatgtgtttatggtaaacatttttatatgtgctgaaggggaaggcttaatttaaaaagattggggtttcttggatcaacttgaattgcttattttaaacagccctcttcagtgtagtttggcaaagctctctctttcgggtttatttgtttacttacctacttatcttcaacacactgacctacccacctgtgtatcttatttggttaacatttatccaagtttgaagatggaaatagttttcctctgaatcagaactttcagtgtaactgttccaagaaaccgccaccacagatgtgggaagagggaagagaatgaggaagattcctgctgtctttttaccgcttgggtttacaaatgtggcaaatttggaaaatgtcaaaaagtaggaaaaataaaatgaaacctgagatctcaccacacagaaataattatagtcaacatattgatatgttttctctttttggaggaaaaaagttacagatgaacagaaatttgaaaacaagctgtgcctattttctgtttcttttattacacattttattatcaatgaatactttctgctgtaaaaaatataaatgatacagaaaccaatagtagtgttcccctttctagaagaaactataaaagggtgtactgttcatcgcccctattcacgctttaaaggagatgtccagctccagttgaaaatgaagttttcttacctggcaatctggtgtttctgaatgtgatttgaaatccgccaccccaatgagaatgagga

SEQ ID NO: 87175 - DNA, 1028 bp, Homo sapiens
agggatcgatcgtattgattaattgactgcaaaaataaattcagaattatgaaaataaagggcatctggatttagaattaccaaatatggctgggcacaggggctcacgactgtaatcccgacactttatgaagccaaggcaggtggatcaccttaggtcaggagttcaagaccagcctggccaacatagtggtagagacatatctgtctctgccaaaaaatacaaaaattagctgggcgtggtggtgtgtgtctgtagtcccagccacttgggaggctgaggcacgcttgaacccaggagacggaggttgcagtgagctgagattgcgccactgcactccagcctgtcaaaaaaaaaaaatcaccaaatattaggtgtgttaagatcctgggagatcaaatttcaccctctcattttacagataagaaaactgaggcccaacaaacattagtaattgcctcaccccaggtcaatcagccagttaggaacaaaacagatttcaggttctagtttgtgtccttttttctttttaaatgaagatattgatctattttttaaaaacaagaacaaaggccgtgtgttagtctagtttcagttgcagagagctgaatccactcccatctggtttaagcagaaaggaatttgtttgagggcattaaaatgcttccagaaatcatcaggagatacacggaaacctctaggttgtgcttttgggaacagccctcagagctatgcagcagatctgggtcttcaaatacctactgtctcttctgtcatctggaagtccccaccaaattgggaagatggtgctacagctgccaggttcagaaccacagccgcactgtccccatccgaaggcctccatggctgccactgtcctgctgtgatctccagcaaaataggttctccatgactagtcagtagagacagaggatattgctgcagaataacctaacacctccctggccatgttgccaggggaaatagttaaagtacagaatatactactttccctttcatacctagc

SEQ ID NO: 87176 - DNA, 1025 bp, Homo sapiens
tctacttaagaattcaataatgacttcaggcagtgttattaaggcctgcccagcaagaatggaggcacagaggccactctgagtgaacatatttgggggactctgagatacagccatttcggggaatggggagtggtgttgagtgcaaataggagataaatttagagataaaggatgacgagactcccctgcccccatccttctcctttcattcgcgttgcccttacaggtagatgtctgttcctgtagccaaggcaccccaggccgcgttagccgatgctcactctgaccgcccaggagcagcaggctgagtcagcctgtcccgcctttgaacttgtgtgcagctgcttgctttaattaggtgatatgtgggttcccttatcttcctgagagaagatttctcgctttaggtgatcggctattgacgccaatgtgggattagagttccttctctccagtttcccctcaggccctgttacaggatgtctgagataggaaaatcacatgtttgaacaagtggtgggtgagttgcttggcaggtcgtcaagactgatacctccagtgccctttcaggttggcaaagcacattcacatagaatctgatttgatccctggagaaaaggtatacaatactttggaaatgtcccatttcatagatgaggaaacgaaggctcaaagggatgaagagtcttgctcagggccaagtagccagcagacagcaggtctgggaaccctatcccggtctggatccaatttattgccctctccttcagtgcaagctggtgtccacttggacttggttttcattgctcaaatcccttctcgcctaggtagggagcccctgaagggcacacagtcaaatgggccaagcacggcaggtgagaccctgacttctcatgaccccgtgttctggagttggagaaacttctgctagattgactggagatctgggttttcggttgtgatttttccattctcctaaaggtagacagcagaaataaaaatcctgaggcccaccgttgtct

SEQ ID NO: 87177 - DNA, 1413 bp, Homo sapiens
tgcatttgttgtgatctcgtgtggccctgctctcagctcaccccacttctcttggctgccaggtttccgtgttttgagaaaaacctaaaaaaactaccacctgcctctactactcgatctactttccccaaacccttctctgagtcagggttgagttttccctcccgcccaccctgggctgggggagatgtggtctctcactggtactttatggaagggtgtctttattcaatttgactgttgctattatgtggcgaagccttcaataaaagtcgtgatttatgagatgtgtgtggctgtggttgttttttcgttttctttcttctttttttttttttttgctttgtcatctatcagggagagaaaagccaggcctgatactttcttggcatatcctgtgttcagttaagaatgtcagctgtcggccatcaggaagttacttctcggattggcttctcctcccttttacctctcaccacagtcccctcttgaaacaggcagaggcccctgctgtcctgcaggctggcgataaggggcctgctggatgctgtggggagagaagtggggcccctggagtggcccctcgccctcttaaccctcctcagtggctatgcgttcagcacccggtcagctcttgattgtttaataggaagaggcaggcagtgctcttccaggggtttccagagttttctttgttctcgaatacggtgactccccacccctcccaacttctctttgttttttggcctggccactttagaaatcctttcttttctttcttttttttgttttccttttcctttttcttttctgcaaagtatgtgcatgttagataaaggctcttgaatagaaggcctagcatattgggtattggctgctgaaaataggctaattggagatagaagcaagttgtcacagaggtgccgtgctagggggtgggaggaggatgaaccccagccaatgccaggatgactgtttccacctctcccctcttcccgctcttattattagctgtttgctgaaacgcacccatgtctttgtggagccacccacaatagcattaaccacgttgtgccctgcatcttaagcacctggttaaggccctgttctacgtctggaattggtccatgctgagcccccagagcgtgcgtaaatcaagtctttaacccacagcgggcggcctgggcaggaccgtggaaggtaggcctgctgaacttgagtggagtgtgtgcccctgggtttctaagcggcggcttctgaggcagagccacccagactttcattttggttagtagcggtgcttgtcagcaagttagaaacttggaaggcccccatcgttctggcctcctaacagggagagtgaagcgggggcaagctgggggacctgtaagtgcccactgggatttattcaaa

SEQ ID NO: 87178 - DNA, 1045 bp, Homo sapiens
ttaacttccattctagagggtgcattgaccacaacccttctgaagcttccattctggagggtgcattgaccatggtcctcccttctgaagcctccatgctggaggggacattgaccacgaccctcccttctgaagcctccatgctggagggtgcattgaccatggccctcccttatgaagcacaccttctgtggggcatcctgatggcagctgatttgactatgagtccctagcccagtaccttgtacgtagcagacactcaacaaatgtttgtggagggaatgattaagtgttgttggacaaatgaggtttaactgtacagatttttctttcttgagggaagggaaccagattttgttaagtgcttgccaggtgcagggcaacttccccttagaagaccctgggcttccaggcagaagtgcccttcagagagagccacacgccatttgctgggccatgtgtctgatttgacagccctccagggtgaactacaaaatgagccctccatgttccggctgacagctacaggtccccagttgcctctttgcctcaataaacagccagcccagaccagttagctgggttgggcgcattggggaatatatcttttccttttttctttttcattgtttggttggcctagtgcaagtgttttaaatagaacagacatcatggctataaaacatctgtaacactacacatttagtaaagttcctggcggactgagttctgtttgattggtgatatttttgctgcgactgttgtttccttttctcttctgtttatccctctggaaaataagttttcttttatgtgaggatttatagaaatatgttcctggcatgtggagagcatggatgtattaggatattggtgtagcagagaaatattacctccgaggcatggccagctttatctcatagagagtgatcttcctaatgtgcaacagtctgttactctttacagggtcaggagctacctaggttaaggcagataaagacactgccttgtgttgaggtagcatatcatttttgctagagcatct

SEQ ID NO: 87179 - DNA, 1046 bp, Homo sapiens
cttcttacagagccctggctgcatattagaatgttctggggagtgtttaaaaatactgatgcccaggtctcaccttgaaccaatgagatccctgagggtggggcccaggtatcagtaagttttaacgacccccaccccgcaggccatgcgaatgtgcagccagaattgagaacctctgcactacaggagtgtcagtgtgtggattaggtaaaacttgctcatcagaaactgattgccacgtacatctaaaatatggtaatgaaggtaatcaaggctaagggttgaggctgccatttgttcttttcgtgaaatcaactggagggtttgggggatggggtaacttggctttagaacctgcctaccagcaaagtttttatacactcgctcctaagaagagcaggccagattgttgctgatgagaacaggcctcgttctggcaggtggctcccagtttactggagagatgggctctggaaatcctctcttggtctggcttctctctgaagcttggttttccttaagttgtggtgtatccgagggtctgtagtctcggccattccttctaacatggtttctcagcctgtctgtgatgtttcccaaatgtcatagtgaaggactcagaggttccccaagatgatagatcgggggtggctatttacttctgtttacagggaactttgacatgctcaacttttgtgtagaaaccattttccctggtagttgctacccagataaatggaaatgttttgggaaaagagcaatttgggagctctgagcttgtcaccaaggttgtgtgttcctaaatcctgcagcctgtacttgggctggtttcttttaccctgagcacagccggtgtgaagagcctcaggcatttctcagcgtgggaataggcactgaggagattccagccaggaggagaagctgggagaaaggttgcgctggaggagacagaacccttgtgtggatggtgttctcagggttacgatttcacatttgttgtttcagcttgtgttatttcagccagtgtcctaggcctgttttataga

SEQ ID NO: 87180 - DNA, 1054 bp, Homo sapiens
gtctccaggtgcgaggtcagcgtctgtgttgcttgcagacgtataccagcaccaagcacaaacagctcagcgtagacagcctgtgcgtacttttgaatcgtgtgcatttcttattgacaggttttgtggatggtttctgggcagcagtttttatgcatttgggtctgttttgttcacgtctcttagctttaaaatagcttgacatgtgatttttctctttttgctagtccatcagaatgaagttgcgtgttgtggctaatgaggttctgaagtctctgtgtctgtatgaaactcaagcttttaggttgccatctgaatgcctgagatatgcagagtgactgtctctagcatccttagacatctaaacgcccgcgccatgcagcttgaatatatctaaaattgccttcctagagaaatgtggagagcagattgtttcagcagcctcttgagccctgctttagataacctggttaacccatgcctttctcttgtcatttcttgcagatggtcacaagaacaaagaaaatatttgtaggcgggttatctgcgaacacagtagtggaagatgtaaagcaatatttcgagcagtttggcaaggtaagcgctggatggggttggatggcacatgccagaagtagcctcatcagtcctaagaagaggctaccgtggcccccgcccctgctacagctgtgtcctcaagaaccttgtccttgaacctggccatcatgatttaagtgaaattcagcagaagctgagatggaagagtctggcttgcatttggtgtgatgtcccacgtgctggcaggagcagacagagtggccttttagtgcagttttgcgggcatttgctggccacacggggcctgggctgggagctggtggtgacggcagctggggagggatgtggggctgtgactcgcagggcaggagctcccatggaagctgctagaggcctgcaggttggtgctgggcttctcccttctgtgcctgtttggaaaatgcattgagagctgagtctccctggggccctttgcagctgaaccctcccctgtcaa

SEQ ID NO: 87181 - DNA, 2429 bp, Homo sapiens
gacatgtcaccgtgggtgaggtgtttaattcggcctctttctagtgggtgaagggagatggtgccttgagagtgggttcttgctgaggatgacacattcctcagatggccctgttgccttaggagggctgacccttgttggcttttgtgtataccaccctcctctggcccctgtggaaatggcaggttcaaggaggctgcgtcctgcatctttgagtaattgtggacatcgcgtgggagcccaggtctgggacagtctcctcctgacaggtttgggtcttccctgctgaagggctgacatgggagagagctgctgaggcgtcctgagaagacacagtgcccgtgctaagctccatcacttgtttcctcccacgatgggtgtcgtgcttgccatgggtacaaaggcacagccacccactggccaggctgaaggttctgtgctgttggtttgcccagggtgataggcagctatgaccctgtccccaggtgtgtctgtttgtgaactactgtctgggatgagggccatgacctttattcagcctcaaaatggagatgttcttgtctctggtattaatttctgcctggataggagaccgtgcaacaaagagaagccagcctcctccagcccagccttgcattctgagtggctctgagctgcccttccaggttggttttgaaaaggcctcccccatggccctttctggtattgtcagctggggatggattcattctggctgggtctaaagaatagccaagtgtgttgatgactgtgtacgttatagcacttctctcttccagactgatgtaaagcagtaagggggatttgtccatcacccagccccaccctgcctagggagagggattggaaataattaaatgagacaggtccggcttgcataatggaaagctctggagggtgagccctctttgctatctttctgcttttaaaacaagtccaggggtagtgtttgcaaacatgaagtgggatttctttttcgagccataacctgccttggaatctcatgggcctatttgtgtcagaaaagtcggtgctgcccagatgggcttttagagtattccagacaggcttctacttgccaacacatagcacatctctgcacgtccccaacccttggtttctttctgtctctctctctctctttcttcctttctgtatttctgtttctctctctgttgtttttcattaacacttatcattgtgacccagtatgcctccagtaagacacactgcaagctttggccatgcccacagtggccaccattgctgcccttagaacagttgtccttttgtctgagaagcagtcacaaaccatcttccctggcatggcactcgctgggtctgaagctgcccagttaattttgcagtaatgtttgtggactctggcaggatgtgcagacttatcaagtgttttattaaaagaccaaagaggcttttgaatgtatcaaagccataatgctcttcaatgctcatattttagtagcttttttttcatacataggttctgtgcattatttgtgtctgtctgcagaatggcttatttctcatttggctggtggcttgtgttactgtgtgtgtccccttgggcaggactcaccacctctcaggattctggcataacttatttgaatccagaatgatcaaagtcagggagactctgctgctgggccttgggagcactacaatgattaaatccagtggttgtgaaaggaggtaacaggtaaattgacagactgcctctccccttcggtactttatactctggttgaaggaaacagaatgaatgtgcacacacacacacacacacacacacacacacttgcatgaagtatattcacacacatgtgtacaccccctgtgcacacacatttctaactgtatgaaattgtttttgactctctttaaccaactgcaatttaatgaggtgtatgcgagtgcaaagtgtgggatactaggccaggccatttactcacattatctcatttaatttttctctggggggctggtagtggtattctccatgttgtagactgttaagtggggtcttgatgggattgtctcttggactcaaggtcacagctctccaggaggtagagctgggtgtggactccccctccaggcttgtctgataacagcatctgaactctgcaccctgtgccaactgctgatcagtccccaagatggactgacgatgggcaagatgcaaaggacaggaagatattgtgcccttcagtgtgccccggagtgctggggacctggacattcatcacctcattttacctgtgcagcagatattggtatcctccagtctatttggcgaaggtagacagtcagggccagggaggctgagtgtcagcagaggtcacccaggtaagacagtgtaagagccagaattcataccctacttcctt

SEQ ID NO: 87182 - DNA, 1019 bp, Homo sapiens
tctgtgttactgccaaagttctgtttcattaggcctacaagtcatttccaattcagtgggctgctacaatccggcctttatcacgggctgctctggttcccatgtcccttctgggccagtgcctgagtttgtggtttgacatgagggctttaaccccttcctgtgccagcccctcactgtggtggccgggaagaaaaggccttccaggaaccggcgtggaaagttacagctcttgaggtctcgtcaaagtgggagatcgctgtggaaaccaggtgaaagggtccttggagccctttgtgtcggattggggttgtgtgggggcccataaaagttaacttgagctctggagaatggtgtgtgaaagctttttaggggaagaaaaaaagaaaacaagagtgaattgttttttttaatgtaatgagaccttcccgtttatccggccagcgtgggcgattgtgggtgagtgaggcccgaggaagcgctgggtgcctgcgatctcccagctccggggttttctgtgcaggtgcgaagctgcattcatggcccccactcagacaccccttttgatactgtatgtgtgaggagagtcatacctggaataaaagtctcataaagccctttgaaatttaaaaggcatgagatctgtgagaagataaataagcctgagagtggactgtgatcctcaggtagtgttttcttgctttaaatgtgtgtcgtagataaacagagctctgtgcagtgtggttctctcagaggaggcttggaaaacaaaagtcttgtgtgtcctttgtggacatctgagctcccgtgaggctttgtcctctgaagtggttcatgtaggtgggttgcccggggagtggtcagcctcccgggcctcaccctgtcctctgctccacctttttctggagagcctgggtgttgcccttcagaccttcttcaacgacaattgtaggctggaccaggaaggaccatgcgcacgctcttccctggctgaaggctacttttgtgtttaaattttc

SEQ ID NO: 87183 - DNA, 3005 bp, Homo sapiens
tgtttgaccgcatttcctggtatgatttagctgtatttactttttctgctgcggcaaggagaggagagccagcggtaggggagcccttgggcacaaaggagttaatgagccctgggtgggtaggggcgggggggcggtatgaagtacttccaccagctcaccttcccagagtcctcctgggccctctgaagacgtcacttaacaatggagttgttagtaggagaaaataaagcctttttctccctagatgtagttcagtgggaactgaaagtgtaccagaaatcatggttcaagcttgtgccagtgggtgcaaggggtggttcttatggaggagaaagcgcagttcatttagacttggcattgaaatcgaactctgttgttcggtggagtgaacattgatatggagattcccacccgccccccacctccgtaggatacccccttacacaggtcctgtatgcttttctttttcttccattttctttctttattttcttcttttgtcctcttagaaatagtctctctgtagaccggccagatttgtcaagttaccaccctctaaatttttacagctccgtatattcagacttggtatttgtgaattagctaaaagtgggctgccaatctgtactttatttacattcgaagccatattagtgagagccccagaaaaaaatgttaatatgcaggaagaggcaaaagggttgagtttctgactgttgctaacctcaccactgcctttaaaaccaatcatgaggcacacggctgatatttaatagcttttagctgattatttttcttctcctcctctttcttttctatccaagttgacctgggtgtacttgagtggaaatgaagtcatccaaatgctgaattagaataatcacaggcctctaagaatgaaatggaagcagagattaaatggcggagggaaagccggcattaataaggaccaggaaaactttgcataaaataaataggagatggaatagattgaatttgtatatgctgcttccatttcttcctccattttgtgttgtcttcctaagtcgagttactggcaaagtgggatttgatttgccacaaggactcataccttctgcagcctaggtgatgggcctttcttctttgtgggacgtttgtgtgaccattgatgtttccaggaaggaagaatctgatggaggggctgttaccatgaaatgttgatgattacttggtacaagtagtgcgtgggagacagatgaaagagtgtggggcacaggcacagtggctcacgcctgtaatcccagcactttggggggccaaggcgggcgaatcatgaggtcaggagttcgagaccagcctggccaacatggtgaaaccctgtctctactaaaaatacaaaaaattaactgagcgtggtggtgggcacctgtaatcccagctactcgggaggttgaggcaggagaatctcttgaacccaggaggtggaggttgcagtgagccgagatcgtgccactgcactctagcccgggtgacagtgtgagactctgtctccaaaaaaaaaaaaaaaaatggggagtatgggagccagtgcaccacaggccaacttaatattatgatgattcctcctcgtagggagaagacctgggcaggatgcaggtagggtgactggttgtctgggtttgcctgtgactaagggggtttctaggaacttgggccttgcaaactagaatgaattggtcaccttcaagcggagtctggagaagtcaagacacttggcctgacactctaaaagggtcagcatcttccttgaccacctccaaggagatttaaatactccttcctgcgtgctccagaacactaacttcatacctgtttacattctgccttcttcatttaatccagctgctgggtaaacagccagcatggggccttgcgtgagcacaggccggcaagtgttagatgagcaagtggctgctgaaggcaggtcagacagacccacagtctgtctgtctgtgcacccctctgggcttctatttggcgattatttctgtgtctcttgaaaaaaaaaattctgccccaatgtagcgaaaagtgagcttcttgtagttaaagagcaaaataaggatttaattaaattaaaaaaaaaagaaaagaaaacccagcagagtggtttgtttacaggaagtcgtttttaggtggtctgttatagaagatgtaatttgtgaaagtagattagttgtaaattagagattttgggttgtcgaggtcgctaaccatcttttataattggcggcagaggtaaatattttcagatttgcttatagagtgttagtattgacaaaacaatttaaggtgtttttcacttaaggaaaaataagtgagagtatggaatgatcagagacgggcttcctgatcttattcccagctttcttatggaatgacaagggtatggaaagcaacagggagatgaaatgctggagtagtttgcaagggagcttgcagattctctgatagggaaacagttttatttatttgtttatttattttattttacttatttatttagagacagggtctcactatggtttcccaggctggagtgcagcagcacgatttcagctcactgcagcctcagtctctggggctcaggtgattccccaacctcagcctcccaagtagctaggactacaggcatgcaccaccatgcctggctaatttttttgtatttttagtagagacagggtttcaccgtgttgccgaggctggtctcaaactcctggactcaagtgatctgcctgcctcagcctcccaaagtgttgggattacaggcgtgagccaccacactcagccgatttttattctttaataagagcaacccatttcttttatcaacagacttgttttcttagcaaaaagggaggacgtattgatgtcactgctttccattcaactaagttggtatttgtgttcagatttagggattcctgtttgcccgaaccgttcatgtatcttttaccttg

SEQ ID NO: 87184 - DNA, 1052 bp, Homo sapiens
tctgtatcggagggcagggaagttccagtcattggagaaggagtttcaaagggtaaaattaggattttttttttttttgagacagagtttcactcttgttgcccaagctggagtgcagtggtgcaatcttggctcactgcagcctctgcctcctgggttcaagcaactctcctgcctcagcctcccaagtagctgggattataggcgcctgtcaccacgcttggctaattttttgtattttttgtagagatgatgtttcgccatgttggccaggctggtctcaaactcctggccttaaaaggaggtgagcatctgcccgtgttggcctcccaaaatgctgggattacaggcatgagccaccctgcccagccaggatttttctttttaaaatggggcattaagagagtatattccattatctggagcatttccttatgtgaaacccattatttccctgcatcctaggatcccttagctatttccaacccgcagcaaaagcttaatagaactaagggaatatctgggcagggtgagctggtcagtaatgcccttttcagagtcggtagattctcaggcaggtttcggcatagagggtagacacagagaagggaaggatgtcaggagggtaaaaattgggatatgcaactctgtttcatcttctctccttctcttctttctgtctttggtctaagaaaagcagtagacttgctgcttgggaggtaccagggtaggtcagtgactttgaaaagctggtgagacggtgagagcgttgactcatctaggctcatagatgttatggatcctctgggcaccagggatgggggtacttggatgggcatcgggcagtttctctcccagacttgccgtcttgtgatcagccagggtggggaatgaaaatgggtccaacaacattaagccacagcacaatcctccctgatgttgagaaatctggctgtggacatggagaatgtgtttgtgggtacatttttgcctctcgaatgaaccgaatttgccattggcatttactgccagactgtcgggaattatgtggg

SEQ ID NO: 87185 - DNA, 1084 bp, Homo sapiens
ggaggagaggaggaagcccagagtgtgacttgccccacacacccctggatatcacagtcctgcccctgcccattttggaaagaaccacatggagagggctcacttccatggacctgaaatcgtgagtttgactttgtcatcagctgcagagcaaggagggaggcagtttacatctggatgcctgcattcaccttgcccagagatgctgactgctgaggatgcacctcagggctttacagatgctccccttcttgccatgttcagtctcctccctgagatcttacccctcaacccccaagaagccacaaggcaggtctgcttgtttgacccatgagtggaacggtagatgtgatcttttcaatgtgaaagaacctcagcgaacattagtcagggtgtctcagttataattcagtctcattattgcctcccggatgtgattaacctgggatctgctcatgaagggatttggccgcccaaggaaatggacaaagatgatggatcaggtgcacctgggacagaatgacagctgaagtcagtggttttctgctaaacccataacttaaccactggttgaaagtctgtatcaggtgtcccaaatcaaatgtattgattctagatgcctttttgtaaagaggcaataaaaagaaataccatttattttcacaattgttccttcctccctgtgtctaggaattacagagtcattgttattattcctcctctcattcgtagctccaagtacatagagagcagggcttgacacactttgtctgtaaagggtcagataccaaatattttagactctgtgggccatacggtctctgtccctgctactcggttctgctgttgtagcacaaaagcagccatagacaatatgtaaatgaatgagtgtggctgtgttccaattccacttttatttacaaaaacaggcagcaggcctgtgggccgtaagttgctatcccctgttatagacagtcctagtcgtcaacttgacgtctcaaagaaagcagcgatttcatagaactgaggatattttcaggatcagtaataaactttaggggcatggctatgctcatttgaaata

SEQ ID NO: 87186 - DNA, 2049 bp, Homo sapiens
ccacaaacgtgtgcaaaggcttgctcgtcatgcaacacttatctggccacattcctgaaagtggaaggccaaagtgggaacttttatgcagctttatgcgacgggtccttgactctgctcactcacatctataagctgagaatttggtggtaatcacttttctaaaagaggaaaaaatggatccacatggattaatctgcactgtttaggtctgtaaaaaaccagtgacattgacatgtcaatgaaaatggtggaaattaacacttggaaatttttatataaaacctttattgaaaattcagttaaacattcacacactaaaaagagctctatatttataactgaaaaactcaatttgatgcaagctgcttatttctccattgtggtcacgtgggctgaggttcttagtatgaaatgtaatttacacaaattagtccaaggcaggtagagtgtgaaattaaattgatgccttgatttctgtattctctagttaagtgtttctctgaaaattcgtcatttctgtcctaggaactttaaagtatggaggttttctttttttttttttttaaatagagcaaagaagttcttactggttaaggacatgaaacaaccttaattacaggctaaaaaggcacgttccattttgttttgtggctaaatattagagtgacccccaaattgggctgccagtagaggtagaaaacttgggctttaacgcaattattacatttttctttttttttttttgagatggagtctcactctgtcacccaggctggagtgcagtggctcagtctcagctcactgcaacctccgcctcccaggttcaagcgattctcctgcctcagcctcccgagtagctgggattacaggtgctcatcagcatgcctggctaattttttttttttttttgtatttttagtagagaagggatttcaccatgttggccaggctggtctcgaactcctgacctcaggtgatccacccacctcagcctcccaaagtgcagggattacaggcatgagccactgtgccagccagctagtacatttctcaactagctgcaccaagccatctaatttctttggttgtgatgagaacaggttagggctgttagctgtgtagacctagaaggggctttgcagacccttttacagatgagaaaactgaggctcatgaataacattctgaccttggtctcttcggtcaggacgccgtggaccctggctgggcctgcttctgcccctgagtccgcactgctgcctctcactgaggacagttgtcggtgttggtgtcagattgtgtcagtaatcgtagtaagaatgaatcaagtatggggtatcctggttcaaatttgataatccaagaggaaggagaatcactacttgcccagaaataatggaaggccaagatgatctgacgaccttgtaaggagatcaccagtgctctgggactgaacccatctgctgggtcctggggtagctctgttgactgccctctgctgaaaaggagtcaggttgcacctctagggtccaggacgcaggtgattgcattttatcagcatctttctcacaggccaccctccagcaaggtagacatgggtcagccctgccaactttggaatgaatcatttctttcaaataactagcgactgacgttcggggcagtctgaaaaatgaattatgggctctcacgatttttatttgtccatggtggcataggtggtatttatctctcttgtccttgctctcccccacttttggagcctttgtctctgtctgagtcagcatgacatggtttgaaaattgcctgtttggcttttaatgatgattaatgtccatagccatgtttcaaatttaggatctcttgaagagtctccgagaccgttaccaagagcaacctgccgagggagtcggcgcagagctccgtactttcccagcctgaattagattcctcccaaacttctccatctttccaccagcaccccgtgggcccttcttgggtctttgacaccaggagctgagctggcctgcccatctggcaagctcc

SEQ ID NO: 87187 - DNA, 1963 bp, Homo sapiens
gttctgagctacatcccaagttgcccaaagtcaggttaagtccagcataatttgccatttgttaaagtatgcctgttgatttgtcatctttccttcttgacttccctccctcagcacagatctctcatgccagtagtcaaatataaaatttttcatacccacccagcgttttgcatgggttcttcactctctcctgcccgcccctcctcaccaaatgagttctttctttgcgaagctggagccaaaccaccaaaatgccacaaagacatgtggcgcagctttttccagtttttctcttgcggtagttacaatattattaaaaatccattaaattttaatgtaccctataaaatatgtgctcttgtgaaagcaagcacagataattatttctgatgaataaaccaagaggacaagtatgtatgaagttcatgctgcagcattcaatttttattatatacatctcctgcaggggcaatcactgtgatgttccagctggttgtgtggagggctggttcttctcagagatcctttggggcagcatgaaccctgaactctccgaatgttctcagagcttgttattacctggaaagagagagccctgtgtaggagctgtcttctgttaagctcttcaaacaaaagaatgaaggactaaatgaatcaggatgagaaaaatgcagtctctctaatactccaaggtatccttctgggatgaggagggaaaaatcagacatacatttgaagatcttctacctagtagctctgttcccttgagccagtctcttagcttctctgagtatttgtttcctaaatgggagatgagcgttctctctgccttggggcttaacagaggcacagaagagcctgtgtctggctcagagtgggaattctgacttgcggtttccctctttcagtctttttcttcttcttctggagatcctttgaaagttttctcatagctccagaagttggaaaacagagctgctgcctggcctcctggagtctgtgtggtgtgaggcttgggagccattaacacatgactatctagtgtcacagctgctggctctggacatctcctgatgcttcaggggtggcttccatattggtttccagaggctgcatgcacctgccaggtggatggaagtgtttcccatgggagttgctgggcccctgtctgccttctcggggtgcctgtggcctctgtgcctgatgactctagggcaggggtctgatgactccaggacagccagtgtcatccctttgcttgcagatgaggtggcttagaaccaagagggaggagcttagcccagcagaccctcctgggatttgttggaggctgtgcttgggagtcggacacctgatctgctttgcaattttatgaggtccaacttctgatcctcagcgaggccccatttccttcctggggcagggttagtcatccggccctgcaggaggtggggcaggactcaggaagcacttggaatggcctggaaatcatgggctataaaagcctttcttcccagggtggcggagtgcactactctcacatttaatcctgcccggtatcctgaagaggggagggccagggttgtaggtgagttgcatggagttattctggaatattccacaactacagttgggactcagctgctgggatcagtggtgaagaaagtcccacattttgcacagaattgggtgatctgtaaatgaaggaagtttatttttaacagcattatgattttgtttaaaaacgaaaagacatactagaaaaaattaaatacataagtaaacagagaactaacaaatcctctcatctcatcaccatgagataacccacagtaacattttggtgtaggcttccagaggtctgtctgcacatatataaactacggttgtgtacacttttatataaatgagatcatatgtggtgtttgccagatggccttttctggtcagtagtatgtca

SEQ ID NO: 87188 - DNA, 2047 bp, Homo sapiens
accctacatggtcatatttgttgccttcattgtttctgtgatatcgatgcactatgattgacttacgcaaacccttagttaggatcatttaggttgtttgcagtatcattatgatcattgtttggtattatagccagttctggcaggaccgcccttgtgcatgcatttctctcctgctcctgcaatacttttgacctagcaattccacttctaggaatttacaataaggagataataatacgttttacaatttgctatttattgccaaactgccccacagggaggttgtactaatttacatttctaccagttaaggcagcataagagtgagcttgagcttttggtcttaggatttttgtgcccaagtctttctaaaatttacattcctctgaaatttgtcatatggaacatttttttttaatattgaagagtgaggaatctgttataccttgacttttaaatacttgttacattgcctctctgttctctgataatccatgaagttgtaaatggttttgactgagtgagatacatgcaggagagtttcaggatagaccgggggttgtgtttctgtttcagattgtcatcttgaaacaaaaatggtggcaaataaaatgttttcaagtggatgtgtttagtcgtgatttttaatgggtttttgatcattgttcctagctgcataccggttttgtcctagacaggatatagctgaagacaaatactgactttttccttcatctaatacatttggcaattacgtcttgccttgtgaaagcattaccattgttatttaaattttgcattgctcttttaagataacgttcagcttgttgcctgtttatctcttccctcctgctgctcttgtgtgcgtcctcacggcacatggggcagtgccctacactcagtagtcacccagtacccattttgggatttttctccaattataaagttttagcattaggaggtctctgagagtcaacttttccccaattgtagacatgtttttgatcttacatacattttaatttatttttttcattcagtagtaaatggttgttgagtgcttttgatgtaccaggtgctgaggtgactgtgccgtgacagtgtccccatcctcgtgcaggtgatgaatgggtgtccatacagccttggaaatgcacaggcctggggcacaggcctttttcctctcctgttgttaccttttacatctgcatttgataaaaaccttctccagagaaaggcttagagttcacagaacctttatttcaatggaggtctgcagtgttcagcgttagagtgaagattttcatgaagcatggcctgacagagaagtgtttgaggaagagattaaatggaagcaaactctttccatctcttggggaaatgggagatgcgggtgtccactggagccagggcttctaaattttaaaatcacttcttcaccaggctgaagccggggtgcccccacggaaggtactgttgaattgcttcgaaggtttctcattgagagaagctctctgtttctcctagttgggactggcatgaataaaagcagaggccaggcgtggtggctcacatctgtaatcccagcactttgggaggcagaggtgggtgggtcagctgaggtctggtgttcaagaccagcctggccaacatggtgaaaccctgtctctaataaaaatacaaaaattagctgagttgtggtgatgcatgcctgtaatcccagctacttgggaggctgaggcaggagaattgcttgaacctaggaggtggaggttgcagtgagcggagatcgcaccactgcactccagcctgggtgacagagtaagactctgtctccaaaaaaaaaaaataaataaaagaaaataaaagaaaaaatgtaaaggcaggaatgtgtacaggacctcacgggatgtggggaaaccagcctggttgcagttgagggtatgagtgggaccctacttctctcccgctgatgaatgaaatgtataaaaccaccttcctcattatgtggtcctaaggctgaaatgaggccacgtacgtaaag

SEQ ID NO: 87189 - DNA, 1003 bp, Homo sapiens
ggttagtaaatgttgccatgtcattaattattaatacattgaattacaaagttatttaatccagcctctccatccaatccatatgggaatctcatccgcagtattcctgacaaatttgatttgttaggaatctcttttaatctttcatatttgatcggcttttaatggtttaaggaagaacatttcaggagtaaaaatctgcttccctgcttaaagagcacatagttccttattttggctttgtgagctctgcagtgggacaactctttccctttcccacatattttgaataattctttaatatatattgacatagatattactatatattatatagattagctatatagacatataaaagatattttcactgtctcagcaaggggaatgcagcaggaaaacagggtgatagtggggagaaagtcagcaagaaaacgtgagcaaaggaatgtttgtatatcagtgctttgatatacatgttagtggttctcaaatttggctatatattataatgatctaaagagcttttcaaaaatacaaattcatggacccatctttggagattagatggtaggactgtggtaaaatctgaacatctttgtttgtttttatgagacaaggtcttactctgtcacccaggctggtgtgcagtggcatgatcgtggctcactgaagcctccatctctgggctcaagcaatcctcccacctcagcctccctaagtgttgggattacaggcatgagccaccccacctggcctttattttattttattttttaaaagagatgtggccttgccctgtcacccaggctggacccatgctggagtgtagtggcctgatcatggttcactgcagcctcaaactcctgggcacaagtgatgcccccacctcagcctcctaagaacccaggattataggtgtgtgccactgcttctggctgggcatctttttttaaaagtcctaatgtacagctgcaattgtgaaacattcattacctgtttt

SEQ ID NO: 87190 - DNA, 1029 bp, Homo sapiens
atggagagctagtggtccttcctggatctgcgtgtcctcagtctaacccctgcagatctcccttcatgtggggagggccttctagatggcacctgggctatgccgacttaaccctgcatttcaggctgatcccacacagcctccaaataggcactattgctctaaggtgtctgggagagaaaaggttggccccggttttggaaactttggggttttgcgtgtgtctaaaaagattatcttcagtagttttgctctcccagtgagaaaaggagaggctgatcatgtgctgccagacactgggcaaagggtgatgtttgtaatgaccatccagtgactcctgctgccgctgtccttcctgcctggatgtttttggagcttccgtctactcattcagcatccagggaggctgtgatgaagtaaggaccatctgttagggaccagatagcaaggacatttgcagcgcattgaaggttggcctggatgaccagcaagggtttttcctgccctgcatgcctggactcccacctccccacccctggttaggcttcctggttgtggggagtcatagccagtggagctctagtctgtaacaaacacaccatcggaacaacaaaccctcaggtctttcacattgattagataattaaaaaaaaaaaaaaacaattaaaatagctaagcaaaagggagaatttccggtctcatcctggagaaccagcattctggtgtgtgtccttccacactttgagcgcattcactctgcagttgtcacactggtgatgaacgtggacactgggagcaggcaggcctggctgccattcttgcccccatcacttcccaagtgtgtgaccttgggcaaattcatctgtaaaatggtgattcagtagaaagtatttgataggattgggagtcttaagggaaacagatgcatggaagtcctcagcagaggacctcacacacagtgaattctcaatccgatgtttatttaaatcatatgtgccttgttatttgtaaggatggaactccctgcaa

SEQ ID NO: 87191 - DNA, 1048 bp, Homo sapiens
atttgaagggctgccctctctggaatcaggcagtctgtccttgggatgagatgctagctggccctttggcttcttccttagagatgtttatgctcatggcctcggccactctccctcttcctccaggtttccgccggcagcccaggcctctccctgtctgactcccccactccctttctgctgggcatttccatttgaatgttccaggctcatctcaccttcgccctcctcacactgacctcactgactccagtctggtctcctgccctgagtccctgtctaggagaagaatggcgtttctgacagctcttcctgactcactcgttgagaccgatgcttatctgctaagcgattcctgtgttcactccttctctcttctgtctgctgtccccatcacaagcaagactgaaccccttctgcttcctgatgtgattccttgtcacggtccctcttgctccaacctgtgttgccctttgctaccagacgcgacttcctgaaatcctgttttcagcagacgatcctctgttcccaacttgcagtggctccctacttcctgccacagtgaatctacagtcctctcaactcagttcacgtccgtgggcccttccagagtgacaggcaccatgatcagtgctgccacctccctttcgagaaaggatttgagacctgtgtggaacaactcggaaagggaggctcagacactgcaggcggcttctctaaggtgacacgccaagttgttgggtgtactgggttgaatggtgttctctcccaaattcgtgttcacctggaacctcagaatgtgaccttatttgtaaatagggtctttgcagatataattaggtaacatgctgttgggaggagggtgctaatgcagtgactggtatccttataagaagatctgaagtcgaacccaggacacacatggggagaagaccccgtgaacatagagacagggatcagagtgatgcatccacaagccatgggacaccaaggattgctaggagcccccagaaggcaggagcaaggcatgggacagactctccccaga

SEQ ID NO: 87192 - DNA, 1775 bp, Homo sapiens
cagtggtgtgatcttggctcactgtaacctccgcctcctgggtccaagcaattcttctgcctcagcctcacaagtagctggcactacaggcacctgccaccacacccagctaattttttgtattttggtagagacagggtttcaccgtgttgcctaggctgatctcgaactcctgaactcaggcaatctgcccgcctcggcctcccaaagtgccaggattacaggcatgagccaccgtacctggcccattttaacaattttgaaatatacattaccttatgattaactatagccactatgctgttctgtagatcactggaacttactactcctgtctaactgaaactttgtccagcatctccctttgaccagcaaaccctttgaccaacatctccctccttccccatgcacccccatcctctggtaacccccattctattaatactctctgtttctatgagttagactttttaagattccacatgtaagtgagatcatgtaatatttgtctttctgtacctgccttatttcacttaggataatgtcctctaggttcatccatgttgtttcaaaggatgtaatttcattgttttaagtctgagtagtgcatatatatatatacaccacattttttttttatccatttacccatcgatgggcacttaatttgtttccatgtcttggctattgtgaacagtgctgcagtgaacataaggccagccaattttgattgagtgtcttcaacatgtcaggtgctgtgttaggcactgggggatataagatggacaagactctcactttcatgaaacatacatttcagtggagggttgaggggaaaacactcagatggcaagcaaataacaaacatagcagagagttctctttgctatgaagaaaatttccactaatgtaagagagactgcttggggctactttcttttttattattttattatttttgttttttgttgatcttcccttgagttgcaacttggggctacttttgatgggggtggtaaggcaagtctctctcagaagctggttttgaagctaagccctgaatgaaggaagaggccagctgtgtgcagatatgggaggtagtcattcccgagagggagcaggcagtgcaaaggccctgtgacgggacagaatttggtagttcaagactcagaaggaagacaggtgtgatggcacctggtgtgttggggaagaggcagatgggccacgcagagccttgtgaaccaggggaagaagtttgaattttcttccaagtgccgtggaaagcctttggaaggttttaagcagacaagtgacaagatcagtgtttttaaaggtcactcagatttttctgtagagactggatagtggggagctaggagcaccaaaggtgatctggctttaatgcccagctcaattcttctgtcgtacacctctaatccactgtcttcctcccctgagctactcgtgcacttaaagtcaatacagcatgctcaccacttaattagaaaatcgtttctgcacactaaagagacctccccagccagggagggcctcagggctatgctgtctcacgtaagtctcctttggaatgcccctcggtccttggggatggattcattgcccttccaatgggactgagtgatggattcatgttttatgtgaaattgtcggaggggtagggggtaagcccatccctcctagaaaaaattttatccatccaggaactgccacactcttaataggagacttgggggatttgctctactatacacatg

SEQ ID NO: 87193 - DNA, 1782 bp, Homo sapiens
tttagagaaaacattttccccacccttcctgtcccttctcctgggttgactccagcaactcacctctcccagctgagaagtacttgacattggattcaaggacatcagagacacttacagcctggagcctggtgtgtgcattgttgatgaatccccaaggttgagccgagacttggatggtaggtcaagtgtctgttgaatatcagcagaaatattttccatcttcctgatgaggagggaatttcaggaagaacatttttggtgtctcatttcttgggattgcctttatcaatcgtgatgcatatttttgggcagtaaccttacttttggatttattttattccccatcctaactcatttcttcgtctatttttatcgtgttgtagctatttttgtaagacacctccaatccctttggaacaaaatgaagtggaaataaagaaatgaagtctcttggcttttgctcccagatcatcagaaagatgactcaatgagccagagctctttgatgccaataatgaacttgggtcaggtcagaactcgaattccaattgaaggagggacttgacagtgggactgtcattcctggggatgatggttggcaataggatggattgggggttgaattattggggacatgcctggagggactggggagaggagggaaagaatgttttcagcgggttgccaggtagaattccaatgttcactgcaatgaacttttcttcaaacttttgtccttggctctcttttcttccgtatgggacagggatgcatttttggtggcttgttaacaagacaaaaataaggagagggatgagaaaaggtaaacagagaaccctacaagttcatgtattctatgccctgcattctgtgtggaccaaacaattcccaaagaggcctaacccaaaataagttagtatcctgcttctagtagcctgtgataaagtgcatcttttttctacttaacttaatcaataaatatgaagtgcttaataccatggagaagaaggcaacaatggtctcaccttcatggggcctaatgtggtgtgactgaccaacattagagacgcacgcagaaagccgtgcacatgcacccgtgtaattacaaagtgccacaggtgctgtgaaaagaaagcacagtgtgtcctacaagagagaaggggaccttatttggattgggtggttatggagggccccttctgaacatgtttggccttctttgcagcagcctccacctcccagcgcctgggagacagtgcaccagtagaggtggggtggggcaggtggtttagcccgagctggggtgcctggctggggacgtgcccagaggagtagggtgtgcggaaggcaggatggggtccccacagcaagctttcctctccctgactgggccacctgttgcaaacagtcaggccccgaggaatagcctccccccagggggagttcagtaacgggtaccatttctcagaaggggctggccgcagagataagaccacagtgccaagggggccataaattgttacctgtgcccttcagttaccccttcttcctccatcccctccttcctgagccagtggggttagatttagcagcagggcttctgttcatgagatggagcagaaagcagactttctggaggctgggcatgatcactgagatgcagagcactgatagggaaaatcaatttaatttctgtggctccgtgacaaggaggggtggcaagcaggaaggtcaggcctgttttgaaagccacagttcagttaagaaaataaaacactc

SEQ ID NO: 87194 - DNA, 1070 bp, Homo sapiens
tttttttgagactgcgtttgtttcattcttgttgcccaggctggagtgcaatggcgcaggttgctcactgcaacccccgcctcctggattcaagcaattgtcctgcctcagcctcccaagtagctaggattacaggcacctgccaccacgcccggctatttgttttgcatttttagtagaaatggagtttcaccatgttggccaggctggtctcaaactcctgacctcaggtgatccgcagaggcataagccaccatgcccggcctaggaattttgttgtatgtctgttgagttgagttgctcaggacttgttgcagtaggggacactttcattaggtttctgtttcccgaggcatgatttaaggcacatttctccgtccctctggttgatgctggggaaggcttggcttctggcagtttttgattgctcagatcaagcctatgtgattcatgggattttacaggttggaggctgagaggtatttgtaggtctggatgaggatttgcactcaacctggttgtggcatgtcgtagtcaaactatggcctcacctgatttagaggacgaggaggactctgcagaaagcacttccttggctgttggtagagattagatatttgcgggcagagagttgggtcaacccaagccttcatcaacatcccacagggacctcccttgaggtgactttcattcattagatggaggatggcattgcaggtcctgtgccaggcactggggagataggctttgtctttttttttttttttttggtggcatctctcgctctgtcgctcaggctggagtgcagtggcacgatcttggctcactgcaacctctgcctcccgggttcaagtgattctcctgcctcagcctcctgagtagctgggattacaggcgtgcgccaccttgcccaactaattttttgtatttttagtagagaaggagctcacagcatagtagaaggctcagactttggactatttcctaagaatctgataagtgaatacatttccaggattcttagcggatggcccgaagtcttgggatagtgtgtgagggccagaggggaa

SEQ ID NO: 87195 - DNA, 1581 bp, Homo sapiens
gcggtgctggcctggggccatcttactcttcctttcttcctgacaggtgtgtagaatggcatctcctgccggcacgctgggggcctgggatacctctggcagacagtgctggaaatttaatgctccttgaaacaggagagcctgagaatgcttacaaaaatcatccttattaaagtttgaagggatgaagaaaagcgctaatgggagagaccctatacttacaaacccaccttgaaggggttaggggttacttcccacctgccagcaccttccctgctctgaggaaacaggaaacctgatggctgggggcttcagggctctggggacagctaccgtttgcggcctgtctgcctggctgatgtctgtgcctgtctgcagctgaaggcccacttaggacaacaaaatccagccaagccggctggctggggctgagtggggccttttggcttcaggtgactttgtggcttcggccttgggtaaagggagtggggggccatgtgtggagccctctggaaggtctggactcctgcttttccttggctcttctcgttctccaaccacccccaaggttcagcagagtcttgggcgcgtctcctccgtttgtgccgcgtgtttgtggcagcagctgttggtgctgactaataggacttcctggcagctgtgccgggcacacgtggcaccggcaggaactgcctctcctcggctgcccaatctgtaccccaaccaccaaagaaaggcctggaaaaggggctgagagaggctgcttgagtgggaaagccctagaacttggtgactcacagatccatagaacacggttggaagaaccaactcccatctgcagaggggagcactgggtgcctaggaggggtctctcaggtcgaagagcaagttaggggctgagctgacacgtaaaaccccatctcctccctgccccctgaatgtgtttgctctgcccgtgtgagacaggcttgtcagggggtcagcctgaaccgtgtcactcactagctgtgtccttgggcaaagcttttcacctctctgtacctcagttcctccagagacaaaaggggatcatcattgtccctaccttaggggcttttgaggacagggtgagcacccagggcaacgtgcctgggacagtaaacctcagcagatgccactttgctttcttccttaccaaaaactgggcagatgcctctctcctcctgagtccagtggtgtctgtgtcagatgccctaacggattctcaggaattgcagctgacatccggtcatcatctttggtttggggtggatgggggcagagccagggaagaagacaagaaacgggagaacctaagtgcttgctgacttctgccccattcccctcaccccaaacccttttttagaaaggactcgagaggccttttagggtcaagattaccaaggcctgagtgaccctgcagaattcctgcacatggctaggcatcctttgtctgataatgacagccactgctcacacagcgtctacagtgcaccgtcagcagccttaggaggcagattctattatctgctctagtttacaggcaagaacacagcacgggcc

SEQ ID NO: 87196 - DNA, 1001 bp, Homo sapiens
tgatatctgggcgtttttcatagaaattccatgatggatgttttccccaggatgcactgccagtgtcccaaagagagacttatcagttaaacctgcctggctccagaggagtcgccgcagacttcctggtaaatacccccgagccaggaatgcgtttgtgaaatttttaggagatgatcccagaaaagcttccttcggtcaccaagccgcgtgtttgtgtctggagatgaagtgtgtgaaggaagatgtttgctcctgaaatgagacattttgtacatacaagccttttatgtgacattgaagtcagatgctgagctgtccgatgctggggtttgaaggtgaaagttgactttacctcctgtagtgacaaagttctgtgtcagcctgaatttcaatttcctgggacttttgtctgtctacagctcaacatggtatcctcagcacctttggggtcttttgttgtgttgtttgtttttttggtggttaggggagggatgggttagtgacagggcggtgggggggggtgcatttaatcatttattctttttagtaggtttaattgtataaagattataatgcatacaaacgtctgtaattaggggagttggttctattagacaatgttttagtgaggaaaattacagtgtttataagccgtttaaggagggggcagcatatattaacatgcaactagtttttgtgaattcataccgagtacttaccagtgttccccggaggtgtctccccgaattccaaagtgtgccccgttctatgtgcttcctgggcttccttcagcagaaccaggccatttttcagaatatggaacgctattctaggggcttaggagagcaaaccttgttctgtgacggaatgagtttcgttgattcacgagacaaatgtttaggaatgccctgtctctgccaggcactgttccgggtattggggatacagaggtgagtaagacggcaagctctttgctctcatgaagtttgtaatctaat

SEQ ID NO: 87197 - DNA, 2030 bp, Homo sapiens
ccatgttttatctgagtcctgatcctcctgtcacatgagtacggcccagctgacacagctgtgcagtcaagccctgggttggatgataagtatgtggagtggcatgggtggggggggtgtctcaggttttatagccaaactcccagaagccccttttccctctttgacaactggaagtccagatgatccaaccctcagaggatggatcatcccctgaggagtgcacgacccagtgcctgcgttctatgccattgtcactctggaaccacctgcttggcttctggaatgacacgtttgatcatcgctgtcttcctcttatctttccccagcccccactgacactgacaatttacttctgtctttggggctatgaaccatgacaggggtggagaaggagtggggatagagatgagaccaagatacttcttgatatctgtggaagcctcagataccaagaagcccttcatctgaaatatcactgacgtgtctctcctagttggtttggagcaagttgtgagcactgaggactatcagtttaggtttgagctgaaggagtggagatacatttacaagttactgaacgggaggcaggcaggcatctgtgtgccgcttccacactgggcagctgcagggctctctggtgggcatcctccttctagccttgctgaaagatgatttgctggcatgaaataaagacgtccctaattgtttggggtgtgggaaagcaatcccatgagcattaatttgcccaagcccagagtgtgtgagaaagtgcctgcctgacatgtttttcttttccattaacacttctgtgataaacagcttagatgctcagagaaaaattaatgaaactattgtaacaatcatgcacatgtaggtaatttattaaggacaattaaaaagctttaaaaatcatccgtgaggcaaaatgaacaggaagatggtgtgtggcgggttttggcagggagcctgcccgtgggtgtacggaacaggtttctcttcccatcgccctcacccccatcagagcaacacagcagtggaaagcgtggattcctgctgtccaggctgttagtaacaaacattctatgctggttgcctgttgggtgaagccagggagatgtgtgactgtgtggtctggctgttctgctctaccttccttgggacccaggtatgctggttcctgggcctcccttccaggagcaggagcatgttgggtgacaacttggttattggacttttgttgtttgtgttggctctaggagcctcgaaaccaggtgaggggcagcaagggaagcctagagaggttaaggtggcactgtcatgacgacaccagccacttactagcttggaccttggcctctctgtgtaacgagcctgagcctcagcttcctcatctgcaaaatggggagaatcgttaggaaggagtggaggattggagcgaggatcacacaagatcatgcatgctgagggcctagcgtgatgcctggcaggtatgtagtaaatgttcaaatgtttaatattctttgttatcatgagcggcatcatgattgtgttgttggctgaaagccaagctagggttgacacccacatatcaaactccaaggccagtgcacttttcatgatgtgccagtacccacccactcacccttggatcctccctccaccgccactgttttacaggaatgccaatactgtgtcctgtgtgaatgctaggatgtactcactgagcctccttgaggcttgggtgaggcccctctttggaaggatggagctgcctagcttcctcctggtctcatctctatccccactccttctccaaccctgtcatggttcatagccccaaagtgacagatcttccacactctggaatttttttcacacgtgtggaggactgggattgctagaatttgtttctttttattggttggtgacccaagaaatctttgaccttgtggaccagtggtttctcaaatgcagatatatttaataaagtcagggtctgttagcggatggtattggtccctctctgg

SEQ ID NO: 87198 - DNA, 1067 bp, Homo sapiens
ataaagtaatataagaagtcactttccttagaaaaaaatttaaacctcatagaaaaggcaaaagttgtgcggtggctcatgcctgcccagcactttgggaggccacagcgggctgatcacttgaggccaggagtttgagaccagcctggctaacatggtgaaaccctgtaaaaatataaaaattatccaggcgtggtggtgcatgcctgttatcccaattactcgggaggctgaggcaggaaaattcgcttgaactcgggaggtagaggctacagtgagccaagatcacaccactgcactccagcctgggtgacagagcaagactgcatctcaaaaaaaaaaaaaaaaaaaaaaaaaaaggtgagtaaaggcaaaagtccccttgtacaattccgtcccccctccccccacctgctggccaccacccttgatcttattttcatatgtataacagagctttttctgtgcatttatacactcttctgtatactcagagaaaataatatagtcttgttttctcaggctgtccaccctcctcccaaaactttttgccttttcctccatcctttcctgagacttagctggaggaagaggggaagtttgatggacaagttttttttaacatggggttggatggtccagtgggtggtagtggtgtttccaccttcttctctaggttctccttgggctttgtgaagcttcctcgattgctcataatccaggttaagattgagtagatggatagttggagggtacaggtaagtatccagaggagcaaagtgttgggggttgagtaccagatactgtggctgacttgagcttcccgtgcctttagctggaccctgacacctctctgaactaggaatgtagaatgaactctctgcgagacatctgtgcccattgccggattttgagcatgtgaattgtgtgacgatgtgggtgcgtgcatgtgtgtgggtgcacatttaaggaggatttctcggagaagccaccccctcctttgtcctgaaatgcacaatagagatccttcgctaaataagtcagcagatgttaagtgatggtgttgg

SEQ ID NO: 87199 - DNA, 1110 bp, Homo sapiens
cagactggggaaggattctgcatggtagatagggaacagaactgccaggccagtgctggctgagggcttgtttctggttgagggactttttttttttttttttttttaagatggagtcttgctttgtcacccagatgagtacagtggtgcagtcttggctcactgcaacctccacctcctgggttcaagtgattctgccgcagcctcccgagtaactgggattatgggtgtgcaccaccacacctggctaatttttgtatttttagtggagacggggtttcattaggttggtcaggctgatctcaaactcctgacctcaagcaatctgcccacctcagcctcccaaagtgctaggactacaggcatgagccaccaagcctggcctgaggggcttcttgcttttgcttgtggtcacttccctgcaatgctgctgtcttgattttcagggcatcttgtgacagtgactgaggcttgctctcccttctcttgctgcccaggtgatgagcactacaggccttataacctgatgatttggggttgagccatatccctagaacttcctatgtggtgagaagtcaacagtatcacggaacacttggttttgtgtctcatttcagcctagtagagggacaaagcaagaagtttaatgccaacatcagaagagccacttgagcagacacaagcatttgcctgtgtacagcatataccttgtgccgggcacgcttttctattacttcatttaacctatctatgcctagtgttccattatcggaacgccaagcttgtggggagttatttatatcctactgctcaaggtcatcaccaaggtctgatttttcacaaaaatttgcaacctccggcataaatgggttaattctcaacaccatcctcaggataggtactgtcatcattcccactctacaggtgagggattgggctatagtaacttgtttgagatcaaaaagccaggaattggcagagccaggatccaaactgcctgaccccagagctcatacctttatctttctcatcaaaaaccactggttggatgagtacctctctgggaagaaagggctgcatgaccctgtgtgctattacccacctgttggc

SEQ ID NO: 87200 - DNA, 1859 bp, Homo sapiens
tctctctctttttctttttctctttctttttttttttttttttgagatggattctcgctctgtctccaagctggagtgcagtggcacgatcttggctcactgcaacctccaactccctggtccaggcgattctcctgcctcagcctcctaagtagctgggattacaggcacccgccaccacgcctggcaaattttttgtatttttagtagagatgggtttcactatgttggccagcatggtctcgatctcctgacctggtgatctacccacctcggcctcccaaagtgctgggattgcaggcgtgtgccatggcatgtgttttcaagatctcctttgacccaggtctgtggctttggtcctttgccatggactagagttcttcataggcaagtagtccatgtggcgcttgagctcttcactagattaaagccagtagaggtaacagcgcagcccctctggctagggaagaggggtgccgctagcatcattccatctggggcttcacctcatctttgcataccagccctgcctgctgctgctcctgtcgcaggcgtggaagacctggctggaaccctattcctgccatgaccttgaggctgttcagtaacctctgagagcctgattttcccacccaccttatgaagttcttacagagcgcctagctctcattcaggtgcgtgggagatgctcagtgacttcgagttccctcctcatgcctcttcatgtggctctggggcttgtattagagcttccctttcttttagagtacagccagctgtctattgcagcttgtatatgaaacggtctctctctgtggtaactttgcacaaaagatggttttgtggtcagcctctgaataatgcagtgaagcccctgccccccaactcacacacagggagctgtggtcacagtcggaccacttggcagccatcataagacttgaaatggggggtttgaagccattgcttgtgaattagcatgtttttctctcttttgcctttgtgaaaaccaacttcctgtgcagccgcttgtgttttaaaaccctgaaaaaggggggccagctctcagcccttgtccaccgctggttcctaggaccgttatgaattaaagattacagccgttaaaaagagatcgtctttaaacaagcgcagttctctctcctcatgccccctgagtggagaagtttttgtgtatagcgagtccaaaacaaacagagatgttcttgagagatgtggggagcaggggccgagacagcaggagagcgagggcagcagagggacagtgggggagagccggggaactgtagttttgaattgttggcctcctgtctgcatgctcagagaagcagggccgcgtggagtgcccagcggaacctgctcatgctgatttgctgcgtcaccttgggaaaacgttggctttgctcctccgcagcacgcacacaggcacaggcacacacacgttcccatcccagctggtgcccgcgtgtgggtgttaggcacagactctttggacaaagctctggagatgaattgggaaagaagtgtggtagaaacatcaccaggaagctttgtgttacgggccttgtcactgcatgtgaagatagaccagacgccccgcagagacagccctcttgaaactctcacctaaaggagatgctaccaaggtgagggacctccgggcagcagaacaagaacatcgaacaaccactacggtttaacaggagcaagaaacgatctttccgaactttcctctgtggatgcaaagatgttgaagagcagttcctgcctttggcagggaactcggggtgcacacggggagacagacaagaagggatgagtccagggcacttgtatgtctg

SEQ ID NO: 87201 - DNA, 1086 bp, Homo sapiens
ggccgggcgcagtggctcacgcctataatcccagcactttgggaggccaaggcgggtggatcacgagatcaggagttcaagaccagcctggccaagatggtgaaaccctgtctctactattagtggggcgtggtggcaggcacctgtaatcccagctactcaggaggcggaggcagagaattgcttgaacctgggaggcagaagttgcagtgagctgagatcgcaccactgcactccagcctgggcgacagagcgatcgagactccatctccaaaaaaaaaaaaggaacaccacaactgacttgccctgtgttggagatggctgtgcagatttagtcttgctcaagggctttaccaagggttgtgctcagggcacaactggggctaaattccaaggcctgctgcctttgggtccgtaaatcttcattgcagatgttgatgtagtttccaggactgcatcatcttggagtttattttaggcagatgattgccttctaggtcattctcaaccatttaagtatccttggcaggagaacttatctgaatgggccaaggctctttgagttgggagcaaggcgtattttcccacccaatctccatgcacccgggtcctgtggtttcattggcacttcatttggaaagttgttggcttttgggaggagaaaggaaggagaagtttggcagcatcctgttccaaggcctagagttttaatgtgtggtcagactgtttattgattaattggttttcaagagggaaacatgttctttcaggacatagggtctctaggacaaaaataactttaaaagaagaggtggagatgttagagaacactctaataactcctatcacttcacagctgggaaacctgaacccccaaaggggtaagagattttagaaagtttcaccaaattccccatttctctggacagaattggactctagatggaggactagacattttcccctagagccgtgtttccccagggcattgagaggtgttaggagatgcaagggctccatggccgtacatgtggcaactcctaaattaaacattccctaaatgcaggacttctcagagcatttact

SEQ ID NO: 87202 - DNA, 1191 bp, Homo sapiens
tgccctcttaattgctactgataccatgtcttgaaccaggctttgttcaaggtgggatacaggtgggacacaggcttggttcacaggtgggagggtgccctgtgcaggccgtgggaggataatttgagaattcccttgcctgtccctgctccgcggttgctgggcacctggcgagagcgttgggttgtttgctttgggtaactatggcagatccttttaattgccaccaaataacttcagctcaacctcgtcagtggttgttttgctgcgtcgctcggaagaatgcctccctctttgtaagagctggatggatgggagcttggcagaggcaggccaatgctctttaatgttttccttcccatttaataagtgttgagtaaaacttgagtttagggtgtttatgtggcacaaaaggtaaaccatttgtggtgttttggaacctgggctaagtgtttctcacacacatcctcatgacatggtaatgactacctttgtgttaaacttgggtcactgtcaactttcttctgaagtgctccctgctttgttttgggggcaggggtgggaaaggaatgaggtgagagaaggtgaggtgaacatgggatgccgcacgggggcattgtcctcagtcggactttctagaaaaaggcatcacgcggcctggagacaggaagggagagattttaatcatctgctgtggcttttgctcttctgacatcagaatggtaggaggccctgaacttttgacctctggctccaggtccataaatgtcccgaggttcccaggaaaaggaagacttgttagatgggaaccctgatgtttgattagagcagcttttagtcactactgtcatgtgtttgtttattcaggcaccagttgcatctgagtagtggtaggtcctggagacaggaggcacagcctttactcatggcctcatggtaaggtagagtcatgcagaacatttaacgaaagtatggcttggccgggtgtggtggtgactcacgcctctaatcctagcactttaggaggctgaggcaggaggattgtttgagcccaggaattcaagaccagcctgggcaacatagcaagacttcatctctacaaaaaattaaaaaattagccgggcacggtggctcacacctgtaatctcagcactttggaaggctgaggcgggcagatcacctgaggtcagg

SEQ ID NO: 87203 - DNA, 1063 bp, Homo sapiens
aaggaaaaagaaagagaagaaaagaaaaagatttgatgtacgccaccatgaaagcaggtagaaggcagaggaatcatgaggagctggatgggttcacctggggagagtactaatgggacatgaggcaccccgcctgtgtgtttggagaactacagcagtttgcaatgccagaaggaacaaagggaggcgaggaaccatggcagtagggtggaggtgggcaggggcaggtcccagtggtgctaggaaacttgtactttatccataggcaggggagctgtggcttctatagccttcaaggggaggtcaccattgagccgagaagggagaggagctttctaggcagaaagcgtggttgactgaaatggcagagtgtgttctgaggagggtggcaggctctgggtggtgcatttcttccggccaaaggagagacgtgaggcaggagctgtgtgtcttccatactgtgctcactcaccatgctcaatgctcagaatccctccttgcagaggctgcagccctctttgtaggtgctttggtggaaagttaaatttgattgtcctatgggcctgtggcaggggctgcagtctccccttgtctcagtgccccatttcctctgaagagtgggcattggcaacacccttcatgacacttgagcttgtgcccatggggtctgccggcttctccctgcccttgacccggccgcagagtggactgcacagatcacatgggtgcagtgttgtcacccactcttctctgggctccacacacagacagcatttggcctgctccccgagggccacacggtcatcctaggcagctgttcagtggtaattagtcaacccaagtctcacaggttcaatgactcattgtcttaaatttaataagtacagaaaaacagagtgctgatgtattaaaaaattaatcctcctaagaggtagcctcggcagaggggcttggaatgaagggaagcagagggaatgtgcagggaagtaggaaatttctccttctggggcccgggctgctgtcgggaacagtagggcagagccccaactcttggatttttttt

SEQ ID NO: 87204 - DNA, 1065 bp, Homo sapiens
aagcccccaccccgcctgcgtgctgcccccagcctggggccctgctgttgagcatttttgttttcctcctccagacaagtaccctctcagcccttgactctgcagtaggcttcaaggtccacttctgccccagagcatcagctttctggaaagccatcagcatctggaggagaggagaggagaggggaggggaggggaagagaggggaaatgtcttcagctacaaaatgcctggctcctttctcactcagaggcttcctgcctgaggagcttgtcctctagattttgaggagcagaggggctgaggacggcagagctgagatgcagcttctctcttgctgtgggtgggcgtgcccttgctgacacagggggcgagggtgagaggctcagcagggtgttggagttgctgccggttcctgcctgtgagtgggccttgctttaagcaaggttgagagccgaaataatggatgcctatgaaagacaaattaggaggggattatcatctcacaaaagaaggcttctaaagtcaactcacgaacactcagagtgagagctggttcatggactgcctggcaggcacacctatgctcagtccagggaccggcctccttgtggcagggggcagggcgagctcaggggctgtggccctgcctgctttccctaagggctcttctggggaggagccctgcagatcagatccccttagtgaaggagtagtgactggggggtcccagaagacaaaaaacctagccatagtaggcagggggaggggcaatgccttctgacccctaattgaaggtgatgggaagggagggggccagtgtcctagagactggggacttcctttggggccaaccccatctgggctcgaatcctagctctgctgccaactggcctcatgaccttgagcaagccccttaatgtttctgagctttattttgctcatctgtaatatggggatgatactagtggtaataataatagctgttgttattgcgttgctgtgcgctgtgtgaaacactcagcgtggatcctggtacgtcgtaaacactatgtggtggtggct

SEQ ID NO: 87205 - DNA, 1214 bp, Homo sapiens
ttaaaacagctcttagaagatgatagtgttttcatttgacaggtgagaacattgagattcacagaggctccgtcatttgttgaggatcacatgggaatgtcatgggttttccagagccaagtaaggaaatacctggttctcctcccagtccccatgccccaacccatctagacctgtctgttctcactctcttccccatttaaagcttgtaaaacaagattcttctttttccaaggcctcacccccgtctggccagctgtctcatgcttagcaagtctttgagacagggactttctcatagtggggacagaaaaattctaccaaattgagcctggccttaactgtggaaaggcagggtagggtcaaaagatgaattctagaccattcacttctgttggtccataaggcctggtgtgtgtgtgtgtgtgtgtgtgtgtgtgtgtgtgtgtgtgtgtgtgtgtgtgtgtcggagggtgaggaagcaggagctgtttatctgtactctggagaggtaaacacagcaggtgggccccaccgaaggaatctcttgacaagctgggctttctcgtgacacaattgcctgttaatggattcagcatctggcagtttcaccaaaagccgactgccaatgagcctggctgctcgaaacccttgacactgctgatcacaaatgggtttccttttgacgccctgcgctgctcctgaaatggtcttgatcaaacaacagagtagtagttaaccgaaacccatgtcctagaattctcctccttccccacctcccgcaagcaaagtgatgtcgatgtctgcaggggaaaatgagaatgggccctcaccccctagccctgcaaagactgtacacatttgtacaaagcctactgagtgctctgaaagtagcttttgcttatgcattgatgcaaaatgcacccaaggggactagactaagccagggagggccccaagagaaggcagtgtgctaggtgctgggggtggagaggttggcaaaaggaacagcttctgaagctttgagggctctgagagaaagctttctcttcttagatgttggggacttgacatccctgtccctcctgggtgatttcctggcagaaaggtcaggaacaagtggcagtcatgagtggaaggcatttgaagcaagagactatcgcagccttggtttaatccatgtaaccagccccttctgcacctccaggagtgga

SEQ ID NO: 87206 - DNA, 1098 bp, Homo sapiens
gactgtgtgtgccccagggggataacagataaggaacaggactagagggaaggggtgggagtgctttggcagagtggcaccttccagccaatagagccctacaaaatgatggagacccttgggctgctgggggattgggaggactgacagcaatcaggatgaaggacactctgagaccagccccacagtttcaagccattttttgggaatggggctttgagtgttggggttgagggagaggcagccccttttgccttgcgtactggggcatgcaggatttggagatgggaaaggttagtttgacctggagcataggttccttcttatgtcatcatattcctggacaataaacctggcctttgggtcttaactgtcttctctggactcagtgttcctgattgcttctttctcagaatgggttgttttcccaaccctgctgtgggtaaaacatcccagatactccatttttatatttaaggtttaatcgtaaatgataattatatttaattatgggaaattcaacatttctttcaatgaagagcaggaaggacacatcaaaagaatcaggattagaaattctggttctcaagtaaagcaaagcagcggtgaaagactcagacacatctgcactaattggagccactgaactttgtatttttgtttgttcttcatggtgggctgtcacctggacagcaaggttctcatggccacatctgagctgccatccctgagacctactgtgggctagacaggcaccttcccacatgatccatttgatcctcattgataggtatgagaagtgggaatttaatttttacacattgggagactgcagcttgtggagattgagtaatatatccaacgttctgccagcattcaaacccaggtcagaacaactgaaatgtgttatctttctacttcacattaccaactcatgaaggtccatttattttttttgagtcggagtcttgctctgtcacccaagctggagtgcagtggcgcagtctcagctcactctgcctccccaggttcaaacgattcttctgcctcagcctcctgagtagctaggattgcaggtgcccaccaccatgctcgttt

SEQ ID NO: 87207 - DNA, 2838 bp, Homo sapiens
cctgcctcagcctcccaaagtgctggggttacacatgtgagccaccacgcccagccacgaaggctcttttgtcaggagaaaaagctgtttcaaatatcagcctagcaaagttaaaatatgaagaattaatgttggcatgttagatatcaatgtaaccattaaaaacaaacccaaaataaaaccccccaaaagctataactttcttaatatttcttaggccaataaacaggactcatgttgacattaactgaagttcaggctccaaccagcagcaggagagttttgaagctgcagaagagatttcttgtcaccttcatcagagtatctgccttaccctaagcccttcagtaatatattcagaatttcaagattggatcatgtgagcaggacttaacaggcctacctctgcctgagcttggctgggtttcagacctcagccgcagagacgaggcactataaatagacgagggaaagagatttagctcaaaaatcctgtgttctcagaattgccaccttctaccttttgggccaagctgtcctagcgttgaagccatgatgtttgcctaggtaacttggcatgagttagttttcatgccagcccacaccccagtcacagaaccatggttccttgatattaggtgagcattgacaagaaggtgactttagccttggccctaaatatgaggaatacagtcagagaacttcttccttagtggcatgcagtgaaaggagtgggtttgtattgccagtgaccattaggatgtgaagactggagatggcattgataagggagactcataggatttcagtgactcatagtacaggatggtatacacaaggcactggagaaagacccatttcctctgggttcatggtaattacaaatgcctttagtaatctccccaggctgttaaccattgtgggtgcaaggaaatctgggttttcagtgacaaggtattaaagcctgcatttccctgttgttagtagttgctgcttcttagcttgatttccttgaagagactgaagagtagcagccggcaagtaatgtctttcaaaaggatatatccattctgctgaaaagcatggaaccaaaataatctgtaacctattccacccaaataaataagtcagcaaataagtctgctttcattgtattgtcttctccataaatatcctttaaattgaggctgagtgacaagatatgcttctgccactaaaatggtatcactgatgatattgaaagagcctttaaaataccacaattgtcactgaaactatactttgctttttttcccccttctcctttgctagtaactaggtctctttgggaatttttaaagtgacaattggtagattgtagtcgatgatatttcttccacataatacttctgaatgccactcaactctgccttgattggctccaaatatcccaaagaagaaaaatgtttcatttgaaaatgtaaagcttattggaggtcatttgctccctaacttttacccctttgcagaaggggcaaggaaaaggcaacagtggtaagactcggcctcaaaggaacataactgctgtcaaaatcaatccatagctatcggcttgagtacagggtggtatatgcttattagattctcaaatgttattcagcttgattgcagcttttatacaaaggagttaagacacgggtaggaaagataatagaactataaattgcaagacagcttcttatgaaatcagtaaattattcatttaacagttcactctttgttgatttcatgttgctatggcacctcaagatggaggcgagtcagtccaccggcccaaccaggggccttacacagatgcacaaatcctggtggaaggcagataatgcattacgtacaaccttcggccacatgataaattgcctgtttatctggcaaattccaaggagatctgctggagagaactgaaagagatatctcacagtggctaacatttcttggaagagacccagccatctcagggtttgagtcagaatctgtttaagaaggcattaagaatgcattgtcttggagtgtcttgcctgtctcccgagattgttggaaacaccatcggctcacagttgctttggcgttcacgctacagtaaatgcctgacttcatttattattttgatgggcaaagaaaactgcctgccgacagccatgctccttcctaagctcttcccagacttacttttgtagtccttctctacccgtgtacaatttgatttcttgctgcttgttaaattattgtacttacgaaatatattgccatggccaagtctgtcattcgtgtacatggcgtggaagggagtttgggtgccagaggagttaggaagcttgatgctgttgttggccgtgactttggtgacagtgtgaccttggacaagttcctttatctctagggtctcagcatcttcatctgaagcatgagaagtttggggtggtcccttccttctttaacctcccgagactctgtgcctctcacatgtatagattccctgtttgtagacagcagtgctgttatggggacctctgaaggctatctgaatgtgcctgcatttagcaagtcaaggccagaccctccagatgcactggactgtggggacattttgtgtgagtgagactattaagaatttagcagttcattctgacagcttgatagatggagtggttttgcatggcatccatgtaggaattgactaaaaaggaaacattttctgagagtccggctgtgtgtgcatgctgggaggtttttctcaaatcagattttaaaactttgctctgaaagaccaacaacaataacctaatccaatatccttgt

SEQ ID NO: 87208 - DNA, 1040 bp, Homo sapiens
tgctgacatgagagtgacaaaaacaaccatgggtggtctgagagaggacggaagccaaggccatgagtagcccagcagggctggagaagctggaactacctagggaaaggacacagggcatgctccacagagggtccaagcactcagcaatgaagacaactgctttctgagaagcctcagctttcttcagaggccacagggaagaagaggaatgacatgaacacagttgtttttaaggcacacttctctaatcacagtttactggataaactgggtagagaagtgtacaaagaaggctgtggtaactactaagccagtctaatgaaaaacagatttagaatctgaaataatcagaagaaaggaagctgttgaggctgacagtactgagttccgagggggaagaaatatttgaggaatctacagaacattccaggtgaaacgtccaggaaatcactggccttccaagcttggcatttcccccgaaggagccaagggtggaggtacagacatggacccactcacctaaaggtgatgctaggggtagaggtggagggagaagatgcagggaatgaagtcctacgggcatctgcctgaggagcagggaaagagaagcgactgctaacggaggccaagaacagtcacagggaggaaggtgagccagagagaatggcctctcagccaacagcctgaggtggggttaaacaagggctctgcagccaaactacctgggttcaaattccatccctgccacccagtatgagagaccttgggaaagtgcctccgtttctccatttgtaaaaccagctctcggttccaaacccacccttttatacttattctccactagacctgggaccctacaaaccacttacatttttgatttgcccctagctccctggtaggctctgccaacagcgtgtgctagagggagaccctaaggctggaggaggaagagggtcttgctccctcccatctgctgcctgggggcttcctattggcttgtggttcctgtgagcatcaccccagcaatgcttcttcat

SEQ ID NO: 87209 - DNA, 1068 bp, Homo sapiens
tttatccagtaaactgtgattagagaagtgtgccttaaaaacaactgtgttcatgtcattcctcttcttccctgtggcctctgaagaaagctgaggcttctcagaaagcagttgtcttcattgctgagtgcttggaccctctgtggagcatgccctgtgtcctttccctaggtagttccagcttctccagccctgctgggctactcatggccttggcttccgtcctctctcagaccacccatggttgtttttgtcactctcatgtcagcaatgccaccatttccaccccatcagaactcttacctgtgctcgaagacccaattccactgccacctgctccatgaggccttccctgcttctctctcggggaaacatggtctcacctttctgtaaactcccctgggttttatctgtgtcactcctgcacaggcaaggccctctgcccactggaggctgagtctttgtctgagcagattcatatcttttctgtttctgaatttcccagggtgcctcgtgtagagcccttagtgccggctcactgcagagctgagtgtttccagttcaaatgggtgttcccagagtgggttttgtttcccatttaagaacagccttcctgtcatccagcctcaaacaggttggcctggactattctagtcttaggaaaggtggcccaggtgtgaagccacaggccacactgttgcttttagcacaagtttcacagcgaggaacagggactctgccctcagttttctctgttgggttactttcatgtctactcaattgagagttttaaatccttttatttctaaagatcgcctggttaacgtatgaagctttcttgggtccatgttggcctgttgtttaatgtttctcatttgcctgcgtatctggaaaaaaacagactcatttgcacagatagaaacaaaagattgtgcagatgggagccacgcatggaagggaaggaatactgatctccctaatgcatcttccttgcgaaacatggagctgctcaggaaagaaagggcccgtgattcaacagttggggaaatgtgggttcaacgggctccc

SEQ ID NO: 87210 - DNA, 1210 bp, Homo sapiens
tgagctgagtctcctttctatagggaagggcaaaacaaaacaaaaacctaacccagcaaaaacaaggctttcttactgccaaactggggctccgaaaatagtttgggtcattggaatcatgaaagaaatagtgtttatataacctctctcttgcagagaacttgaaagtgatttcctttcgttttatgcaaataatatatgggatttatattacccactttgtcaaactcatcttccttgtatgtgtttggaaagcttattcactggtggtcaggcttcttgtttttcttctgggtagactgccttttagacaataaattctgaagtctttgttaattccgagctgggaggatacaaatggcggtccatcctgagtgtgggaaggagaatcagtttgaaagagctcttttatctgcactccttagactttttagtgttgtttcggttattttagtgtattgccagactcacggagaacttcgtttgtccaaagctccacgaaggctgcaaagataaaccaagctgtccatgtccttactggcagggatcacagagtctagtgggtgagagagtgacagataccataatacaaggcaagtaagtactgggtgcatgcaaagtgctttgggattgtaaaagagaaagagaaaaaacccagccaagtagggaggggaaaagctgccatctgagcttcacttgcaggctaggttacatttcagcaggcagaggcaggcaatatggccctgagcaagggaagtacagaagtgggaagtgcaggggacttcagatcacggggtgagggaggaggctcactgagagagaagaccagtactgtgctctgtggggccagctcatgagaccgcaaagatagtagcagctttgatgccaggctgggaattctgcctgcgctgttgggagccagtcacgtgttccacacaggtgagtggcctgttcagattctgtccctgtgtgctccatcctagtggtacctgggagttgtcatctccgtgcctctcttttttctgtccccacatctccagttatcagtctttctattgcacccaaaaaaactgcttgcctctctccctagttgtatgtggtccctgtgtcctcatcactcatccatcaagtgacaaaactcttctcttaaccttcagccttggcctcctctggtctaccctttccatgctgccagagggatggttttaag

SEQ ID NO: 87211 - DNA, 1057 bp, Homo sapiens
gggacagaagttgtattgggttcacttgtgtgtcctggctcctaaagcaaagggattatccttgccaaaggagaaatatttggaataaaataccatggctcatgtttcaagatatcacaggccgagaagcgaccatgatcttggtgagatgccctgatgtttttttctgtggggcacatcataaaagaactttggttaaacattttggcctgctcctcatttcccagctccaatcttccagattttctgagtagctgacatgccttctaggggaaattttgcattcttcacttcctctacctctctttcttcccctctgtttttttcttttctagccaggggcagcagcttagtacttggaacctgccacttagaatggctcagactccttggagccaaggggcacgctggcggtttctgccaagcacctggccagggttccggggtggggaggacggatgggaggtgtcacactgcccctcgtgggccattgcctcacagcttgcaggtgtcctggcgctgggataaaagggcttatccttgagacctcaggagcgtttctgccaagcgctcgcattggtcagtttattcggattctcctgtagaggggagttacctgcttcttcctatttctgttttctgttacaagacctggctagaggcctctctgagagcgcagtcaggcacaaagcccggcagaggcattggagaagacaggtcatggagtgaatgagcgaaggaactctgagattctagggtgttaactcttagaatacccagatcctacatagctgcaattcagcagaacattgaccctggcagccagagtacttttcagactagctgaggtgctggaaagcagcccaggaggacacttggggcagaggcagccagcctggggttcaacatttgtggctgataatagagacctcggataaatggaatatagacatgttacatctcctgatgcagagctcctgcagccagagggtcttggcctttgggggacctctttgggagggcctggggtcagatgggggtggacttgggcctgagt

SEQ ID NO: 87212 - DNA, 1281 bp, Homo sapiens
tggaatatctttgttcttcctccattttccatcagttttccactctggggagatgagaattcgttaaaacagagtgagccagcgtaggatggggtagggaaatgaagcccactgtaaactctgtgggtgctgagaaacctcaggctcctaggtaaaaggaggaaatccaaggtggctgtccagacactgcccaactgtgccaccagaattctgagctccggccagcaggctctaaaggacaggtgggcaccttggagacgtgaggagcaatcatctttgcttcatattctacctgtggttgcctttcagcagttttgggaatgggagctttggggcattttatgtcctttgcattgtccgaagaaaggtaaaaggagcgattgctgttacactggggatttctgatctgtctctgataaaatctggttgcatagttgatcttcagcaaaagaggaagcgatgaatgaaattgctgtcctcacttgccacctccccttccttttattctttggtttttaagtgtggtgaaaatatcaataaagaggctggccattttggtcccagtcaatgaacacttgccatggggtagtccttgcccagtggagatccagcccatatgggcaccgttgcattgcctgtgggtcataatgttttaaggatattctgttcagttgccctctgggtccctccaactagatgaaggcattctagattgcaggggaggcgggaaacagtcttgagctgcgggatgatcttgtctcctagtcacgagaaggagtattggagatcccatcatctcatctgcctgtggtcattattactaaaaccttcttcagctgcccaaaccacagtaggaggtagccttgctcttcctccccttggagccattttcatgtgggcatgaaagtgattgacaggctgtgaagtacctctcccaccatcacccaacactgtgaggtaggcggagcagggaaagttttaattaccattatacagatgaaaaaactggccctctgcagaagttaagtggtttgcatgagcctgggagctggcactgcaagacaagtctacctgctacggacagagtgctcttgtaccctcggggttctgcctctggtcactctctacatagcagaagctccactggcacttttgtattcacaactaccgggtgcgataaggcagtgagggttattatgataccccttttcacaggtaaggaaacaaggctcagagaggttcaacaacagagtcataattcttcttgttggagaattcatt

SEQ ID NO: 87213 - DNA, 1057 bp, Homo sapiens
ctacaagatgtctgaactgacgctctctcttcagaaagaaagggaggcccagcaagtgggaatgacttggccaaggttacccactgagttaatgtccaaaccgggtcaagaacctggggatcctcacagctgcctttgaaagcttcatatgggccgggcacggtggctcacgcccataatcccagcactttgggaggccgaggcaggcggatcacctgaagtcaggagttccagaccagcctgaccaacatagtgaaaccccgtctctactaaaaatacaaaaatcagccgggcatggtggtgcacgcctgtaatcccagctactcaggaggctgaggcaggagaatcacttgaacccaggaggcggaggttgcagtgagccaagattgcgccaccacactccagcctgggtgacagagcgagactctgtctcaaaaaaaaaaaaaaaaaaaagaaagctttacttggcttctctatatcccctgaacatctctgacctggctctcttgatatcagtctccatgtccaattctccatgtctgccttccagcctcttccacagccttcaacctttgtggcattgattcctggtggtcccatcctagcccccaaaccttctctgtcctcaaaagtcccatctctcttctctcttcagataaacgtacatctcttcaccccagcatcccagcgccctgagtgaggaattaatgcttttatatttgaagagatcggctgctgtcatttttgatatcttctgtttttgtatgtgggaacgcagagcacaattagaatacagttatatatcctcatagttattgaagcttggattaacatgacataaagttttgtctagggagtcttttgctatggctcagggagcattttttgtgacagtaataggctacagttaatatacttgaatgatactagaatctgtgttataaggcagaacaaaaggggtttatctgaagctgaattacaaaggtggaattatcactgcgaatgatccacagagatctggggcttaattattgtcgcttgtgtcatttcggcataa

SEQ ID NO: 87214 - DNA, 1162 bp, Homo sapiens
tgactctgagatatatatatatatatatatatatatatatatatagtcatcattctgtcatgcaggaaggtctgggctctagatttaagccttctagcatctaatgctgggtcactactgtgatcagaggtcctgatgaggctgtttgcgtgtttgtgcacagaggcgcatgtgttgggaaccgaccacctacccttccccagcaccattacatacccaggctctgctctgaccttacagcccaccctccatggcccccaagtggtcttgggagcagatgcacagctggtggattgggcctgggccctggcttgctcaccaagccctgagcttctgtttatgactaattgctttgtttgttctgtatgagacacttaattttttttttcagtgatttactcctctttgtaattaggtgtggtgattagaatcttgttcctattacaatggagttttccttttaattcatgcacattcaccaggcctatctccgtctgttccattgattgtccccagttggcttttcccaagctgtcatataaatcacagttcaggggtggcttagagactgatacgagtccaaggaatgaaagagagctgatggggagttttgttatattcagctacccaatagtgatacatatttaaggatgaagtctcaataaatcagggcacaaggagttggcaaattactttaataagtgttctttactatatcttctgcatgtgatttatttttttattaaaaatgtcattacacacacatatacgttttgctaggaaaaggtctgaaaataaacactgaagtgttaacagtgggtgatttgtattttcttctctttgctcataggcagtttctgccatgtatatatgacacatgtattaaaaaataagaggttttgcaggccctcctttataacagattagaaacagcacatttgtcaactagcccaaggtcacttcacacatcagcaaaagactccaggtctttaaagttccagagcaattgctcagtccccagagctgacgttcatccgtcagtcagtcagcaagtagtcattgagtcctgggtctggggtgaggggcagagaaggcataagatgtggttcctgttcacaggtgcttatggtttagggagagagttgtttttgtttgtttgttt

SEQ ID NO: 87215 - DNA, 1040 bp, Homo sapiens
cataagcccctctttggaaggcctcttccaaagcctatagtttgcccccagaaagtgatgttttggttcagatgccatcagatgtgtgggattggcaagacatgggaaacagagtgcagctcacagatacgcgcgtgagcccggcaggcctggccaaggggagataggaactgggagatgtagggcacctgctgatggcagacagtgggctgtgctgggaggcttgcacctggctggataaagtgctgaaggagcgtgttcttgcacgtgttcatgcacccatggtcagaggccacaaggctgttccgggacccattcattagaatagagtcctcaagtcctaaagtacagtgtcatcttcgatgaaaaatggtttctgtggtccaagtgagaggacccctgagtcagatcagcatcgagtcattgcagaaatccacagggatcctcgggcagccctgcctccatcttcccagtctgagagatggggcaaagtgctgcttctcaagggttttgaggattaatgagctgacatttgaaaactgcttgggagacgaattggaagtgctaagtattactatttcatgtggaagtctgaaaataactgcaccgaagtgttctgataaataactaaattgagctagtgagggggaaatttcagccgtctagagagtgtttctcttaaatattttttctctcaagtggaaaggagtgagggggagagtgaggaagaatttatccagggagaatttgtgtgcgttatgccgcccacaaatggaagaatattgagtcggcctcaccagtctggcgtcatcttggttgcttgctttttgttttgttttgtttttgagacagagtttcactcttgtcgcccaggctggagtgcaatggtgtgatcttggctcactgcaacctccgcctcccgggttcaagtgactctcctgcctcagcctcctgagtagctgggattacacacatctgccaccatgcccggctaatttttgtatttttagtagagatggtgtttcaccatgttggccagg

SEQ ID NO: 87216 - DNA, 1771 bp, Homo sapiens
agctttaaaaaatcctctttcgggctgcccactccagagtactgatttaataggttggggtgtggccttggtgagcagtcacggctgaaaaatcactgatgtagatttcagaatgaaccaatgggattttccagtctgctccttcttctccgtccttcctctttggagaatggttaaagacagaccaaccccacccttttcaaggccagagcacacggaaaagtcttatttcaataaactacacattattcctgagctttacggaaggaaccgatttgggttttgcctaagctggcagggagagaggtggagacagtgccttcccatgttctgcgtaatcctggacccaggcagcggctgtctccaccacaggccccaggcacctgtggcctgggcagtcctgccacctcagccgagtctcactcttgtggccttagctccttgagtttacagagcataatgcctgttaagcctgacacactatagtatcatggtattgcatttgagggtgtttatttatactaacacttggagcgtttgagtgggagcaggaagagaaattcaagggcatttgttctgggggagtttggagagctgggtttcttctcttccctttcccctccctccttgcatttgaccagataatttaaggatcatctgaagtgccgtttcctgctttgttcttgatatgtgtggcttgcgggtgtgtatatttatatccccagaggagtaggacatttctcagggcatgcatcggccacagcaaagctctggagcagcctcacagcacagagagtttgcaaaagcccagtggccaagtcaatgcttccagagcatcgtcccagctgcctctggagtccatgttagcattccaggcagagagtctttatgcatggatcttaggggccatctcatagaatttcctcctttcacagaagaaaaactgaggatagaggagggaggtgactggtcctcagtgagatcctggtggggctgggattagaacctggactccctccatgcttggtgcggcactccccaccacacccagctgcctcccaacacctgctgagttacgtaccagcaacactgctctttagctgtctcctgggaacaagttttttgtgtcctcagatcagttcagcttcactcacctactatgtatttggggagccaaaactgtaaaaccttcagcagaagaggcagtggtccaggggacatactgtaggttcccacccattagccagctaactggacaatagcatttttgacctccctccatgtacctttgcattgtgtcctttttttttttttttgaggtggagtctcactctgtcatccaggctggagtgcaatggcgtaatctcagctcactgcaacctccacctcccaggttcaagcaattctcctgcctcagcctcccgcgcagctgggattacaagcacacaccacaacgcccacctaattttttgtatttttagtagagacgggatttcactatgttggccaggctggtctcgaactcctgacctcagtgacctgcccacctctgcctcccaaagtgttgggattacaggcgtgagccaccacgcccggcctgcattgcgtctttaaagttttcctattcagccagcacgtgagctgggctgtctcaagtctaacccctggatgtggtcagtaccatctggctacttctaaaatcacccagcaagaatgcctggctcacaataaatcttttgactcattagaaagagggttcactcattcacta

SEQ ID NO: 87217 - DNA, 1027 bp, Homo sapiens
cacaccccaggcattcgaattcctattgagtcccagggtctgagtctgagatatgctcatatcaccatatgctcgagtgtgactgctctgtgtacaaacacaccagttgatcttatggtgattttgcctgtgtggtgcacgggaggtggaacggctgttgtgtgtgtggccccagcaggttaccgtcggcgggggctcttgaagcctgcccaaaaggagtttgtcctgcctgggatgggcatggggatctccaaactagcattgcccactcccatcatcctggtgcctgggagagagggggcagctgcctgctggaggagccaccatgccaggccattttcctcccagtaactgacttcagaaatggggagcagaaggggaaggccccaggagcctgtttgttcaggcttggttgcttagcaacaaaagggggccctgacttgagaagagatttttaagccaggccagtccctttgaggtttatgaccggcttgcctacccccatcttccattcttaccttgactttgctcttccccctattacatttgatcgcatctagaaaaatacgtttgatttgtctgcaggcaccattttaaaccttggtttattgctttgcccagcgtcttcccctccattggagattgtagtctgggaggagtgaggcatgaatagcccacgattccttttctcaaagggattagcgccagcccccaagctcatttgtgagcctttgagtgcacatcaacggtgctcagtccttcttagccacaggcacacagtgaaattgctctgaggacagggccccccgctaacagttttaccccccctacagccacacggactgggttgtatttttaccatcaaccttgagcacaaagtaaatgaagagagtaggctgcacactggtcagaccaggtgccctcccccggtgcgtagctgaagggtgaggacaaacacctgtgctaaagatgtgtgctctgtgggataaaggagtgggtcataaatactcataaaaggagtgcattc

SEQ ID NO: 87218 - DNA, 2112 bp, Homo sapiens
ctataatctcagcgctttgaaaggctgctgcaggaggatcacttgagcccaggagttcaagaccagtctgagcaacatagtgggaccctgtctctaaaaaaataaaataaaataactgggcatgatggtacatgcctgtagtcccagctactcaggaagctgaggcaggaggattgcttgagctcaggaggtcgagactgcagtgagccgtgatggtgccactgcactctagcctgggtgacagagtgagaccctgtctcaaaaaataaaaagcagacactaaagggaactatataaaatgttaactgtatacaacggtgtggagtggaaagaccactgtttttttttctttctacttttttgcattttcaaatattttttgataagcaactattacttctgtaatggaaactaccccctcaccccccgacatgcatataatgttttgtgtactttcttaaaattcctaaggcagcctgtattctatatttgttttgcaggtggaagatgcaatgctgatgtttgataaaactaccaacaggcacagaggtaagattaccccagtgtaagagggttgcgttcaccctctcctggcctctctgtctgtcatccccagtcccactgacaaaagatacagtgaagagtccagagtcaagcaggtagaggtgaccatccattgaagatctttattcacggagagtcccagtagcacaaagagttccagtactggatagctgaaaaaccatttccttctggcctaggaactcctgtttagttatgcagccatccctgacacacatattcagatgtacctctctaatcctgcctttctgggtcccttgctaacctcggcactaagcgatccaagtggaaattattcacagcagtgactcaattgagttatcaatttgtattgaaggaggttctttaggagcagactgtcaatctaaagagccaaaaaatcaaaataaaacattgtaggttcgttgggtgtgtagtgattacagccttgggaatgctccgtggggcctctggaatgtgtagagggcatctgtacttaattgtgtttttccctgtgctgcttctgtcccatccactttacaaaaaatgggtcttaacctggagtctatgaacctctgcaatgacatgcaaaatgtcatatgtttatacttttcttgggtgaagatccctaggtttggacaaattctcaaaagggtctctggccctgcccttagtctcttccttccccaaaaagaacacattaaatttattgctttaaacagaaaaattggaggcatctagaaaagtcctccctggaggtagcagagtcaaaggaggtgatgacttagtgttctgttctccggaagctcaggtttctggggttcctattaacagggtgttaatgagcagagcttcctaagggggtggcaggaaatggtgtgctggtgccctcaagggagggagcctgtgagtgagcagcatttccttgccacttggatcgcatttagatgtttcctgtgttgtttacattcctgctgtcacctgtgattagaaacagttacccagcactgactgtatgtctttcctgtttggagaaggcagagtgagtgaaaggcaagaaggagtggagtgggaatcattgctggcggggctgggagaaggagggggatatcctgagtgcgtctggtaatctggcttcaaatgcatccctctacagcatcctcagaatgggagaatggagcattgggtgcacaacagtggtgtcaagtggtatttatggagggaagagatggcagggggtggagggtggggagcagtggagaagcagggagagaaaggaggggcatgcaggtgtggaatgatcgattttgtccactgcattgctggggagtgagagcccagtgagtgagatgaaggtggtgcccgtggtgggcaattgaggattatcctccatcatcatccacattctgtcaatctagctttatggtttccaagccggacttccagatgcatctcctaatgtgaccttcacagcagcccctggagggttgttgtgacattgggaaaaatcacttaacttctttatgcctcagtttattcatctgtaggatg

SEQ ID NO: 87219 - DNA, 1081 bp, Homo sapiens
cccatacacacgttccaacccctcaagataccggaggaggcatttctctttgaactgggtgctaaagttggtgtaatacttcactgcatttagaacattgaagagagtgaaaaaaaatttttgtttttcaaaaagaagaacatatcacagcagaggcacagatcatatatatggagcgagccggccccacatctgtggcctgatggagtgcacatttggagtcaggtgataagcacaaggaagtaaaatcctcatgcagccaccttgccccaaacttaccttcacctcctcggttcctgctgtccatgatcttatcaagaggaaagtgctgcagtggcagaagttgaggacatctccctggctggcgccgcctccagctctcttcttaaagaggcccagaccatcgacccagaggtgttgtcacagcacatgctcagcacttgtcctcagactcctagcccagccctgtggggcagcctggggcctcaactcatccttaccccaggaattttgacagctacctgtgtgtccttggagctgtgtgacatgagctgtgtgacatttgctgctcggggataaccacagggaactgggcttaacatctgatgagcgtcaggtgggccaggctcccagggcccattcagtctccacttgctgttaggagccacaggtcagggcagaatttccactccttgaccccactggtcacctcctgtccctgctccctgttggtctctgttggggcagggatgccctcagttccatctgcatggcggcagcttgtatctcccatccacaggagcaccagcctggggctcactagtgccatgggagagaacccaggacctaggagagaatgagcctcccgcaatgtatgtcttccaccctgcaagcaggaagagggtcccacgttcagtctttgactcacagtgggtggagccctggagatgtgggggctctcacctttctccttgcagatgggccttcctccagcttctgctgctcccatgacatttttcctgggggcacattccctgacctctgagcatctcaggttcttcctctaaaaaataagagacct

SEQ ID NO: 87220 - DNA, 1066 bp, Homo sapiens
catcgatccaagaccttaattttatttctgacaggaaagcaaggagtgtgctttcatttttttcccccgagttaactcaattccggaagcgcccattccggcgctgtctcttgagatattaatcaacacagtagcttggtttctgttcacctgctcttctttggagacacggagtaatacaaagccctcaacttcctagcaacagggctgggggacagggtgcccggggcaagagggagcttgcaaagccagggggagtttggtacccaggatgagctgcacttttttagccaaaatacaaatcttaaacttctttcctttggaataaaagccctggcaccaaaagggtggtgacctaataggtcttcctgcctccccctgctgtggcccacggaagcagaaagggagtgggctcagggtcagcaacttcactgacccagaagtggtttttttgtagagagggacaatgaatcttttgtttggtcctgttcccatagaggcccaggctctgactctcacaacatggtttaagatctcggtgagggcagagtgtggagatctgaagagaaaggagcttttagcatggcagcttgattaaaagcaccccctttcttagcatcacggcactgccagtggccggagagggctgggccaggggtcgccgcaagccctgggtggctgcctccccgttgggacttaaggttcctagaggggtcccggttattatgcacctctggacttcagcctctgttttcagtttgtggatcagagggtgtacgctatcccatctgtatctgtatatcagcatggtatgctgcaaagagcttgagttttagagttggtcatactcggtttcagatcccagctttcccttgggcgtgatctcaggcaagttacaagatgttttactcccttgtgaaggtaacacacccgctctgtaagagttaaatgattccgcttgcgaggtgcccactccccactccccgcaagtggagagtgcggggcagcctggtttcttcccccttcctccttaagtgaaaccacctgcttaacttctttaggcaaa

SEQ ID NO: 87221 - DNA, 1212 bp, Homo sapiens
tgtggcaaagggataagagcttaggtccagattcccactgcaggactcactttccagagcaaccactaatcaattgctgtgtgaccctggacaagttactaaatctctctgaacctcagttttctcatctattaaatggtgttaatgttattaactcatggacttgggaagtttaagtgagatagtttatctgtgtgaaacatctgatgcttggaaggctatctgtaaatgttaactttgtcattatcatattaattattgttattttactactaagaatactgtgactgtcattacttcgggaatggaggctcaggcttgctgattggagagaatgttaacaccctagatggctgctggcagatgctgtcaagttttccaccttgaagggtgttgtgggctgaattttgtcctccaaaagcataagttgaagtcctgacccctaaaagatacccccaaaagaagtcctaaccccaaaaagataagttgaaatacctcagaatgtgaccttatttagaaagagggtctttggaggtgtaatcgggttaagaggaggtcttagtggagtgaactgatctcaccatagtccttataagaaggaacatgtgaagagagagacacagggagatggccacatgacctcagaggcagggacaggggcagtgcggctgcaagccaaggattgctgaccacaccagaagctaagagaagagcctgaaacagattttcccctgagccttcaagagggcatggccttgccaacacctggatttcagatttctagctttcaaaactgagacagaataagtttctgttgttttaagctcccccctcccatttgtggtagcttgttatggcagccctaggaaaataatagggcaaagcagagtttcctgcccagtatgtccccttgctcactactggcctgcagtcctggtggtcagacttatccttctcgctctgtgccttgctagtcacaacccccctaagcaaaatgatgtgcaagagaagttagagaaaagacctttcatgcaactgagaacacagcccccgaagcctgacttggttcacaccttgcccaagtctaatttgccaaagaccttgaaagtgaccttaggatgttaaagatacattttggtagagagagagagagagagagagagagacacttcaagaagtctgaagtttacattttaatttagtggcctgcag

SEQ ID NO: 87222 - DNA, 1255 bp, Homo sapiens
gcagctggggtgggaagaggagagcagctggggttgtgttattagtcattccatgaagagattgatttgataaataataaagcagcgatattagcaacacatgcttgcaggtcagatgacttcgatgaaaacccccagttaagtgtgtgtaatggtttgacaatatatatgccttctaaaaacatcctattttaaaatggaaattggactgttcttgcaattcttagcaaatatgccaagaccattaccaaagggagcttggaaatctgaagggtgatgtttctatttaatttggcctctaccctccccctttcaaaggatgcttaaactcactttgttttcctgtccttgccttttcattttgttaactgttttgatttgtaaaatactatgcctcatactacactcctttatgatgatttactgtgctgttcttatctttcaccttaaatccttgataagagcattttaaaaatgagattgctacctgacactattataaaatcttggctggcagccagtggagaaacaagcacgtttggtgggggaggtgggggcagagaaggagactgagtttagagaaaggaaagattttcaaaggaactgtatagcagattttcccccctctgaattctggaggcccccccgttttttaagtagagcgttaatgcaacctcataagtgcctcctcactattgcctagtggaccgtggggtgggcggtgagtgaattgaacagacaaagattctttgggcaaaggttatctgcgctgaagatgaaactcccatatgtcctttgctatgaattggaactgggtggatggatggaccagacagatggatagcagtgaaccagctaccatatttatagctaggagcacgtgcccttctcaactccagacatccccacccctgtatcccaccttgttctgttccagacacatcagagcagagccccctttagttgcagcagctatggcagccgactgcccaaagatggaaacttctgtgtgtgtgttttgtctagagatctccttttatccacaaagggcatcaccgatggggggaccagtaaatagagctgtctgaagtagcaggccgttgaaattctagtattgtgacttaatgaactcttgtctttaattcctatgacttggagaagacagccattctctccccataatggagctcgttaacccatctctgtactgactggtgcttttattattattatgacgactggagaacataagtct

SEQ ID NO: 87223 - DNA, 1065 bp, Homo sapiens
ttcatccagagtgttttgtgaatgatgttgcattcaagaatcaaagcatcattgcatccaccccaacagggaagagagatcccatagatgtggacgctctttagtacgcatcgtggcatcctcctcccagtgtgtgtagaggggtttgggctcactgtgaatgtcctaggaaaaccaactctggggtccaaagccctgaccactcccttcttcttaacagctccctgggtctctcagatttcaagggcttaacctgtacagaggggcttaccctttgtatccctgtccatgcagatcataggtgggcctccctggggtgggtgcagctctgacatattaattcgtttaaaaaaaaaatcagatttgtgttattggggtgggagtgggggcttaattggggcggagaggcagtgatagccttcctttcaatttgtcaagctttctttcaaaagatctgccaaagaagaaagggtaattaataggcttgaagtcatttccgatgtgtcaggatttctgccttgcttccaagtgataatgttcgcaggctccgggcctctagggagccttccgtcttattaacttgtctgggagaaacagggagtagggacagctcgggccagtgggtgacaggaaataaagatttgtggtgtagtgagctgtaaacactagggctggagaagtttggtgtggggggctgggagcgggtgggggtggtgcagagggagagggtttgctctcaaactccacttcatgaagcaaagtcctagagtttcctgggtcagatggccattcggagtcagcccggataaccccagggaagaagtgctttttaatgagcagtgtttagacactcggcaatttttgtgtgtgttcacctcttcaccccttacttctcactgtttgtttacccttcccccccccacccccccgccaaaaaaaatcatctcccactgaaaagatctttggactttacagtggttattctcacaagccctggacattgtctgcacacatagacaccaaacttttgacttttccaaagacagaattattttatttgtttgt

SEQ ID NO: 87224 - DNA, 1005 bp, Homo sapiens
actcactgccctgctgcatccagcccctgggtcttccacctcctggcacgctctagcctaggcctgaagtagcagggccagacgctaggtgtcgccgtcctggacctgcctccatccccggaggtcttggctcatgggctttcttgatctctgagtgtcttttttaatccctattgcccagcaacggcttccttggttagagacagtctggcaagtttcctctggttcaaacttacgtttgaagtttttctacaaccagaaggtgattctctggcttctgagcttcacccaaccctctctgagccccaacatgggggaacactggtctcttctttctgtgactggtcatcttttacagctttgattcatgctcttagtttccagttttatatgtgcttaagcattataagacacctcagtatttttaggaaataagtggggacataaatataaacaacccggaaatcactgcccctagaattcacagagtggaagaaccaagctttttagggctgatgtggcgtgggctgggagacttctcttttgagaggctgatactggtctttgaatgaactctttaccccaccaaaagtagaaaaaggattccagtgacttcagaaatttttgttgttgttttgagaatgttggcaccactgggaataatgagagacgcctggcctattcaaaagtggcatcagaaacctcagtgttggaaatgcagcctttggttgtccatccccgcagctagagcatgagccccccaaggccagactcgagggctcagcgcttcagttgagtagtcctgattgaactaggctcatgggcacagagcactggactggggaccatagtggatgccaaggctcgaccagtgcaaaatcagcccaaactgaaagctgtttgggaaggcagaatgaatgtatcatctttcactcggcaatttttcaaaattcagccacaggtcttcctggacccctagccaggttttgattttctaggctggga

SEQ ID NO: 87225 - DNA, 1041 bp, Homo sapiens
gagctgcttttaaatgatgttaagaatcccattcttctccctgctttcccacttctgccctggtgttgactttgaaaaaccttccaagacaggctgaggctaaggagatgggggagctttcctgagcagctttctgaggtccgtttttttcttttgaaatagactggaaatctatctcggctctgaatcatccttcgattctcatcgcggaggggcagagaggagggtgcacgggcagcccagctcatgtgcctttgtggccatccctcctcctggccaagagataaccggttgtttttgaaagtcctgtgtttatcgcgagagagcagtgtggtcagagaggcggtgaggaaagagccggcagcccttctgtgatggatgggtagccgacttttcttgtgaagcaaaggcagcccacaagtttgtctctttcaagagaagaaatttaaagcaaagctccagagagagaagttttttcagtctggtccttcatgtaggcttaacaattctaggagggccctgaaaatggcagagacctcaattctcccctccctccctgcccctttatgggctccctaactagagaggtttgcaaagcttaaggggattaatgctctttaaacctctgcactccttcctgctcctcatgggatccgggtgctaataaagatgtactagcttggaaaggctggtaaacgctgctttgttgccacggcaacaggcgaaacaagaacgacaccaagtattgctaagaagagtccttaggatcaagagtttggggcgggggaggggggggatggttcttaaaaatgcagagagtcttggcaaggtaattagacttggtgctctcaaagtaaattcatagttttatggagcattactagagagccttgttacttgcaaagtcaccctccatcaagtagaaggaacagctgagagccgccagcatctgccgccagttgctccagtgaggctggggtgttgcgtcctgagacaccatcccccctctcctcctcagcaagtagtcaatgtgtgcacacg

SEQ ID NO: 87226 - DNA, 1682 bp, Homo sapiens
aggcatgagcagcgcctgcagcccctgctgggatgttttgctcaaacctgctgagacttccaagggagcctgggactctgctctcctactcctttcctcccttgtgtttgggcactcggctgagctccttggaaagatttctgcttcctgtgggtgagaagtagggcagtgtgaggaggcagggctgctaggctaagatcccaggctgccccactgacccatgtcccttcctgggtaatggtgcccagttgctcaagccatacctgaggcttcagcccgggccccatctcccacacatctagccagcgtccgcaccgccagctctgggtcgccctgtcctctgcacccaccgccatgctctgtttcagacacctatcccatctgtccctggcagagcagcaactctccggggactcctgcctccaggcctgtgacccatttagagggatctttctgaaatgtgattctggtcgtgccaagtttagtggctgcctgctcaggcgcctcagtgtggcctccagggtaggcgtgatggagcctacctctccattccctgtccgctggggttccctgctcagcgcagcagggaccccagcagctcctcaaccagccaggttccctgtcaacttttgcacatattaacccctacccacctttcctttgataaactcctgagggtcctcagatgggtgccccttcctccctcctgaaccccctgagcatgcctccatcattatttccctacactgactcccccagttactatgaggatcttaactgcaggagaccatattctgttcctcttggtgtccccagtacctgggacataataggtacttggtatatgcttattaaccagaagagtgatggtgtttatcctcaccaggttgctatggcaacagatgctgcagcccctcgaggccaagtgacttgagaccttggaggtccaaaggtcacacaactaccttcctggggccccacctggcatcctcctctccctacagccaggacaggctgcccagcctcagaaccaccacttgttgtgactattaaaccccatgtcccaatgatgcctggagaccatgcctcaggcactttacactgttagtggtaatggtgacacattatctgagttttgttgcttgtaaatttcttttatgctgataagcttggaactggattggaattgagtgggggacattgtccagtgtccatcaagaatgtaatggtaaacatttaatgtttttttctccttcttccccacagtatcagttttcttattgaatttgggaagcaatagcaattgattaagttgcagtggagcttgccctaaaaggaaatgattgataatccgtttaggtctggcttgctcgcttttcccctcctgatttccttggccactttttcaattaccaactgtatttagcttggtttgcttgttgtaactcatttccccttcctccaggatctgcagggaagttgtaatgtaatgttagagtagtgacatctaattatttccctgagacatcagttagaaatgtaagaatacttcttccttgaggtgggcagacgagggatgtgagtctgtgaggcagaacgtgtctgtgctgccatcagtctttggggtgggagggaggtcagggcgtccagtgacatcacagcctcctgtcactggactcaga

SEQ ID NO: 87227 - DNA, 1062 bp, Homo sapiens
atggccaccttctcagtggaagcaccgggtgtgggatctccctgtttcacaggtggattggctgaggcctgaaatggagaagggacttgtccaagatggttcagggcatggagtatggagcccactgttgggatcgccaagatgcccgataatagcgttcctcatccctgcctgaggagtgaacagactgaggggtaagccaaaggcatggcagatggtacacggaaatatcaccttcttaagaaacgttaacgatgaggggcaggccgcctgcatgagaattcctcagtcataggcaaccagatgggaggtgggctgacttacatgggacagccagggcagcatcttgctacctctttttacgcaagatgagtccaggaatattccacacaaaaaaagcacaggagtcactcaggacctggaggcttttcccaagacatcatgatggagtcttcagggtctgccccaggggccaaagccccctttcccgctcctgccagactctcatgcataacaagtttggaatgaatttggcaatgccatcaccacccagctcacttctcagttactttctgtttgctgtgtactctggaaggtgtggattacccagggagaaccctgccttgaagggtgtgtggccagggacaggttctctgggctgttggctggtaccccacagccctgggctggggtgttcccccttgtgcccatgccaaggcaaggctttctgcgtggaagtctggcaggtgtacattcgctccccagtgggaatggggagcagaggtttcgttgaggcatctcttgggagtgcacagtccctaatttctgaaataccattgatgagaagcagccccagtttgggtctgagttaatgggttaaaagagcagaactgttttcttgggcgctgaatatttcttctagatgttcaggtccataaccaaggcagctaagtcagcgaattgtcagcattccagaaagaagcgtcatctccttgggtgctgaggacctccggggctgcagctgactctgccctcacacaccctccttcttggctttcatga

SEQ ID NO: 87228 - DNA, 1585 bp, Homo sapiens
agtggggaaaatggcttgaaaattaggtgctagaacgacccaattacatttctgtagctttttgtattcaatttcataaacaattttgctcttcgctggttaatcagtgaatgcctttttccagtttgaaaagcacttttgaaattataatgcaattaaattgtgtgtggatgttctggcatagcgagtgtgaaagccaggggcttggcaggccgccatgttgtaccttgactgtaatgagtccctgggctggcagcttgcgagtgtcattcataatattgtccatgctgggttactgtaaagtgcagctgccttaaccggcagttaaccggcgactgccagtctctctctgcagtgggctgtgcgtgcctcttccaacagggctgtaccccaaagacggcagagtggccaggctcctctcagtacttgcccaggcattgggaagtcgggggtcttcctggtggatggggccactgcctcagagatgatctgattacctgtccccagggaagggtggaatgtatttatccttcttcatctccttggcctagcaggcttctctgtctacagttacaacagattatgggaaggggaagggaggagacagaagtcttaagcaccttgctctgcacctagcttacaataaatacctttactgaatccttccaataacctttgcaagagtagtattactgtctccatttgatagatggagatattgaggcacagcgggatttgatgacatcccataagtggtggctctgagattgggacctgaattgatctaactccaagacctatgttctttcagcatttctgcaactgggaaacaaactgaaataaaggctgggggagctgggtgcaggagagtggcatgaagtcactgctctccgagaggggacgtgaggacatgaaccttcttccttaggctgggagaatgcctcttggtccacacaaggatgccatatagaaaatgaaagatgctttagtttttcaccaaattatatttaaccatatttccactcctttggacatttcgatgtgagttgggatgatctataaggtgggcacaagacacaagacagtgactcaaggctgggatcatgagaagcccctagggaaaatactggccatggcataatccagtggcacaatcctgtctcagtccccagatcttgccccaatcaagaacaaagactctcgtgcctctagtgccttaggatatgaggcctgtagaaggtggtcgacccccaaagggcctcacagcaggaggtggtgagatcactctgattctagaactttcttgctgattaatggctcaagtcctaacagttaacacctagcctccacctctaatccccttcttccctattgattctttttcctgatagaggccttcacactaaacccggtttactgcaaatgagtgttattaaactcctagagggtgcttttcagcacattccttcatgttaaaattgccatagactttcaaccaaaggaggggagtacctgtggcctggttatcgtaatgcttgctgagtggaaatgacaagctttacaccaaggtgggcctccagggggc

SEQ ID NO: 87229 - DNA, 1050 bp, Homo sapiens
ttggacttggggagattgtttcctgttgtagcctcttttaaaaatttttttgactgtgtctgggagatcatgggtcaggtgcaacatctcttttgcagtaaagcttggcaaggctagggtggggaggtgaatggggtgggacggtggattagagagaggaggggagatagggcccctgggactaagcttagatttagctgggaagcatgttagtagctgccagcatgtgcttctaatcatctattcgccagatgttcccggaatgggaaatagaggggccttgcctgatagttccctgatggaaactggtagcttcaaattggaaatgggctccagtttgctgccaggtgtttgctccttcctagaacatctggaaggaggacagtagaaaaggcatctctgccccagcctggagttttgcgggcagctgtcttgctgatggatctctgaaagctggacattgtggtcatgaggagagtcatgagaatcttctgaaatgagccctccatttgcaggagttcacctcagagtttaaacttccaggattgagcctgaggctccaaaacagggcaccttgcaagcctgggctaataaggcacctatttctggagagatgcagatttttcaagatgttagaggaagaagcaagaggaagatgaagaatcagctcctgacctaatttctggtccaaagtgaaaagattgaaaaatactttttaaggtggtgactatcctaaaccagtgagccttgtggaaattccatgaggatctcacagggaaaactggaccccgaatgaattaacatggaacccacctaaccacacaagtctttgctctgggtatgtggaaccaaaattatcttcctggctgaaatgaccagtttctcaagaattttagggtgcagtgcaggatcctaagatggtgtagcaggaggccactccctgggcctctgagtgcatctgccatcagtgggaaagggtgtgaaatctgccttgggagttacagggaggtcctcagcgtagacacgagccacggctgacacacactcagg

SEQ ID NO: 87230 - DNA, 1031 bp, Homo sapiens
ctctgagcagagggatgctgtgccaagtttcatttctggagctgtggtggctctaactaggaatcgagcttttgcccagtcctgacatcatttgatcatttagctccgaggaaccagaggcaggaagcatgccactaaccttttactgcctgtcactgttgaagaggaggggcaggccgccctgggaaggggagaatcaatccacaacttgcttttgtcgtttgttaagtcttctctccccgcatttcaggctgaggggcctgaccttgccacctcagaaccatgagacaggaggatgcaggaaggggagatgctctgagggaatgtggcagcccccaccaggccccgctcctcccaggagatgggtttctggtggacctggtagtgttttaccttgcctttacctcacgtacctctggattctgaatattctcctctggttcttgtgctctctgaatattctcctcttggattcgtggtgtggtcaacgacaagggtcacctagtctatactccagtttcctcttgggttaaaatggataatcctttttgagatacttcatcgaatgatagtaaggataaagtgaaataacctacaggaatgggtttggaaagacagtgggaaagtaatagtaatgataataatgtcactttgagagcacatccagacactcctctgttcttttcctctctgttcccagctgggcaggtgagcagcttacaccaaatgggaaagccaatactttctacagccgactgcgtgcctctgccttccccgcccacatcaggagagggtcccaaaccctccctctctgcaaatgcccacttccctcatgtcctctcaatcccacctacacccaccctagttctccagacccctaaggaagggtactttatcattaggccaactaattgttcatctgtgcttcagtgggtgtggtgggggagctagaaagctgatcagccgtgccaaagagtaaatcaatggatcgtagccaagtcaggacaggtgaccctgacaggtgtgtgcag

SEQ ID NO: 87231 - DNA, 1033 bp, Homo sapiens
tcatcagtcttaagagatgagcaggacagatggctctgccagccttcaaagacacaaattctgcattctctctctctcttttttttttttttttttttgagacggagtctcgctctgtcgcccaggctggagtgcagtggcacgatctcagctcactgcaagctccgcctcccgggttcacgccattctgctgcctcagcctcccaagcagctgggactgcaggtgcccaccaccacgcccggctaattttttgtgtttttagtagagatggggtttcactgtgttagccaggatggtctcaatctcctgacctcgtgatccgcccaccttggcctcccaaagtgctggaattacaggcgtgagccactgtgcccggccgcattctcttttttaactccctccccccgccaccccccggctggagcagatccctgttctggctggtcccatcccctccacaagcagcccatggacactgaagcttattcctggagagaaagtgattgggagatccagggttttgcctggcttatagtttctgtggcatcatttgccctagatgctcaaacgtcctatcttgtcggtggaagtggcaaaaccacatttgacaccgctctaggtggcggctcaatgggagtggagtgctgcgcatctcctgtttgacctttcagtcgctgcatggctcttccaagctgccgcagcctggagaaatgtgaactttcaccaaagcctttgcaaatgagcttttccagacaaggcagatggctttgtttggccaggcctgaggaccccgggattgacttcctttctgctctttcttctcactgtcctcttactcccctgcacctcagaccttcagctaagcagattccactccccctggcccaggctctgggtagaaattggaaaaggagccgggcgcggtggctcaggcctgtaatcccagcactttgggaggctgaggcgggtggatcacgaggtcaggagatcgagaccatcctggctaacacggtgaaaccccgcctctattaa

SEQ ID NO: 87232 - DNA, 1026 bp, Homo sapiens
gcaagcaaagctttggaaaaacagccaagtgttcagcaaagtgaaggcttcgcttttcttcctccccgctcctccccttgttgagaaatcccattatccgggagaatgattgtgaaactccaatctgtctgccgctgagctgtgggccgttcttcttgcctcctccgcccctgccctggtccccttgtctatctgcagggggaagacaaatatctatatattaaagctttaagaatctataaatctgagttgattctctgctggtgacagcccaagctctttcccaccacgtttgacatgatctaatgggtttacagttgtttgagtgcttctctgaagcaaatgaaagtgcttagttaggggacgtatgaaatggcattgtttgttctgggcactacagcaaagctaggggatcatctttaaattatccaccctttctcttcagccaccccgcagaacaaggggctctgccgctgaaggagctgcaaagacagttcctactggccttgcctttctgcttgagaggtgccaggactgggggggtaggatgcatccccagctgtattcatttcgccaggaagcttggggctaattgggaacagaagaatgcccaggggatgaggggaaggggacgggagaaggatggtctcaccaaggtagaggagtgacaaatacttgcttctagcaaaacaggagtaaaaacaagagagactcctaatgagagctttggggcagtttgtgctttccattctcaggggccagcagtgtgggttggtgtgattagttgccttgctacttggcgcaaaaccaattcctcttttcaatatcaagtttcataagcgtggaacagtaacaaatcattataaaccctctgggactggtgggtgtgtgatgatgcggggttgtttttctttttccccctcctctttgataagcccatcttttcagcccaggtacatttttcccattgtaaacagaaaatggcatgggagggagtgtgtctcggaaacttgctgtattgttaat

SEQ ID NO: 87233 - DNA, 1964 bp, Homo sapiens
cgggtgcggtggcgtgtacctgtagtcccagctacttgggaggctgaggcaggagaatcgcatgagcctgggaagtggaggttgcagtgagccgagatcgcgccactgcactccaacctgggtgacagagcgagactctgtctccaaaaaaaaaaaaaaggctaagatggttaattttatgttacgtatattttaccaaaataaaatacttatttcagaaaagaagactgtgatgccaaaaggatttttcccacccatcactctatcccaaatttctgaccccattgtttttgtcctcctctgctcattttaattcattttgggggttattcagcactaagttactaattcattgtaaatgctaatgcatctgtgaagtaaaaatgattatatgttaaggaataacacttattgataattaagtgttctgttgcttctttgctttccccaaatggaataaataaatattttagacataatcaagtttgttttctctgctcgggccaaacagacagagatgttgaaatgatataggtctttaaaacactgcaaatgagtcttgacattgctgaattgttatgcatccagggtacataggcttgaaatccgggctatctcctttaatcaggaaaatcatttttgtgatacttgaattttgagtcctgtggggttaggaaaaggaccagcggggagaatatcagagtcagaatttgagatgatgccctgagtcttgccccgacccttcctggtgcaacagtctgcattttaattcctgtctcctacctcagttgcctttcttcccatctcagagtgggaaactggggcatcagagagtcctgaattaccattcagggtatggaggtgatttgtgcagtggaccaggaaggagttggtttgcagcaggaaagcagcttccatggccgggaactcagccatggcctgccatggtgacttgactttactctggcctgtattctaggatcaagtgtggatctttgcttagctgcaaggtggctttaaactaggctgtcctctggctcatggggcagtgcccttcagtggtggcactgacttcatgttctttccccatagccaggatgggtttttctcattcatccactctctcctgccttcagtccagagcagcatgattggccaagtcagcaggcctggcgggaggaggttgcgtgcagcccccctgtgtgggatatggaggcagctgaaacctagaaccttgctgtattagttttctgtggctgccgtaacaaattaccacaaacttcgtggcttaaaacaacagaaacttcttgtctcacagttctggaagccagcgctgcactcccccaagaggttctgggggacagtcgttccttgccttctggaaaaccagcttcttaagactccaggtgttcctggtttgtggcagtaccactccattctctgcctacctctgtcttcacatggccttcttctctttctctgtgtctcaaatatcccctgtttgtcttttaaggacacctgtcgttggatttagggcccaccctaaatccaggataatctcttctcaagattcttaattaaattacatttgcaaaagctctttttccaaataaggtcacattcataaattccagggattaggacatggatgtatgtttggagggccactattcaacctgctacacttgtcctaattagcagtgaggttccctaaaaactggcctatcctggcttgttttatttgcaaggtgcctgggcgtgggggctggggcagaggggtgaccttcaaagacagatgagacccagagtgccccacaggctggaagtgaggggtgagagggagacgctgtccctgcatgggatcctctgactcgtgcctgttcgtgaattgtgcaagcagagggccattgccttgttgatctccacgtccttcacagtgcctagcacaggtggcagctggtaaa

SEQ ID NO: 87234 - DNA, 2262 bp, Homo sapiens
agcactggcccagtatttggcgggtggtggtagcaaatgacatgataaagatcacgattgctgtgtttcgtggtcctagccctctgttttactggaaatggtttgagagcagatagtagccttttttattctcataccgaagaatctgctagtccctgcaggagctatgctaaaggagctccacatatcagctccctgtttcctggtgttccttggaagatggtgatgttagagttggatgcatgagagtcagaagggacctgagaaattccctctccgtcttgtgttgcagggacccaaaatagacacagagtttgaaaaggaagcatctgtattttgctcattgactggaaacacaattatcataatataattgtgatagaacagccattcagtttttgtcttcctgcttggtgtgtctggccattcagtttttgtcttcctgcttggtgtgtctggcttagtgttcagccaggttcatacctttggggagaagagtgtcttagctggggcggctataatgaagtaccatggtctaagaaaaacggtttatttctcacagttctggaagctggcagttaagagcagggtgccagcatggtcatttctgggagggccccccttcctgtgtacagacagctgccttcctgttgcatcctcgcatggtagagagaaaaaacaagctttctaatgtctttctgtaagggcactaattccatttatgagggccccatcctcacgaactcatcacctcccagaggcctgaactcttaataccatcacattgggagtttggatttcaacatgaatctgggtggggggtcggggggcagcaaggggcagccacaaacattcagatggcagcagacagccttgtgaatcctgatttgggctgtgacaggaggtgtgaaacccagggtccagttctaccaccttcatttgcagatgcaaaagttgaggctcagagagggcaaggggctcccccagattaaacataaagtagatgcacagtgagaagtggaagccaggtctcagtctccccatcagtgtgtctgcccccatggcctgtgctccctcgccatgttaacgctaccatgtggcagctgcatcccatccaaggagggtgcaaccctgcatggggccatgtggtaaagcagcacttactgagtggggtcacagatggggccacatgctggaaacgctgtcggaggcgggaggagaagaaagaaaggggcaggagggtaggagaggaactgaggatactgagcagcagtcgcctgccaaaattcttcagtgcagcttgtctagcaaagccggtctccagcagagtacatacagtggatagctgacgggctgacagcaggcatcaaacagtcttaaactgccccaaatccagagcgcttttgaagcagcagtataaaaaggatgcctgcgcggaacagaggcctgaaacttttaatagtttcttccaggcctcaggatgtcctgatgaggtattagaggaagtaattcaggaagaaaaggacaaataaccacctccgtctggaggccgacccgagggctggccagggctgctcgcggaaagggcaagcgtggccccgcagtgatccacgaggctctggttagcccacccgcctgctgccgtgcacagagccgcggggctctgacccttgtaaataacagacaagtaaatttcttgtttgcttcggggcaaatgtaaaccacacagtgcccgctgcatgtgggtgaaatcattaacttttcctcgctgtcggaagggtgctcagtacaaattagaaatcattgcctccaacctcaaggtcctcccaaggatccgcctacctacccccagaccaggaggctgtcaagacctcaggacgtcagagaaaaacctgggcctgccagaactgaactcaccccgcctctctttgttttttcttctctctcttttcctttagggtttggctttgtcacttttgagaatgaagatgttgtggagaaagtctgtgagattcatttccatgaaatcaataataaaatggtaagtgtgtaggggttgcgctgaaatggaatgccccctttctctacgtacacacccagtcttgcagactggtccagcccatcatcaggctggagtgggcaggggtggggagggggctagatgctcggggtccaggcctgtgaacagtagcagttgtttcatactgaggtggacaaactctgtaaagggccaagtcgtgaatattttcatctttgcaggcc

SEQ ID NO: 87235 - DNA, 1045 bp, Homo sapiens
tgccatcactgattgtaataaaacactgagcagaggaaacaatggatgaaattaattctggaagtggtaaggagatcagttgtggaagctagcatcgggaaaggctttgtgaactagacgcagataggccttgagggttgggtggagagtgtggggaagggctgtgtgaggtggggtgatgggggggggtggctggcagccagagacccagaggagggagcaggggttttgaagctgggggtctatgattggattctgactgtgctttgtgaccttgggcaagtcattccttagaacttctgtgtccttttctgctgtaactacgaggcgggtaaggccatcgcacagaggaaatgaggctccatgcaatgagggagttgacaaccatggacattctttgaggacttctgtgtgccaggcactgtgctttatatccattatgtgtatatgttatgtaatatatgaaaattacaaggatgttgtggctgtgcctagttatggatagcactcaataaacagtgcgtgccttcctccccagagtaaccctcctgagtcaagattataaatctaacaggtctctcaatgccttttgcaaacaggtctgggccatttataacatgcatgtgtcctggaaggtagacattcctgctgcctgcctttccctatggaagctggcagctccatttctgtttgcacagtaaccccttcctctgtagactgcatgggcaggtcccacatccatgaggacctttttgcagtagaacaaggaaagttatcatttacaagtaggtcccctggtgcttggccacacgctggtccctgtccacaaggacagtgcctgattatgatgtctgagaagggaggagggagggtctcttccgctcactttccagtatccacagtgaccagctgggaagcctgtctgtgttaggccgttctcgcgttgctataaagaaatacctgagactgggtaatttatttaaaaaagaagtttagttggcttacagttcagcgggttgtacaggcatggtgccaacatcgctag

SEQ ID NO: 87236 - DNA, 1507 bp, Homo sapiens
tggagctaaggctaagtggtctgtctgtttaataagagtttgaatcagatggcctggcatgaagagtcactggcctgagagaatgtcaggggcatttgtaaatgtgtaaagggctgaaaaatcctgagggattattattattgctattgttgttattattcacagacacatccaacagccattgtctgcctccttatctgtcatgctttctgcacgagcgtcagcctgagcttcaatctgtgtgtatatctgcagcttacgtccttgccacccctccagaacccagtttcatccttgtaggtttttccgaagcaggatttgcacaagtggcgtgttttcttaagtatttattttgcaggccatttactcggcatggctatttttacagtgggtaaggagcaaggctaaaaataacttagctcataaccagacaggttctgcatttgacatttacgtggaattcatttgcatctcatttgttcgcctttctgtttaacaggtagaatgtaagaaagctcagccgaaagaagtcatgttcccacctgggacaagaggccgggcccggggactgccttacaccatggacgcgttcatgcttggcatggggatgctgggtgagtctggacaggaccgcaggtcaccatggactgggagggctatggaggcctctactcccaactgggtcacctaccagtggggcaaactgcttcacctttctaagcctcagtttccttgtctgtagatgaggatgataattccccgttccaagacagttgtgatgattaagtgtgggtgtgtgtgtgtgcatgcatgtgtgtgtgtgtgtgtgtgtgtttgtatttataatattgccccatgcctggcttataggatatgttagactattttctctcttttccatctccttcctcaaaagaaggaaaagtccccctctatctgcctcagccctctcatctgagtgggagttcttaagatgtaaggactcctggctgacttgacttgtgtgggctaaggctacgttttctaaaacttgggagaggagggaagtggtaagggtgggcgataatcctgtctatttaaatgattaacatttttctcttgggatatcaaaatttgcatttaaatggatgttttaaatagcctgttttactctttatttgccaaaaaaaaaaaaaagatgaaagacaaagtgtgtttgttctgactaaaaatgatttctcctggcttttagagaaattgagttgcatattatgtccctttccttaaaagtatctctgtccgtcctgcgtagataattgaaaatcttaccgcttaaatggcatgaaagatggagaaagcagtggagatgcgtaatggtgtaggtcgcaacaataattagaaatttaaaggcgagagaatggtattttagtgcaagttattgtgtgtcaggaaaatactaattaagtgggataaatggtagttaatggtaaaattccattcaggcacatgagctgtctagtgttaatgg

SEQ ID NO: 87237 - DNA, 1041 bp, Homo sapiens
gccacttcccaccctccctgagggaaggtgacacataggcttatgcttttgctgtcagattaacactaaaatatttaagacccccagctctgaagttagaagcaaaggagccatttttcatctggaaagcccctaggcagccatgacttggctgtttgcatataatccatttatcaatattgttgaaatcatggtataagaaatctagtacaagatctgatttgctagcaggtgattaatttggaggagaactgagctgcctagccacgaaataaatacgaaggaaggcgccagtatgcatgtgtccatttaaggcatctgagccctggcctttgctgttcttccttccttctttctccgtcgggttgctgagctcaacatcccaccgggctcctgctccttagctagcagtcagtgcagagctgctgggtccttctgcctcgcttgggcaggcttctgtcaatgagtcaccaagcaccgggaaataagtgcacaggaaggagcaggtggcaagaccctgtggaggtagagacagttccattcagtgagtgagctgtgactgcaaatttgggaaggttctgggggaagcaagggaaaggagccacagctggtctcactcaagaatttgggcacgtcactgttgcaagggacccacaaggctttctacaggtgacaagactaagctccaagagaaaaaggaagactcctatcttaagtcgggttgctgtcacagattaccatagacgaggtggcttatgaacaacaaacatttatttctcacagttctggaggctgggaagtaaagatcaaggtgctggctgattctgtgtctggtgagggcccgcttcctcatagatggccccttctaaccgtgtcctcacgtgttggaaggggtgagggtctctctgtgacctctttgttaagggcacattcatgagggctccacctcatggcctcatcacaccccaaaggccccatctcctaaggccatcaccttgggggttaagatttcaacatagaaatttgggggaaacacataca

SEQ ID NO: 87238 - DNA, 1061 bp, Homo sapiens
aactagctcttaagagaggcatagcaaagtgggggttgctaccatttctagagagagaggacacagtcccggcctgggctgcccccgctccagtcaatgctcactgaaagtctgtcttagctgcctgtttgaatgactgttctttttctcatttttaattcttggactcatgtcctcattgcttcactcaattaaaaaaaaattattctccagtcccctcccactttgcttcttgtatgcattgtgaccgaccccacttcctcagaatgtaacggggccagagggaaacttctcacaaacttcgtagagcctcctcaggggaagctaggaagaagacatcaaatgtttttaagtcatgaccaaacaggcttgttggggacatatcatggggtgagctttgaagtgctggtggtccagaggggttgcagatacgtgacttggagcacccgtgtcttacgatggacagtgataaaggtgaacacacagagacagactattctctaagaatgtgagaaacctgatctggaagaggagctatataaacactatctgactatctttgtcttttggggccagtggctgttggcataatcacaagcctgtctgtcttcgagaagggacagtggagtcatccaggtgctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgacttccttcatttccctaactgaaatacacccactctcttggaataatgacgtaccactcagttggaccctcaagagtcactgctttgtctgtgctggtagtttgtgagaagtgacccgcacgcttccatttgatgcatttgatgtgagtgaatccatacatttgaatgtcattgtccttgagaccctacatgtgcagtttggctcatctcatta

SEQ ID NO: 87239 - DNA, 1063 bp, Homo sapiens
ttcattggaatggccactcctgcactcccatctctgaggactgagtcttctgagtgctctctctatcttcaagtggcatttggtgtagccacgcccaggtccttgagctcagctagaagaccctagagcagacacagccaatgcctggttccaacctagaggggtccaaagcacaggtcccccaccttcttcctggaagagtgagccacggcctcctttagcccaggcccagcttaccattagccagttgtctctccttgggcagttgatctgtgtgcagcctgtcctgggaccccagtcccataaatagagcccctttgctgtccacagctagcaactctaagctccatgagggcagagactgtatgttgttcactgctatgattccagtgcttagaaccgagcttggcctgtagcaagcactcagtatttactgggagggcacagggctgagaatgggtcttgagttatcagttctgctgcagctcactgcggaagttctgggtgactgcatgcaggtactgaatgctaggccccagccctctttggggagggatttagtgattcagcggtagaatgggcccagggagaaggctactgggccaaagtccccaaatagagctttctgcttcctgccccctgagagagtcgcaggacacaaactacctactgcagtgttctgagctccagctgcaagttggaattcccaggagagctttggcagtttctgttgccctggttgcacctcagacagattatatcagaatctcaggaggtagggcccaggttgtatttttcaagctccacaggggatttctggctgcagcccaggttgaaaaggtaccctactggaagaggggaggcaggaggaatttccgtggaattcagctgtgggcctggagcaccccctacgagtgggatgaaaatgccccctctcagagagactggaggaaggcgtgagctctccctccgcagcccaagacaccacgttctgttgtggagacaggttgaggttgagaccaaagcctattctcaagccgcagaatctgtttgccaaaaacaa

SEQ ID NO: 87240 - DNA, 1351 bp, Homo sapiens
cagctcccggccaaggtgcctgctctgtcaagaggccgtcccaagtgcctcctgcctgtggcacggggctgaccactccgccatgatctctgccaggagcagtgggccagcccagccatgctcagttctactcaagacaaccccaggggagccactgtgtcgatgcacggccaacagggagctcaaccctgcttctcaagaaaaaaattcctcctacaattcttgaattattgttgtgggccttctagaaccagcttctggggtgacaaatgggtgagaatcaaacgcacctaaagatgttgtgccttccggaagcctgacagccactactctgtgtccctctcaaaagctgccctgtgaaaatcccttcccactcctgtctttgtgtggagggcggggggttgtgtggcccgtgacctaggtctgtgcctggccctttcaaggattcctccatgactcaggctcctctctctcctgaccaggcttcccagcagcggcttatggaccagtggcagcagcggcggtggcggcagcaagaggatcaggtaggaaggtgtatgggacaggcgactcccaggcatgcccccagtgtgcagggggaggtcaaggccctgtcggatctgtgtggctgcatctgtccaacaccactctcaccacagccccggggagggggtggacggggagggggtggaccgggaggcgcgggcaaggcctggccacccagggcacttgtagtggggtcagtcacagtcatgggactgcaaactaaaggcagattattattctctccttgaaaaaaaaaacaaacctgagtttctttttgactttgaccatcccgtcacctgacagctagcttcgggtacctgtggtcatttccctccttggcttttgctaattcaacaggctcccttccttgggtccctgagccagccagagaagtgctaggctgtcccctgggaccctgctgcactggtaggtgggcttgctggtctggctaaacccccagagcccctgaaagcagccatgggaccagccctgggcctcagtgaatgaagctgctgtttctggagccgctgtgcctcccagactcttcttagccagactcctcagctccagctgccaagggaattgggctttctgtcccatgaggttgctccagtccttctgtctccaaagccaaccttttggaggtctggaacccctcaagtgacatgggaacactttcccagcattatcatggggtcaggccagagctgggatatgtccagggtgcccggggtcccttttgtccctctccccagaatgctttctgccttcccaggcaagcagggcttctgctgtgccctgggct

SEQ ID NO: 87241 - DNA, 1021 bp, Homo sapiens
tccagtcacacatttttttttttttttcgggatcaatggtgtttgatttgtagccatttccatcaggagcaaagtctctcccagcccattctaggtcagccatgctcatcgctgcactgttagtgaactgtattcaggagtgtgctcccagaccacctgcccacaccagcctgggttagcgcaaggagtaaatcctcaactccgaggtgcccgccccgccccacagggtgcagggtcagcctggaagctacagggcaaccctgcagtgctgccgggcagggtgtgtcaggggcttgggatgtgccccagggcaatgactagactgtatccaccatagtgagagcgctgcctaggcaggaagacacttgcctgtgtgtagccaggctaccctagttcctcagccccactttggacctggaacagggttacaggtttgggaaaggaagcgttctgcctttctttcttttaacgcattctgccagtaaggggactgtcacctcactccttctagaaaatgatcgggaagccaagcctgatgggatggccaattatttacctgtgggtggcctctccgtggcaaaagctctttgctctgaatttcgaagaccacaaagactcacttgggtgtgtgcatcagtctaggccacagagggctcactgggtgttgatggcctagtttcaccttccccagctcctgaagcccttactcaccccagctcctccccaggatgctcctgcagcctcaactactgcaggtcagcatgaactcaactgcattcccttatagggagacacagggagacattcagggagagtctgttgagtacctaccttgaacctggtaccatgctaaacctggcaggcaactccaaacagtagaaaacgtggcctctgctccccaggggctctcaggcttcatttagggatcagacatcatcctatggacggccctttttttgtctttgatttttgtctagctccaacgtttgggtttttttttttttttttccttccattatga

SEQ ID NO: 87242 - DNA, 1685 bp, Homo sapiens
gtttggggtgacattatgggtgggtccgtgtatcaatcttagagcttctgagcccctggtaccaccccgtcccacctctccccacccacccggccccagccaggaccccttactgtactttatacttgccagctttattccaatctagtaacatgagctcctgatggtggtggtgagtgtgagcagtcatatttctgttgtcttttctcttgcttggttggggctgcggtgagagtgtctctgaggcatactttcccgcctctcttacgctaggatctgcacacctcctctcaaacactcttctgagcacgctcagcgggaaggtttgtccacacctattaatcctctctcagtgtccagcttcctgttagtaccagctggtttgcatgtttttgcttgttcagatgaaacagttcaagaaacaaactcatatccaactctcaagaaatgtctttttttgtacactttcgtttttgattttttttattagttacaactccaaaacacctgttgtccagtaaaacatttcacacctcccctgcctgttcttagattgtatgtatctgtgggactgaactaaatgcatgcaccgtagtagatgtactggtagccgtagctgtagttgtagtacatgcattgttgagttgatattacagggtctttgacggctcggcacagcacggccgtctgaaggatagtgcggggaccaggaagagaaggggctccatattttcaatgtttccaaggggcttggatccatgttctcaccatcagccaccaccacctcccctcacactccccgttcccccagtccagaactgggtcaccaccctcagctctagccttcctcactgaggtctctgttgatatcgtccaattatagtgcaaaaatggagccaggattggaaggagtcttaaaggtcttccttgttcttgtctttctcatactattcttgaacagagcagatctttttttatttcttaaggcctaccagcaagactccttcaagcccttctactccttgagtcctttggcaggtcacagccagcccttcagggatacgggtctatgtggcagtcctgtctatatggattacttcttggggtggaggggaaatgagacatggtaaggaagggattgagatcttgagatccttggtctgcagacagggaatgcacttggccctagtgaatcattgctatttgttcttagggttggtgaaggttaagtagggtgagagtggtgacattcttagcatggaggtgactggcacagtttcgtggagacagaaagggaggtcggcttggaacatccaagaggaaccacccctagtttcctccagttccccaggaaggctccctagaggggaaaggagcagtcctgcagcctgtgcccttagaacaggagcacgtgctgccagtcatctttggacatgccatcttccctacatttgtggtgacaagccataagggagtgccagaggtctctcagagcttctggaggtgtccctactctttacgtgttgatgctgagtgagtagtgcctgcctcctggaacctgctctttaagtcaggatgtggtggctctgcccagtgctgcaagaacattgatggaacacaggtgggatctgaaccttcagggtgcaagttatctactgtgggagacagaagcccaggaaaacgtc

SEQ ID NO: 87243 - DNA, 1083 bp, Homo sapiens
acttatttaaaatcacacacctggttaccggagagcaaggctttggttaaaggtgaagaaccctggacttgaacccaggtctctggcctccttaagtagccctctggagaagccgtgttttttatgagggacacacctgccccccaggacaccgggcacaagcaggaataaagaccatgtaggaaaaataataaaataaaataaaagcccatgtagggacagcccaagtagcctcagcttctagctctatataggccaagcgctcagtctctggcctaaaacctcatagtctgatctttcagatgtagatttcagaactggacctacgggacatctgccatggagttgaatgtggcagatatttattaagtatataacaatagtaattattgttatatgtggtaggtactgtcctaagcctgattcaagggtgcttttgactgtatcagaaacctcccaactctgattaaacactataggttaatgttacagggaattaaatattatgggggatttattggctgacatcctggaagctccatagaagagtgggcttcgtgcctggcttgttcagggatcctttttctgcaattctcttagcttcgccctccttctcatttcaatactgtctttatattggttttcctcatggtggcaaaatgattgcagcagtttctggcatcataccgtcctgtccagaagaggggagtcagatggtctggaatgctaggaagagtccagagctttgtgctgcttggctaaggctggggttacaaaaccagtcactgagggtgggatccaccccctctaaaccgaatggctctttacacggtggtgtaaggatgggttcccaaaggaaaacctgcatgctgataagaggggaaaaggaagaatgatgccagagagacaaccagtggatgcccaccacagccctggaagttcctggaagttcatggataaatactaagcagtctccacgccattgaagatctcccaacctagtgtggaaactaatgggtaattacaataggatgccataagcccggtaacataagcctatccaatgaacagaagtagcacaga

SEQ ID NO: 87244 - DNA, 1602 bp, Homo sapiens
acattttttcctgtgggctgcgaggaccgcttctggaaggtcgctgggaagccccgcccggccttagggctgggaggggattggctgcccagttgctggggctttgctctgagccagtggcggggtggaggggcggggccaaggcgggagcagcgggcttcttggccaatcatcctgcagggaggctgggcacccggtaccatggcaaccgcgagcagggcctcatttgttttgtagatgagtaattactacacaattagagaaagctaaaaataaaggggccctttgttcctggttacttattaatattaataaaatggtctgcccaggtctgtggtaaacatttgatgcctgcgtgcctgtggcagaggcttgtgtagccgggaaaggcaccccagccccgctcgcccctctttcgggaagttatttctgactatatcctggagagggtgggcttctgaccttggggagaagaggagaggctcagtgtgacagacataggatccaggatgtcctggagtccgggtccgtcactgactcaggtggaaaggtggcggcagcgtcaccatccttcagagaaaagacagacacacagcagcaaagcagacactatggaccggtgtcagaggaaacccctagtccagttttgctgtgtccttctgtgttttctggcttttgattgatcagctccaggtgtgtaaaatagtcgttaagtcttcaatggaggtagcccccaagactccagtgactcccctcccatctggcttaaagggcacattccgttcaggcttggaaatgatctgctggaggtttacactgtgttcagggttgtccccgtggctccccatgccctggccttcgaagttaaagcagctgagaggcttgctttctattccttctccctcctagggggagaggttgccttgttgattactccagtgaggatgattaacagcttaaaaaaaaaaatagaggcagcataagagcatagaaggcagagtagggaatcagaagacttggttccaggcctgcttccacctctactaaacgaggaattcagactaaagggtccttgggagccatttcagctctacagctctgttttgctgctgtttccaaagctggaaatcccttttccttggagataggaacagggacagtgacagtgccttaagatctgagagaacaggccgggcacggtgactcacgcctgtaatcccagcactttgggaggccgaggcggctgatcacttgaggccaggagtttgagaccagcctggccaacatggtgaaaccccatctctactaaaaatacaaaaatcagccaggtgtggcggtgtgtgcctgtagtctcagctactggggagactgaggcaggagaattacttgaacccgggaggcccaggttgcagtgagctgagagtgcgccactgcactccagcctgggtgacatagcaagactccctctcaaaaaaggggaaaaaaaaagaaaaaagatctgagagaagtgagtggagagaaagccaagaggttccaggtgataggaaacttcgtgggaatttgaaaacagccatgaattgtttaatgcatgaaggcaatggg

SEQ ID NO: 87245 - DNA, 1051 bp, Homo sapiens
caactgagcagcatgatttaaaaagcatgtgccttcaagttagagccagatttggtcctgtctgagacactgtgtggcattggacacatttcctagctgttcaaacccttggtcttcttatctgtaacaggggttacacagctgctcttacaagatgttcggagcatgaaaaaagatcgtgtgaaacacctaccaacatgcctggcaacacagtaggggctcataagtatgagttccctttccagcctcacacctgcagaagctacagcttctagaactttgtgcttcttgcctcattggttttcacctccaggccctgttttgtccctaccagtatcaggcctaacaggggcagagtgatatctaattcttacatagcttttcatcatgattgagaagactacattaggctgcctcgtaagtctgtggtcccagccttggatttcacagtgttttcttttagcagcagtctgtcatgcagaaactgggcctgcagtgagtgcaatcacttataagacacaagcaaggatctgagcctcctggcaggtagcaggcagggaggtagctttcaggttgggaattggtgcctgagcacaccacagagcagcaacatgagagggtggctggcgacatgtggggaaaagccaaactgacttcttttttgaaaaaaagagacgagtgtgcttcaaagacagaggcagtcaatggatcaaagcaaagcaagggacattttcaggactgaactaggagaaacttggagccaccaaactgtaagagacagtagggagttgtctccgggcagcaagctccctgtctatttcctgtggagtctcagacctgggagggctggatgaggaagcaaaggctctggtatcacccaacaggggccacctctctgccttttctctgctgagtggtgatggtggcatctcgcctccccagggctgcgtgcccagctgctgggtggttcaatgcagcatggcatgggtgctgcaggttccggggagcctccttgtctgttattccttgcaaattctaacctgtgtgggcc

SEQ ID NO: 87246 - DNA, 1087 bp, Homo sapiens
acgttgtcctcttctgggacaggagtcataatatccaatttataaacctcagcactgtttatttattcaacaaagtgtgctccctgtccccgccccctcacacgcacaccctagctgagcagtagacaaggtgcccttgcccactaagagccatgtcccatcctctcttcccaagctgatcctggtatatgggaccaattctggccccccaaaataagtctccgtgcctggggaaaggcaccgttcgcttagaaggatcactgagaattgactggagaatgacttccacagaaagcaccctcaggtgagagatttggcttcatgccttcccccaccccccaaccccactccccacctctcctcttagagggagacgggttctcaaatgaccccctttcctgcgtagccagccagtgttcagtttgtggagttacgctgagtttgcaaaagaagaaaattgctttgtccctaatgccttcccactgtcagacagcaggaacagctactgacaagtttatgtgccgagtggcagtccccattctctcctaagcagccagagccgttgctttttatgagtcttctcaaagatgcatgggtttccagatggctcgttcggggactttaacatgctttctggagcctggttcttctgctcacagagacagacagagagaagtgtcgactgtggaaaatagaggctcctctcttccatgcgcccagccctcaggggtgcgggttccactgcccagaagcctagctagaggcgggaccagccagaactgggtgcttattgcctgctggctgcgccctctagtggggacccagcagccctgtctttcacccctggctgggggacatctgcaaggtgactttgagctgaggctccggcaccgtgatgagcaagtgcgtaataaaacgggacttgggatttgaaagctgcattctaatacagtgtcttctccacggtgattttagtgtcatttgatggaggaggactgagcaaggaggggtaatatagacctaagatgagctgcttattgtgaaattcccttcaggccgactcagaaaccacaggcctccccacaca

SEQ ID NO: 87247 - DNA, 1008 bp, Homo sapiens
tcatcaatctcttcccatccctgtgacaagtgggtgaaaatcaatccacttctggctcttccaggcccaccagaactgagggcctcaaatcacaggcccctgggaaagggaggggccaaagccaggagtgaccccacctgcatcgatgttctttgcctctgccattgaaggcaactggtcatagggcagagggggagaagccaagggaggcagaagggagaagtgattgttgcaaggagcagccctctggagccaaagatgtgaaagtgtgactctcagaatgtctggttctttaagacgggttagccgtagcccaaaggtagccagcccagactcaccttgaggcttaaaaatcagtaagaacttcctttaacaattaaaaaaatattgttttccattttggaaaagaaaataaagtttaaactactaaggagaaataaaggtgagacaaaattaacctggttaactggttgacaggctgcggccctcattagggtcagaatgatgggattgggggggccgaggcagtgtcaccttccgctgccccccgatctgcaaccccaccactctctggatttgtgcgtgtcaagtccactctctctgtagcaaaggtacatcctgagcctgctgttctcactctggagttgacattgcaggataaccaagagaaagcaggtgttttggtcagctatggtttagctatgaattggttcagtcggtatgttctgcattcatacttctttgtcttttttttttttaaacaaaaggaaaaaaagtttaaatcccccctttccttctcctgcaggaggtgagtgtgtgggtgtcctgtagaaccattggcttccaccccagctctggccccagcctccaggtttaccattcccccccatccctccctccatccccttctctccaccccaaaaggaaactctctgccgccatcattactgttatgtcaagatgcccaaactctccataacatatcccatcctccgaccacgttcagta

SEQ ID NO: 87248 - DNA, 2435 bp, Homo sapiens
attgggagctcctccctcatacacacactcacacgcacgcatgcatgcacacacgcacacagacatgcacgcacacgcacgcacacacgcacacacaggcgcacacacgcctgccagccctacttgtgcaggatgggtccttgttcagctccgctcccaagccagtatcacttaagtcagtagtctgatgaatctaatcccttcggatcaactgtggtaccaaatccagaataatattattcacctgagagctgctcaatttaggggaccgtctatcaccacttataacacaacttatttccatattcagcatccagaaacacagacccaatttgttcttgaaaaccggggtcttttgacctgtgggctgtgatgtttttctgaaataaccagaaagcatcccagtttgtctgcactgggatttcttctccccagctagagccgttgggactgcggacagagacttatctttgcactctggggttcagggcaacatgcccatcactgggggcacaaacccccgtttcccaccatccacccacgcctctgaatctggcttttggtttcccccggggtaagcagataggcttggtaggggcggagggagtggggactagggatttggagctgaggaggatgtcatcctggcccctcatggcacggtgtctcagaattacatattcatgctggcaaccacagaactagtcctagagataatttcctttcccagaatatgacaatctgttcccatgtatagcacactgatgaccttaacaattgtgcaattttagggacctttgattgcaacggcctttacaaatggataccattgagcaggtgctttcgttgccatctcactctgaggtattaccgtctctgccatgtgtctctgccctgccggtgtgtccgtacatgtatgtccacaggtcatacatgcacgtgcgtgcccctgtctcatcacatccacatctctctctcctctttctggaccccttttcaggagggtgggggcaaaagcaaatccagtcgtttaatctctcatctcttcctccagcttttaatcatgacccccacctttttgactctctctctttttttcttgatttggttctttggattctttttctgtatcttccccacccttcatctttctctgtcttgaaatacaatcaagagtgtgggaaactggaaggagatctcgtgctgtgcccgtcccagggggatagaggcagggaagcattgggcttctgctaggcctggaagcagggatgggggccagggccacccactcctggaggtcctttgagctggccctgtgggttgctgggccccttcagctccccaggccttgctggggctcagccaatggggttcatgcagtcaaacagccagactccatcttttagtgaaaagaaaacgtttttgccagtaactactgagtaattatccagattactgcacgaaaagcaaattaaattaacgacatcacctgtgtaacatggatttggatccctgccagtttcctaaccttttaaactgagctcaagttaattaaacattttttcaatcactttgatggggatatgggggaggacggaagagaggagagggaggttggggcagtgaggaagccccttgccacacactcctttggaaatgagtatctgtccttcttgggaagaacaccagcaagggagaggggttgtccttgtgaaagcgctagatgtgtactgtgttagcacgttaagtttgtgaggttggaacatggatctgtctctggaaaagagagggtgacagctgaggccagggaatggattccactcggaaaatcccacagaggcaccaaagcctttcaatcttggagttgggatgtaggagaagcaaggctggagatgaactggccactttgggcttgcacttcattggatgcctctctcgtagagagggattgctcctggctcctgagtcggaccaggtggagaactgggttgagttgagctccataaatctcttggatttctctaatgttgctgctaagggatcacctcaactaacgcaactgcctctcttaaccaaataaaccatgtgtgtgaattctcccacccctcgcctccacttccccttgagcactgacccagccattgctggccagagccagaggccactaacagtttgaaggaaagctacttgctactaattaagctgggtttggggacccagaggaagtaaggtttctctgagaacagggacaactggtatcaccaagaactctggagactgaagatggctccagccctttgtggagtcagatgaagagggggttaaacaactaccaggcacagcagacccttgaaaggccagacactggggctgcctgtgctccctccctccctcccctggaagagaaggagtggtgcagggcttcctgcccacag

SEQ ID NO: 87249 - DNA, 4725 bp, Homo sapiens
agcacatttcccaccactacctcaacaaccctatggtactatatcaaatcagcaaaagaattgaagccttgtcctctccccagtgtcaggtatggtttagatgtcagatttcccaacctgtgatctcagtaagcttctagccaggtgattctcgtgcgtattcaatagtccagtgaagtccatctttgaaactctagttaaaacagtggaggaaatcgcatacttgtctgacacttctttctcctcccctctcccctccattttatgttttcttctggacatcctggccttccctgccctgcagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttattttttcttaaaacatttttttttgcttgttttggttctgttctcacttttaaaggatgctgagatggtaatatgactctccatattttggtaccaattctgagactgtatgaattttcaggtggaactttagcacacactgaagcaaagttgtgaagtgcagggcgggaggtgggcgtgagctttctattttgcgttgtagaagaagtgagatgtagtaagctaattaacagactttctagcagttctttttgtgatgtctctttgttaatctgagtctatctattttcggcaataaggtaaggacgacagtgttttgagtgtcctccttttctataagtgctttttttctgttgaaagaggtgatattataaggttttttgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactatagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaaaaaaaaagaaagaaaaaatagtaaattcccagaaattcagtgtttagacgagggaatttaattcctattttgtccatgttggtgatgtactgtacttcccttccttttctctgcatcccccatcacctcatagaagactctttgttgatcattgtatgttaataatgtataaaatggctatcttgtaagcgtgctgtcctggtactagtgtagcgactttttttctcctctttcttctagtacatattgataggtataacataattaaggtttaaaaaaaattagacatagttattcagatttaggaccagtaaggatagaactttctcttatttatgaaaaaaaatgctaataattttggggcagttttttcctttaattatttttttcaatttcaagtttaattttattttagctgatctgatgtggtttcaactaacccaaggtctcaccatgttaaaatgccggcggactctacggcgttttgtagatccccccccccccacccactgtgaaggggtgccatactaccttaaatgctaatgctagatatgcaaaactggatttttttaatttattttttaaaagagggaggcatggtatattaaaatgattttactaagagaaaaaatatttttttaagaatgctcagaagaaattgataatctgtgtgaatatgttttagatgtttatataccttttgaagagacccagtagcccatagcacaaatcttgtggaaatccgatatgttttaatgtggctacctaggtttaaggttcacgttagtccccccattccatctagaagtccattttgaaagatttttgtaaattcttttaacactgatgtttcagcctcgtctttgtttcagttaagctcaatggcgaacatgggaaccacctttcgccttccctgggggagaaaccctcttggctgatggcttttccccggaattatcaaacagccaccgggtgactttctggcttccagatccatctgcctgagacccccgaactcctctcctcccaagcagaggcgagtgagtggcattagctcccggacccattcccggtcctagctgggcatggggctgacggagatgaccaagccttggtctgctctctagcagcttccacagacttggctcgtggccttccttatatccactgggaacaaacagcctcgcgctctataccaaacagcctcgcgctctatcccagtcgcccattagcttgattcaaacaaagccccagcaggcctttgcgtttttatccttcataaccttcatcttaatttgaacttgtagcttggactttaaggtagcatggctctattgctgtcaatttactgtttcactgcacagcaatcacagccagtgaatgttacacacatcttgctagactagtataaaaatcattgggtaattgttggttctaatgacctgaaaggtgttcagtttttgttcttggttttgttttgtttttgatttcttgggggtgggttttgcttgttgttccttttcatttgggggtttttggggaaaaaatttatttttggttccaaatagaaaaacaaaacctattttgatctttagtgcaaacgagggctagggacttagcctcctccaccacctccacactgcttcattctgccattcactcactgcagcatattcaagaataaagcaatatcgtttactacattttttattgaaggtcagccatgctttctgtattatattgcatatgaaattgtttacaaaagaaacactaactcatacttctctttattggttgcaagtggcacgcaggaacagagggagagtggggggctggtgggggaggggagatttttttttttttttcttgaatgtgcttcgcaagccaggctatcttccaaggaaggcagacagtgggagagcagagggactgactgcaggcaagcacattgaagaaagacactggcgggtttccccaccctcaccccaaagcagaaaactagcagacgtcagctcagccccgtcctgggcacagacactacacaaggagacgctggaagttaagcaatactttaatactgtaatatgtttgttttctttttctttcttttttttctaccaaaaaaaagtaagtaaactaaaaca

SEQ ID NO: 87250 - DNA, 1155 bp, Homo sapiens
accttaatccaaacacctggctatcaaataatcagaatgtattgtctcagacaggatttcagttccgggaggcaggggcatgatgggggagggggccggaggctgagagacaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgacctcacccttacttttatactttagtatgaaactgatgagaactttggtagtgagtattttttttatatatatacatatatatgtactatctatatatatatctcaagcatctttcaggtctttgtgtgtggctttcttaaagccctgttgtaaaaaattactatgtggatggcagtctctcacatcacagatgtggaaagtataattttatatttgtattttcaaataaataagtttgtgaaaggtttccatcctctactgtggtccagaaatcaatgtgtttgtctgacaaaaaaaaaaataaaataaaataaactgttttgaacagagttgtttggtgttctttcacttgcagaggaggtctggggtctgggagagctgttgttttgcttgggcgggagaggatatcatcaaatcgcacctgccaccctcacccctcagcatgaatgctggccgtgggcctccagcagcgaagaagtccctgccttgtccccagggagcttgtggcaccatttttatgaagtggcaagagagcactaagatggaagagcagacgggagaggggtgtagattaacagcagaaggtacacagaacccatgagtggacagggaataaaccccaaaggtcctgcggatcagaggacccagatggtggaaggagctaaggggccctcccgggtgctgccctcagttatcaacagtgctgggagaaggcgccaaaccgcattccacgacccctgagtaggggtctgaataggtatcagacctctgccctcaaggagttttaagttttgcctactggaaatcattacaatca

SEQ ID NO: 87251 - DNA, 1029 bp, Homo sapiens
aaagcaatagtccaaatagacacttctgtgagagcatccctgtgtctgccgatgtcctttgccaaccctccaaaggtggatgggggccaaggagcaccccccacggaagaggggatggggcacatggccgcatcagccagcctggctgtcctgctgccctcgccacccctcccacaggtctctggttaattgccaggacacatcagtgggcactctctgaggaaggagcaggcgagccagcccatagcatcccagctcagcaatcatcgctgattaaaaactagttacaaagcaatgaagatgaaatcctgcattaaccaaatgaccccatccatggccaagcccagatagatgggagtgattatgaaagcatcactcactatgtcggcaaacgttaacggctgtttgaatttctgggagatttacggggtagtgacagcatttggctggatgggactctggctttttgcttcattcccagatgtgcctgtgtgtttatgggctcctgtggactcacagcctattcaaagtggtctagctcggctgtgcttttatgtgggtttaatctgaatatgccggcttgtgtaaagtagaaatgtattgtattgccaattttcagagaacctgaattagctcagctattctgaacataatttaatctttctttaatgattcaataggtgctttgaagtctcgcactaatcagagtcatggtcatgaatatcagaacttgatattgaagaagcataaaagtgctcatcaaagaattaggtgacggaaatggcaggaaacagcataagtggatgcttctgtgagagtgcaggtatgaccatgtgtgtcagtgggcatgtggaagcctggtgtgataggtctaactgggataacattgacctcaccacaagcaatgaatgaccctatcaaaaagtcagcctgggccgggcgcggttgctcatgcctgtaatcccagcactttgggaggccaaggcaggcagatcacctgaggtcaggagttcgagaccagcctggcca

SEQ ID NO: 87252 - DNA, 1035 bp, Homo sapiens
gaattaggttatgtttggaagggctgaaccatcagatctggattgcccagtggccagccccgggtgatgtctgcctattgattgtagagacactgggaaaaagatgtgaagactgatctaaagttaccagctctggagaggttgccagtgcctgataattggcacacatggaacgcaagtccatctgagaagagcaggctgggttcgcgctgactggggctccctggatggaaacaccccacctcaccccgacctgtgaaagagacacccaccttgctgctcattgcaaagggtggtctgtgctttgtggaacttcatgcccctcctgagcccaatgctcaattcaggaggcctcattcgcccgcttgatgctgatggttgaatgtggtctccttccatcctggattgcactctcaatttgcaaggataaagaagggagactttctgcaaagatgatgctcccattcatgataaggggcaacatgcatttcagcttcctgcagcccaggttggtgccagggtggaggtgggagctgatcatttgcaaggagacgcggagagatgtcgccacaccttcactgagaagcacatctgctgccagagtccgcttgtactgatagtggaacatggtcagctctctggctgtgatgtccccgccagcaggaggacatccaggcccctgatggatggggtggctctcttatttatcaagccatcagagtctgctacctaccagcacctcagcctcttctgttcctccttccactagttcttcgtggtcttgaacactgcttgtcccccaagatggctctcccttcttcctgagcacatggtgaaactacatttcccaacttcccttgcagttaggtgggggccatataactaagatgtcttcaaacaaatgtgagcggaaatgaggggtgccactgccaagcctgagccttctctacgttctctccctttcccagtggctggaaccacagcagctgagcctcaacctatagacaaaaccaaggcctgatggaaggaatttga

SEQ ID NO: 87253 - DNA, 1055 bp, Homo sapiens
ccctgaaggacctgtatactgtgtatgctggcattcacactctactcactggctgaatgttgagctatttttaaacagttgaactgtgtaaatgtttcttgatctctaaggtattatgtttgccttctcttagttatttctgggttgtcacaaagctcagtatcatggtttgacagaagcagttatgtgaacttttatgttaggacattactaaataaagaattccctagctgcttataaagtaaatttactttgaattgtaaataacatgaagaaacctttataaagattgttcaaatgggactcaatctgactaggcttgctttgatgtttgttagtatgtgggctggctacatctgattcccgggtacatatttcttctgatccatcagacttatacgtgtacacatgttgtggaaccttggctagctggttttgtctgcagagaatctttgtacttcttgctatagaacgattatctctccacttgagaggccaagctgacttgcgctttgtggtaagagtgaggacctgtcattgctgatacacaaagaccaaaactgtaactttaatgtcatggattgagtgtgctggagacagttaacataggcctgcacagactaggctgttcagtaaatacttgttgaatgaatgagtgaacgaatggttatatccagctaaagactggattcatatggtgtagataacaggattgccaagaaaggaggcagctaatttaggtgatgctctccaccagcatccacctgcctccctggggccaaagtgtgcctacaagtccttatcaacttccctgccttcctcgtttccccaggttttactaaatacatgaaatatccctctgagattgcagcctttgtatatgtggtcaagccagtggtttttagctgttagtagtaagctgcttcagaaattccctattttaaaactcatgtagattttctacccagtgattctttgtgtatgctctcatctctcctggtacactgtgaggcaggtccacatctcacagtctgtatatagtacacatccatgca

SEQ ID NO: 87254 - DNA, 2195 bp, Homo sapiens
gatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttctcttggtgctctgatgtggccagcggcgtgggctggaccctcctgctccctcctccctcccggcctggggcagggtttgtccccaggagccccgcgtcgcatccctagggtacccctgccttgcctggcccattcacccgcggcgctctccgactgcactctcgaggtgacacctgcggcaccgctgcacctcaaccttgcggacctgccggctgcgtctagcgctgtcgccttcctgtttggcccaggactgtaaaccgcttgctgtatcaggcaagggaaacaccatggggaaagccagtctgttgagaaagctccagacggccacctccctaaataaacagcttctggattaaaggcagactggaggttgcagggaagtgcaatttcagacttcaaagggaactcagagatcgccccagttgatacatctctccttcctcctcctcctccagctcagcaggactaccccgccctccaccacagggacagggccctcgctgccagaagaggaagctggtgccgtttccagacaggg

SEQ ID NO: 87255 - DNA, 1030 bp, Homo sapiens
tgggtgaccgggagctgctgggagtgagcccatccctaacagcagcagcctgatgaggccagacggggcagggcagtcggcagatgctttgcagtagcccatagctcctcagagttcctgggggactggccagggacctcccacccaggctgggtgcagggctcgtgtgctgggccagcagccccgggggaaggctgagatacaggaggacatggaagggaagggcacaagtgcccggagggagctgaggaagggggaccagaagggagctgaggaaagggggtcaggcagagtctgtgacaggagagatagagaacggacggaggcagagactccaccttcaggccaaagagcctctggtgggggtcatcttgcccttttccatattccaacttttatctgctttctggatttttttttttttaaagggaggttggttcctgcatttccactctttgaccataggaacgcctggctacaaaaggggctgtaattggctgctgcctataggggccccaggtccttcctccaattgcaaggcagcaactccgaagttctaagtcccatggaaagtggcagtggttgggctggactgtggctggaggatcaccgggcctcggttctcaagcaccatctgtctggctgcagctgggcccttcagctgggggccagtgttgctttccagctgcccccaccgggtcagatcatctctggcaaggaagagctgctggcatctggtaggggaaaaaagggatgggaggaatctttttcaaaggagcccaatggtctttcctggtcactggttcctggagagacagttttgggagaagttactaaagacgtaagccctctcctttttccagggactcgaggtcaaccgtagaactctgcctgggtcatccccccattcaaattcctagaaccattccagcttgcccagctgcagggactctggcagcaggagatggagtgaaggaatggaatcccggggtgaagcagctgtaggggagggcttcaacgtgggagggta

SEQ ID NO: 87256 - DNA, 1047 bp, Homo sapiens
accatgctgtctgggtcatgtttcctgtgctgaaatgtcctctgggctgtgcccagtctcctgagcctggggcacacatggctgaatttcttatgctccttggctcatagccctgtgagccttacttggcattttttgcctcttaggaagtgggttcctattctggcctctccacatactggctgtgtgactttgggcaatttacccaacctctctgaaatggttcccacagctatgaaatggagacagcaacacctgtctcatggagttgtaataaagattaaatgtgaaagcatgtggcacaggctcgtaaacctgtcgcctacttgctttaatcctttcgtgtattttaaactgcttttcatttgagcagtgctagttgcaaaaggcagcctggcatggacggctctgaccctgctcccaggcacaccacagccatggcctcagactctgccctgagcttagccagggggagagagggacagtgctctgagaattgggggcctctatagtccacctggttctaactataggcagcctgggagtctctgagaccttatagagtcctgtggaaatggtacttctggtaatcaaaatgcttcccattactgcttccttgtgtttcccattactgtttctgagccactctcctcatccacagaaccaccctttgatagaaaagtctagactttgcctttactcgctgtgtgtccttgggcaactccctcctagacttgggtctcaggctcttcacctgtaatgtgaggcagggtgtggggctgggctggagttgtcagtcctttacattttgtggtccccacaaggatgctttcaaagctttgcacttgggccaaatggaagcggctgcttgagctgctgtgtctccagttgcccaggccagcccagcctcccctggggccatgaggatcaatatttccttacagagggctgaaagaattccagggattgacatccaggtgctggggaagacccccctagaatctccctaccccatcccccctgtgagggcagcttggccaatttacc

SEQ ID NO: 87257 - DNA, 1032 bp, Homo sapiens
acacacgactcagtgtatctatctataaaatggtgatgatgatggtggaaggtaataacctgcactactacattgtcacgaggattaaatgatgtgatgcacgagaagtactttgcctagcacttggtaaatggcagcttctctgatgatgcataattgctgggggtggatgagggcaggtttctgtttaatgcctttacataatggacttctgctgagggtttcatttgaagaaaggggttctggttctgtagctaaagaaagtgtacagacccttccatccctgggggactaggatgcagcaggctgtttctgcagagggctcatcctggtttgtgcctagaacagtggtgcctttctctggtcctgaccggctcccccagcccccacctatatccctggaagatttcaatgatcagaccaaacagggactgtttctctccattttctagaagtagagattgaggccctcgggaggcgaaaggaagctggttatgggacccctaaaagctcttgcccccttcccctgattgttagatttggggctgaggctaccagccccagctggcctgaggtccttccctgcactgccttctaggagctgggcctgcagggaaccaggaagctggtgtcttggccagggtgtgccacttcctggttctggccagttttgctgcaagtcaggtcagcctgaccttaccaatgctgtaaaacccattctgggtgcagatgggggaagagagggatcccagggcctcatctggccctgctatcagcctaatgaagggggtggcttggagggtgggctgtgggagggctgagggtgctgtcagtgcgcactagcgagtgtgtatagaagagtgactgtaattttaaaaacatagcttcagagttgggcgaagaggggagtagtacattgagtgcctgggctgtgtgggacggttcaaaaaaaatcctaaagtgttgtctgtgtcctatggctgcgagggcctgggaggagcatgtggcactgtgcaagtgaatggggttgag

SEQ ID NO: 87258 - DNA, 1045 bp, Homo sapiens
ctgagagaatgcaggtgacgtgcactgaggcaggggcagaggctgaactctgaagactactcctcctgacccaccccaaggcttttttgccttgtgatgcctccactaggaatgccagctggcttttttggtggggtacatggactgctctgtgtagtcactctcctgttctggacctcagtttaccccctcaacaaggtggcatcgttagagtgtgagcccctgctgtctcactgagaggagctgagaagaaacatggggcgtgcattcaaggtgttaccagggagctggtgggagaagcagtctcagtctcaaagatccacaagctctgtaatgtccacagagcaaaatcctaggtaggatatccaggctgctactcaacagtcttcccaccagagtacatgtgcaaaaccctcagggaacctggggacttcccagaagtattcagacatggatggcttccagggaatcaacttctgaaagctccacttcctgtgcttcttcctaaaactgatcagccgggaaccctctgggtctgccagttctcccctcaccaaggccctcctaaacacttcccaaaagaaaggcctacccccagtcatcccaacctcaccctggtatcccgccctgggttataaaagccaccaaagagacaacggaagaatgcagccctcatgggaggagttccagcaggacaaagaacttccttaagatgttgagaagggggccttatctatcttacctacccatctgtttattttaggattagaattaggaagctgacacagggacacctgtttaacctgtttaataaatatttgaattaaaaagaggagtcagagtttttccgacacaaagtatgatttggctggctggtctaaccacaagatccagcctggccaattaggaattatggtggatgttttccacaactgcctgggctgggtttgctgttctaaggctttgacaaaaataaatttgaagcaagtagatggcatacaataggcctggaaatacattccacttaaagttatgataaaacatt

SEQ ID NO: 87259 - DNA, 1050 bp, Homo sapiens
aaaaaaaaaaaaaaaggctgggcacggtggctcgtgcctgtaatcccagcattttggaggctgaggcaggcagatcacctgaggtcagaagttcgagaccagcctgaccaacatggaaaaaccccatctctaccaaaaatataaaattagccgggcgtggtggcacatgcctgtaatcccagctactcaggaggctgaggcaggagaatcgctcgaacccgggaggcagaggttgcgctgagctgagatagcgccactgcactccagcctgtgcaacaagagcaaaactctgtcttaaaaataaataaataaataaataataaataaataaaatttaaaaataaaataaaaagctgttgtccatgtttagctggttcagggttgctgagctggctgggtaatgtctgtaagaacactgagaactatcaggtattgcatatgtgtgctctggtatggtgctgccagctctctcattaggaatcatggagattgtactgccctaaaggggcatgggaaggattataacgctgtgagggagaatttaaaagtcttggtggaggcaggcgagctgtttgttggaaggccatggagcagggatgggagggagtagtcagggccggggccagcacagggcattgctggggttaagctaggtttatagggcgttaggccatgacatcataaaccagagagtaaacgtgtatttatcacctgcgtaaatacagatgcttctacacttgaaactgtgtaatggagaaaggatgttaggccggatatggcactttggtccctagaccaaagtccttgtccctagactgtctcaactggctgtgtgcctgtgactctgggcttgaggatcctgtgtgtgcagcctgtgtccatatagcatgggagttaaggcctgaagactgggattaggcagctggctttgagtcttgttcttcactctctgtgtgacttaggcagattataacaaattttttattacaattattttattttattttttggcttctcatgcttatttcctacctaggcagaattttagat

SEQ ID NO: 87260 - DNA, 1039 bp, Homo sapiens
acagtagtatcatcactttatgcaggaggagaccgaggcacagagaggttaagttaacttgcgtaaggtcacactgctagttagctgaggaggcaggatctgagctccaaagccaggaggctgagtccatagatgtatttacaatattgtagcgttaggattcttattctttgactgttactgttcttgtttgacagtcccagggagggataaactgagcctagaggtagattaagtgtacagatcacagtcttggaaacaatgagggatggaatatatgagagttttttttggagttctggggaaacagctgtttctaagtgtggggcagagctgaggagatctggcagagatagagaaggattttttttggggtggatttttactatctgctttgagggttgcatgtatgtggatttaagagccacgtgactctttcccctcctatcccattttatttgggaacttatctttaaattccaactcacctctccccctggcagccttagaaacttagaaaactgccatggatggtgaattcttgagacatgaaaggaaaggtgaagggtggggttcttagtggaatttcttccttgtggtagcatttctattaaatgcatatggggaatgagccacagcgtggcttatgtttggtggagagagggatgggaactcgggtgacttccctttttctcatgagctgatttaataagagaatgaatcatcctatgagctttaattctggaaaagaaagaaaggagaggcaaatgagtgagatggcatttgactgaagccagaagccttccatgtcagtctcctagggcgggcactaggctggcacccagggccttggcggttcgtgctagtggtgagttccctccaggggctttgggaagggctcccagcttccggtcactgccactgtcaccatcagccctctcatcctggtaaggctctggaacctaaggccttgaagggaaaagaatagggaggcatgtcgttaaaaatagactactggtaaaattcacatatagcagtg

SEQ ID NO: 87261 - DNA, 1099 bp, Homo sapiens
ttttttttattttttatttttgaggtggagtcttgctctgtcacccacagcctccacccgcccgggttcaagtaattctcctgtctcagcctcctgagtagctgggattacaggcgccctccattaccccatgcccagctaatttttgtatttttagtagagacagtgtttcaccatgttggccaggctggtcttgaactcctgacctcaactgatccgcccacctcagcctcccaaagtgctgggattataggtatgagccaccacgcccggccaaaatattacataatgattgttaattactaccaaatacttattaagcccctagcacaatgttttgcatattgtaagtcctcattaaatgttagctgctgctgttattgttattattttcattttgtgaaatcacacagctacttagtggtaaagccagggctacaatgttaaattctttttattccaattcttttcagcatggccataaggagatttcaccacattctggaaatatgggaaaacctttacaaaaatgtttatgcggatgtctttgcatgaatgttcataatacagctagaagaaatgggcttaacctatttattagatatagttagactttgggcatgggggcatatgtctaccaaagaatttgtttccacaaatattatttactagtgtttaaaggtttcctgaatgctagattggttgcctctgctggaagattggggtgtttttagatgttttcattgaagagttcttctcaagttggaaacatccatttcaatgagttgtggtggcaaagcaggcttttgtgcgtaatggaaatatttctgtagcctggctgctatttatcaagggtgaagacagtgcagatgttttgaaaaaaatatataggcttggcagaagtccatgtgtcttaggccatgcctacacaaatccattcccaaatgatccgtactgacctttagcaaatcgatgacagcctcggagcctcccaagggagccgtttttgtctgaaacattgttgaggccagtgtgacccctggccttgcatggtccttgacacctctgatggggcgacaccctctccctaaggcagctt

SEQ ID NO: 87262 - DNA, 1020 bp, Homo sapiens
ctgagttattttgtgcacattttcatcatagcttagttgtttagagtgtaagatctgaagttaggcatctccaggtagaatcccagctctccatcttactctaagactttgtaagtgccagagtttcctatatttagaaagagttaaaagagatctcatgtgtatgccagacaaagaggaagtgttcattacatcgaagctattattattattgccatttctgcacagcggtacacaaattctgaggctcattattaaggaaaatctttggtaaaaactgtagaggctgagggtggattttggaagagtgggagggggtggggtgaggctcttgaatgatgagcagagaggaccgcacagtggaggcgggggtggggagactgaaatgtcatgggtgacagctaagcatatttgggggcagaatgactcagcatctgtagccctgctgtggaaccaactctttttccttttctttggagaatttgccctgtaagctgggggaggggtgaggaggcataaccagtgagaagggttgaatggcataaagttaatactaacattggtccagaggaacagggcagagttccctggaggaagggaacctagtcaggagatcggggcaggcccaataggcagtcaagagtgcaagctcacagggtgcagtggctcacgcctgtaatcccagcactttgggaggccgaggcgggcggatcacctgaggtcaggagttcgagaccagcctggccaacgtggtgaaaccctgtctctactaaaaatacaaaaattagccgggcatggtggtgggcgcctgtaatctcagctacccaggaggctgaggcaggagaatagcttgaacccaggaggcggaggtttcagtgagcagagatcacagcgttacactccagcctgggcgacagagcgagactctgtctcaaaaaaaaaaaaataaataaataaaaaaataaaaaagaggctggacacggtggctcatatctgtaatcctagcactttagcaggctg

SEQ ID NO: 87263 - DNA, 1324 bp, Homo sapiens
agtcagcgtcttgtagcgagaggaatgagccttccctgggtgatcccgcagcacctgagccacctggcccaggagaaaggactcagggagatgtactgggcctttcaccccttttctttatagccagctgtgcctgaaggaggtgagggaccccaggaattctctcacggaggaagtcatctcaccatgtggttgggcccctgctggatcaagtgtgaagctgggtcctctctgttgttgggggtcagtgccactggtacctcagtttgaatatggtgccatctctgggatggagaggtgctgctgggagaaacctggctcgggtctccaggaagctggagcgtgtgcagcagggctgggtgtgaaacccgctgtccactttctgcagctggaagggccaggacaagggaaacaggatactgctaccgacctgggcacatccttgaatagaagagagaccctggacagcgaggatggcccagggatgttgatatgactagggctgtatccccagctcctgggccaggccaactagggccagaggttggagtcatgggcccctttgagaatctggtgaaagctctaactcctctccttccaaaatgcatgtgtgtagggagacacctgtattcaacaccagacggttaatatacccccttggaaccaggacctccattgagacctctgccctagagttactggtctgacctgggccatcagaacagttgtcacctttttggctggtcagtgaataatcccagggttcaaagagcagactgcttctaaggtcttttctcatgacctccctatgcaactttgggcttgtggccatggagacctggagtgtctggacagatcccagctccctacagctagctagaggatgggggcagatgaggtggcccttttccaggggctcattttgctgtctgtgtggtgggaaggccctgggcactggactaggcccactggtctattgaattagaggtaaataaagggatttgggtggaggtggatattctggtgtttcagctgggtgtgagatccaggcctttaagagctccagcttgttcttggggaaatggggttgaggtgctttagtagagagtgttaagtgtgaaagacgactcttaaggaggtcttggggcagaattgtccaaggctatgatctgggtgttgtcggttccttagatccctttggactcttgaaggcaagtgggggccagagggctgctgtcactatccccagtgcagccccaggccagaggaggcctggcctgcctttcctttcttggctcactgggtcctgggctgctgcataggt

SEQ ID NO: 87264 - DNA, 3167 bp, Homo sapiens
tgcagtaagctttgatcatgctactgcactccagcctgagcaacagaaggagaccctgtctcagaaaaaaaagtgtccaggttttgttggataagaaggaccagggtcctctaactcactgcagggtctccttgcctagctagttctctttggtatgcttggtggtatgtgtaatatgtagagttaaagatactaggcataaaataggtgattgtgtcaacatcagaaacaagaagaaatgggagtgaggagaacatgaacttattgaggagtatttttttctttcctaatgtagttaagaaacataaccagaaagaataagattatttaactgaaacatatttctaaaactgaaacaaacatgatactaaaatagcttgtttatcattccccaattatgcatttttaaaaccttcacagaatgtggcttcatgtctcaggctttaacatacttattgagtatgcacacctctctctgctagttacagtgtgccttacgagaagatttttctgattatctgttattgtgtaaccattggcccagctctgtgtaaacaagctctttagcctggcctgctggaggttggctcttcccaagaaagtttttagaactcagaggaactgcatgaagtagtagtgagaacacttagccctgcattgcagaagttaactgatcctctcagcatcactgtgaggtaggtaagtaaatctgaacttgaaacctaaagtgcaaggctaaacaagttgcttaagtccttgcaggaggtatagcatcagaaggtgattcatacactgggatccctggcccccaggcttgtgctcagaaagatcctctgttctgttgaccgcttgatagaaaactggaatttgatttattaaatgtttgacatttttaatgaaaagaaattgattcagaaactttgtgaattttgctcactgttttgagaatctaaagaccctttttcttcttattttagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaatcagagcctgttgatattacaacagggacagatgtgttagttgctcactagagtttatgtcttatattaaattgtatacagtttttattctaaccactaactaggtagtgtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagc

SEQ ID NO: 87265 - DNA, 1059 bp, Homo sapiens
agtgttgaaaatatggctagagaagtgttttcatttagtatgccaagtgatcaaagtagagaagccacagttttaggaaatctagcttaatggaaacatggaaatagtgcatgctgggaaatatctggtaaagtatagttattggcaataaagtgtccagataagttattactaggaattaaaagttctcagtacttcctatcatgttctttcttttgatgtactttttgctacaaacctggatccaaatttggtcctttgctatgctcagagttgcatttttatattcaatttgatgtcaacctccatgcattatgggctttttttttcctttctaaaatattcccacttttagaggtggatatccttgtgtgtacataagttcattttcttacaactgtgctatttttgctctgtagtgttctttttcattgtattatttattacatgtttcagattctgtagtgttgatgtcttttctcttggtcacacccttaatctccttcagtctatcactggctggccttaacatatctagtcttctgctgctgaggactttactgtaattgtttaaaaaattttaaatggtttgcttttctctcgtgtatattttctaacgaatcagttggagtatcagttttcaacgtacttttcaacttactagtacagctttggcttctggactattgtgcagccatttcaaatgaatcattttgtcaatgtatcatgagccaaaggacagatttgtaaattccttcttcctcctccacctctacaatgtcttactatgttaaatgttaaggaatcctctatctgtgggctcctctgtatgtaattccttttctgtgtagtttcttccatcttttgctttcatgtagtgtggctcttcccttcctcagagtgatcccttctgttttttttttttcttttttagacagagtctctcgctctgttgctcaggcttgagtgcagtggcgtgatctcggctcactgcagcctccgcctcctgggttcaagtgattcttgtgcctcagcctcccgggtagccaggacgacagg

SEQ ID NO: 87266 - DNA, 1668 bp, Homo sapiens
aactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggtactgcattttgctttgctttgctttgcttcattatggtatcagtgtacttcagttttgtctccatgtgatctagaatgtttatgtgagaacagatgtgggcagacctgtgttattagaggagattggtgatagataagtattaacacctccaggtctaacctcagtttggtgtgattgacaagtggtgacatagtgattaacctgtttttttcacttaacaagtgcctcggtggactcaggctttcatttggcacatggatacttatcactgcaaaaccaccagttttcagttcagttgggggactagacatgaggctcactgggcaaattaaagtaacatttcttggaagttgggatgaccttggatactcttaattaaacttttagaatgttttttcatttttctgagagcaccaacatttcactaattttcatttataaaagcttttagagttaatatagtggtagctgtttctggcaagtgttaagactaaaacttcgggtattttgtaattgtaaagaatcaagacctaatatgatttgatgttgactaggagagaaaattaacaggtagaggcctaagactttgttcatggtaagagagggaaggagacttgcaccgggggagggaggttggtaattctgctagctttccctaaaatgcaccccttcccaatctgccaagcatgtgagcatcacataagtagcatttctctatgtgttcgattatatcttctgttgaaactctctttttcacaggcctgaccacttaagctgtcatgtaaaacatgtccattcaacagaaagacccttcaaatgccaagtaagagttaaaatgacttatccttagtgtagcacttaatgcacattatccagaaggtctgagccagttgaatctcaccattcttgaatagtcttaaaatcactgacctgagtaaatgtggcccatttgacttctagttttataaaatataactgacagcttctgtttctgtaaagcaagatcatttaaaaatttaagcgtgttgttttttttaagctatatttccctttctttgggcaatagtattttttgttagg

SEQ ID NO: 87267 - DNA, 1118 bp, Homo sapiens
atactttccccagaaaaaagctcaaatggttattttaaaatatgggattgatgtgccactgaagtgattttcgtgtgattaaaaaccatattaagcatggtgtctatagagattgaaaaaaaaaagtgttcttcatgtaaaggaaaaacccataacacatctttggaaagctggttgaaaaatcttttgaaatacttttttaaagattatttttctcctgggtaaaacaaatgccaagcgtttattgatcaactttttaattagattttatattatttaatttttttcagctattaaaatctttttttccacctgatggagaagtgtgaaaacaaatatttaatcctgggcttggcaatgtgtgcagtgaaatttgttggaaaacttaaaatttagagccgagagcagttgaatgggtaaagagaatatttcagtcttttctatggaaaggtatgaatagacttaatcagttctggttttaagtaattttcactggggatatggagttaaattatcttgtttgtttcctggagcatcctgttgaatttatattttgaaacaatttaatacctgcttgctttccagataacttggtggaaagtgaaagctatagctattaaaatgtttgatggatgattcttctaacaggacattcaagatgtgactcaccgatgttaatttgttcagtacaaaatcttttaccctctggcactggagatttcatggtgccatatcctactaccctgggtgatgaaataacatttctgttttgtttcttgccagccccaggaaaaggaaagcttgggcagggttaaaaagccttgcagttgaaagagatgggatataaaattaaaactttggtttgatgatgctagtcaaataaaagcctacccagaagttatatttttaaaataaatcacttaactgaaggctggccgtggttgttattttactctgtctctcccccagagaagaagttgggaaaacccagttcccccttagaaggcttcttgtagaagtgtggggatcctaggaatcctcagagagtgattcctgtagtggttctgcagcatttcacccaagaagcagggacctggtgtgaccctcctgtgagagtg

SEQ ID NO: 87268 - DNA, 1557 bp, Homo sapiens
attgtcattagaataatggtcttcattaagtactagttttcataatcctgaagcttcattttcaccaatttgaaaggcagctagggaggagaagactatgcagggaaggaggaaaactctggagtgcatcacagagaccttgagtgagttaaggcagggaagaagcagatttgctatccactgaatgaaaataagaagaattccattgtccaaggtcagagcaagaacacaaaggttttagtttacttagttaattccttaggtttggacattacaggagacatgggggtgaccatagcaatttagctgataaatgtatcagaaactctttcatcattttctgtcccctcctatcttaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctggtgactgaggggaggaaagaatgggagggggtattcttgtctagtggatggaaaggaaacacactgtcaaattactatatctccttggttttctattacagtagaattctccagccatatttttattgtctatgggggaagttggagatggtgaccttgattagaagtgtctggagggggataaatggaggggataagattcagttggttttggaaaatgttaaagtcttaaaataatgcgtccatctgaagaattttttctaaaaccagagtttataaaaatatcactgatacagcctgccccctcatttccctgccacaggagatgtcttggactagagacacttgtttaataatagcttgtctctgatattcccagtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttgtctatactatctcacttgtttttatttttggcgggagaggaggggtgttgggatagaatttcacatcctatcttggagtgaaggggaggatggggaggctcagcccttcacccaagaataacccagtaatgacatctctacgcgtgggaagtgtttccctccacactgagaggatctgaggctgcaccccagtgggattccctgcttgagttggaaggccatctcgccatgagatgcatatcatagcgagagcgcagagggcttagccggccggggaggaaatgccaaaaggaagagaggctcgaagtcgaaagggcttcccccagtttggaggtggggaccatgctgtgcatgagcgactgaagagccgagtgtccgccgtggcctgtgccctccgctgagggtctaacagggacgcgacggtgctggacaccgtgtctgagtcacg

SEQ ID NO: 87269 - DNA, 1056 bp, Homo sapiens
cggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggttaggtgacaggttatacaacttggagtgtgggaggaggagagaggaacctgaacagggcaagttggggatctgacttttgtttgggtagatgtaggcacattgtatttttggcttagatgctttattcatcatggctgaaggtaataccatttactcactcaccgaaaattgtttacaataatctagatgaatttgctgtctttggacatctgtcttttgactggaccccagtatatagtctgtggaagctcacttaaggagagagctcctttttgtttggttagagaaattttctgtcctaaaagtagaaatagccccttctaggtaaggatggagcatttgatcatactggtttcattatattcctctaacagttggaaccgattgtttttgagtacttgtttcaaacttctgagtattttccttctggaaaatagctcagtgtttaaaatttacatgaacttaaaaggttaatttttttttaaagaatgtttgaggagcaatcaattctgattttgtcttatggatagaaatagaattagccattttcctcaagaaaagtgattcttct

SEQ ID NO: 87270 - DNA, 1063 bp, Homo sapiens
tcagttgaagatcaaattgactctgaagaaaaactggagatgtttctcttggagtttggatagagtattcacttgataacatgtttttcccctgccttgctcttcacaagaacatctggccaggcattaacaattagtaaatttttttgcatatgaacagtatttttctggtcatgtagatgggtgcacatgacactaaacagcattgtttagtgttatccctcttaactggtgggttgtatttggggtggaggctgtagccgaggagaagacattcacctctgtactcgagaaactttgtgtaggaatttagtttatttttttattttttttaattttttattttttactacttttactgttagcacaatgctataattgagctaatctttgtagtttggtgcaggaccaccaagtttgtgtgacccattacctactttttccatgctcagccattaccctgtcctggggcatctgagggcagtaaggaacaggtgtccaaaggaggaatgttggtgcctatgagtatgttttccagttgtattgaatttcttacttggtgtatttttgacttgtcttagtttctttccttgtggtctatgctattttacttgcgatttgttggatattctccctgtcattaaagagttgtaaaatggaagttagtttctctatgcaaatgctttaatggatgaagctgataggtttagcattgatttttgctggtgtccttcaacaagcatgaaggtgataaatgtgtttccatggctttagactcatttttgaagtcttggattgtgtgaacattcttagaaacaataaaatgttttaattaaaagccctcgactaccagctgaattcagtgtctactaggaaaatgggtagatttgttacattgtccctttgctctctatgactttgttccagttgtcaaggaacttaaatgggtattcaggaaaaagaattcttgtttccctttcctcaccttgccagttaaataactcctggtgacacttcaggtggtagaattgaaacacaaacctgacttctgaccacatgggtc

SEQ ID NO: 87271 - DNA, 1021 bp, Homo sapiens
agtgctatatgtgcaggtggacatgttgcccttaagctgttctctagtttaatgtgtatgctttgttttcttcagctacatagtaaactgagagcaaaggctgttttttttttttttttttttaagacagtgtcttgcactgtcacctgggctggagtgcagtggcgcagtctcggctcactgcaacctccacctcctgggttcaagcgattctcctgcctcagcctcccaagtagcagggattacaggcacctgccaccacacctagctaattttttgtatttttagtagagacagggtttcactatgttggccaggctggtctcaaactcctgacctcgtgatctgcccgcttcggcctcccaaagtgctgggattacaggcataagccaccgcgcccggctccccaaagtcttatgttttaaactttttgacatttcttctaagatgtccagaatgctagtacctgcaccttaataaatgtttgtgaataaatacattattgaaatcttaggcaggtgtgccacatagcttaaatctgagacactgtgttctttagtcagatcatgcatattcttagaatagtaacctcaaaggtttatacccttgctaccttttttatattttttgtagagacagggtcttgctctgtttctcagactttttgaactcctgggcttaagcaggcctcccaccttggcttcctaaagtgctgggattacagatatgagccactgcgcccagtcctgatactgtggctcattttaattctcacgtagtatttagtttcattttgcagtttgaagaaataggcccagagatgttaaaggggcaggcccagaacttgaatccagatcttgtggtgagaaattcttgttttactatcacgttgctttttaaagccagcctgctttttccagttgggaggcctcggggagaaaagtctgacccaagtgagaaacacctgtaatatctaccagatgccagcagggtgtcccatggtgctgtctttgatccatgt

SEQ ID NO: 87272 - DNA, 7290 bp, Homo sapiens
agctcctttaacgaaagttcgttatttaacttttaccaaacggctggtcactctgttcgcaaaccaccccaagctgggaacgcgggggacttttttacccccttcgtggggagggtgacgtcgcgcgtgcgtgcgcgtgcgctgaacgtagccctcgcagcacccgttgcgctcccgcgcgtgcgtgttgggatcgaatcgctgtttccttccgcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcggtgaggcggcatggggcttgcagccttgaggaaataggtccgagtagttggggaaggctccaaggccttaacatagagaacggggaagcgggggctcttagagaggttggggcgagactgtatcgcccatgcaggagtcgagtaaggagctgagttgatgtggcttctctggcgcctcgccttggacgtccccggagcccattcgcaggctggagcgggaaactgaggcgctgagggctggtgtagtggttgggagcctggcgtgtttctgggtgggggaggggccattcctattatgcggcgcatgtgggctcttccacgttgggtgcgcatgtgcggggggtttgctggttcccaactgagcgagcttctcctcctggtgtttctcatcccttttactttctgcgatcccgcagagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggtgagtgtactggttgtgtggattgatgtgaagggacgaaaactacctaaaatttttctcttgcgtgacaggtttaataattgcaaatttttcatgctaggtcttaaattgctttagtttttgggtgaatttaataaacgaggattgctgctgtggtgatttaccaaattaggttgcggtactagatacgaagatcgttacaaataattttggactctggattccagaatcttaccagctctctttacctggtatcacttaagtacacctattaagtactttaaagtactctttgtcctaatgtaccttaccagcttaacgtgaaatttaagataattggtactaagaaaaaaaaaatcactttttcaggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagc

SEQ ID NO: 87273 - DNA, 1061 bp, Homo sapiens
gtgaaaagtatatgaaaatcaaatttcagtgtccatatttaagttttattggaacacagccatgaccacttgtttacatattgtctatggctggtttcattcaacaaaggcagagttgagtagttgcaacaaagacttcatggctctgccaggcgcggtggctcacgcctgtaatcccagcactttgggaatctgaggcgggtggatcatgaggtcaggagattgagaccatcctggctaacatggtgaaactctgtctctactaaaaatacaaaaaattagctgggtgtggtggcacgtgcctatagtttcagctactcgggagtttgaggcaggagaaccgcttgcaccttggaggcagaggttgcagtgagccgagatctcgccactgcactccagcctgggtgaaagagcaagactccatctcaggaaaaaaaaaaaaaaaaaaagacttcatggctcacaagcccaaaatatttactatctggccctttacagaaaaagtttgtcaaccccttaccaaaaggaaaataataacctgcttctgtcatttgtgcttaacctaattcaaatattcagctttgtcatgcgtgtccttttcctcttgcagatgtttctgtcatgggtaatatattattagttgtcaacataaataatgaaccttttcaagcgataggttgctaacacgtgtttcatcagccactactacagttcagtgataaggtactgagagctggtggaaagaaattctcctgcccatctgcccagcctagaagaggaggtattgctctactgcagttgatttctttttctttctttctttctctttctttctttcttttttaagtctagttgatcaaaattgctcaatgatggcaggtttctgtaaccattcttgcgttgaagtaatgtggcacacaatgagtccatgacaggttttgttctaagtaaatattagtgtccactcactatggaatttgcaagtgaaatttccaaaatgttcatattgtttttctacaatactgggatcattcactctcaggctggtgctggtaccacca

SEQ ID NO: 87274 - DNA, 1040 bp, Homo sapiens
taatagccaacccagtagtaactcccaccccctcaattaaaacctggactgtccctttgtgtctcactggctgtcaggctctgtcctgctactgctccctgtggcaatcatctactctctccccatcactcccccatttgtgaaagacatgagcacctggctcactatcagtctgttcatcaccatactcagcatcattcctggtccgtgtctattagatgacccctccaacattctgcctccagttaattaatcttctcaccaccagtgacctgtccctccctgcctgcctcagctgcccactcccatcatctaatgctagatcttatcaccagcagtaactgtgccatgtccaagatctccatttcaagcagctttctctgaccactacctcatatctgttcaacttgcttcccttgtacacccactcctacactcttcccctcagagaacttccttccacacactggttccccagtcctttcactcacgcattcctccatgctgtcacctccctcacttctcagcttataatccatggtccagcatgataaatatacttacataaaccctggggccttgtagtgacattaaaatatgtctgcaagttctttgatgcttgtactcatcagcttggctgccataacgaaatgctatagagtgggtggcttgagcatggattttttttttctcacagctctggagactagtagtctaagaccaagattctgtccaatttggtttctggtgaagactcttcctgaattgtagatggctactttcttgctgtgtcctcacgtggccgttccttggtgtgtgagcacagagagagagacagcaagctatttggtgtctcttcttaaaaggagatgaattctattggatcagagctttatgatcttatttaacattatgatcttatttaacattaatttgtttcttagaggccccatctccaaatagagccatactatgggttagggctccaacacgggaatttgtggcgggggcagacataaacattcagtccataacaacac

SEQ ID NO: 87275 - DNA, 1011 bp, Homo sapiens
gcagggagaaacctagagaggccattcctcctgggagagctgcatgctgactcccctgggtcctgtcagggtggatgactgaccacgaccctgtgctgcgggcaggctatggtccaggagggacactgggtccttgaagatacaggttctctgttcttcccagctgggctccaggagtcacatcaggagccagagaagggcatcagttgctttatggagccaataggtggggcctaagaggctgggggagggagttgggaataggaaaaggttgtctgcctgcgggacgtttccatttggcagagaaagtgtggtcccttaggggctctcaatccaatccgacaggagagacaagagctctgcacacatggagtccaagaaagatggaggaaagaagacacaggccagagattctaggagctcacagactggacagggaaagacctgtttttcccgatcctggccacagacccagaggtcccaaccatcttgggaactgccctggactctggcaagagttagggtgagacccagaccccccaagttctctcctacacatctacaaggcccccagagtgttcttctacaatgctttctatcagagccacctgctcctgggggcttgcagctttggccaggaccagtgagtggctctgctgggaggctgctctaattaggcccagggtcactccccagccccatctgtcctcagcaacatgagtcccaccttttcctcctcaccaggagccttgggagcttgggagacattccaaggctggctctgacatgaatttgctgcacagtgcgccaggcgatcagagctgactcctctcccttttcccttggaggtgttgatagtaacagcagcgatgagctgccaagttggcaggagaacagagcgactgtgcactgcggatggaggggggcgggaagcagcaagccggcagagggctgggccagaacgacagtttgtttatcctgaaattgaaagggtccctccagtctcagcca

SEQ ID NO: 87276 - DNA, 1502 bp, Homo sapiens
tctcctgcctcagcctcccaagtagctgggactataggcgtccgccaccgcacccagctaatttttgtatttttagtagagatggggttttaccacgttggccaggaaggtcttgatctcctaatctcgtgatctgcccgcctcagcctcccaaagtgctgggattacaggcgtgagccactgtgcccggccgcatagactctttttagggtaggaaatccattgtataaacatgttctcagttttggaaggttcattaatacagccatgcaaattggtaaccagctttacaagctcactaaactgtgctactggccaccctaaggtgccagacaaagaatcctgtgccactttctgcgtggccagagctacctcctgtcagctgcgagatagccaaaccacagccaggagcccagattactgactgctccctaggcccgaattcttccctgggacgatgaaacatcaggcatttgtgtgggggaaaggaactgcagtgtggacatctcagaacaacactgttttgtttatgtaagctgtgaggcattgtgggtgtgctggctacagagtcacccccctgtttccatcacatacgagaactgatgacaggagatcaggtagcgttgggaagctggggctaaaactctgctatggactcagaagaaaatggaatattctaaatattatagaatagacacagcaaggatacagtatcttctagttagaaacttttaattaaaagaatgttcactccatagggatcagctagaacatgatggtcaataattataaacagctgagcatggtggtgtgcacctgtaatctcaactactagggaggctgaggcaggaggatcacatgaggccaggaggtcaaagctgcagtatgccacgattgtgcctgtgaatagccactgtatgccggcctgggcaacataacaagaccccatctctaaattttttttttaattatgaacaaaaaggacagtcacaacccaacaattcctttacgatgctcactacacaagcagcacttaagactccttaggcatgggagtactctctgcctgggccagggaggtggaaaggaaactgaggcaccaaagtagaagagaggtcctgagatgtttcaaggcacacatagaaggtagttgcccgtcaccacacagggctgatcaccatcttggtctctgggatctaaaatattcaacttgggtagtagttcattcttgtaaacccagcactctgggaggccaaggtgggagaatcgcttgagcccatgagttcaaaactggcctgggcaacatagcaagatctcatctctactaaaaataaaaaataaataaagttagccaggcatcatggcggcacatacgtgtaatcccagccactcagctgaagcaggaagatcccttgagcccaggagtttgaggctacagtgagctgtgatcgtgctatggaccccaatttgggcaacagagtgagaccctgtctcaaaaaaaa

SEQ ID NO: 87277 - DNA, 1060 bp, Homo sapiens
ggagactctctcgaggagtggagaacaactgtctgcttcccgctgctggttcaatttggtgccaagcagcagtcagaagaaaggcatgaaaccaggcaaggtgaggagcaaaaagccggagctgaaagcagagggcagagttgaccatgaatgagaaaattaaggtcaaggcaagagctacagggtgtggacacctgcctacctgcctgcctgtgagagaaccccatgggactgggtgtcaggaagagggcatgctccctagcacttgacctcctgggatagggcacagcgcagaggcagggggatgcccggatgacctgtgagagagttctttccctctggaggccttgggaggaagccagaatgggcatgcagaagtgggtcaaggttcaattttcctgaagaagccctgagctggagacaggatgcattgactttttatttatttatgaggctatcgattataatgcagcttttccacaggatcctgaggcagctcgagttgggagaagaaacctcctaccagttcactttctctgtcctggagatgtcaggtgttcagataggctgcctccctccctccctggtggttctctctcctctccctacccctctgcagccctcacctctgcacaccctgaaggatggaggctccagagagttcctctagtctctcgggtctggctgttccgggttctttccaatatttagggcatattccaataccccaaatcctgagagcacaggctatgtgctccacatgagtggatgaaagatttctcagttataaaaggcctctgagatcttcctagcaaaacacctttttactgagaaggaacagaggccaaggagaagtgatttcttccaagtcacacaaggtgagaggcacaacctggacaagaatgaggcctctcgattcccccaggcgacaatcctttccactctagcacgctgcctcccaacaggatcccttttacttgaagtgaacccccagacagatccttaatgcccactcttccccctcagtccagggttggggtgcccctgagctgggaatcac

SEQ ID NO: 87278 - DNA, 1011 bp, Homo sapiens
ttattcctattgttctataatgtcctaccttcttgctccacacaagtcgaaaactcatgttataagctaccttccctgagtatagcagctgatgtttgttgagcatctactatatgccaggcactgcaccttttcctcacagtgacctcaaaattctcccaatgtatcctagggttatacaatgagtagcaaagtcaagatttgaaccctggcctgtgttcttcagagtccatactcacagccgctacaccatattgcctctcaggaaacaggtgtccttccctacattacctttctctgacttaggatttgattagcacgtcccttaccacacatcactttttgatttttactgtaactacttaaatcatatcccttagtttccttattagaccacgagctcttcaaaagtaagggctgggtgacatttggtgtccccaccaccaggcccagcgctagcacagacaggtttaattaactgcatttcaaatgaaggaatgaacacatgactgagtgaatctgaattgtagtgagggttaaagtctgtccatggtggaatagggagctggaacttgcttttctgaaggcctcagcctcacgccgccttttaaaaggcaccatgggaaaggaggagaatggaagagtttcatagatgagtgagagcaggagcacaaacccctgcatgtctgtaattacagagcctcttgatgctggctgctgttggcagcatgctggggaacgtgttttcagtcctccaggttgggaactgctggtactactgattgctttgtgtgatctgacatggctgtgaaaggaaaagaaagaaggggataataaaacctccgagcagtggccttgccagctgtagggcctgctccaagagcaagggcctccagtgtgcaccccaccactgagactcgcttttggtagggcagaggggaatctagccaccttgtctgtgctggacccttttgggagcaggatctccacatggagcagcccagggcaggg

SEQ ID NO: 87279 - DNA, 1405 bp, Homo sapiens
ggcacaattagtttatagaatgtttacagagaacttcccatgtttcaggaactatgctaggtcctgcagccacacataagtaagacgtgattctcacctgaaaggaactacagacaaacataagactgacatatttaatggtaagtggtcagtgaaaactcctggatgttacagagcacagaagaggggtatgcattccctctggggttcaggggcttggtagatgacatccaaaggagtcagccaggaaaaaagctccaagcctcacaggcaagagagccacatgagctcaggtgtggaatctgcatgtagggaaacgacaggcggtggatggtgttactagagcaggaagaacgagatggaaagtgtggggacataaggcagagaagcaggtgtgcacgtgtggaggttaagttatgggaaaggagttagtgtttattctgagcaggaaagaggggcgtgcctgaggagatctgcattttagatagatcacagcagtgtagatctaaggcagaggagccaagaatggagacagagaaccaactggaagagatgatgagtgtctgacgcaggggattcataatgagaaggaaggcatggattggaaaaatatccaagagatgagcagtgatggagacatggtgggtgagggagagacacaaatctagggtttctggcttgtgcctgggtggataatggggccataaactgagataggaaatacagggaaggggaacaagtctgggacagagatgttggcgatggctaacatttattaatcacatatatgaaccaggcactgtgccaggacttcttcatgcattttctcttaactccatgaagtggatatgattctcaatttatagatgaggaaaatgaaatttggaaatgttgaatagcttagccaaatctgcacagctggtagagtggtggaaaaaggtcagaatccatgcattctggcccactgctttatatgtgtgtatgcgaagagtctgaagagcctgtggggcatccacagtggagaggtccaggcattagggggtcatcggggcccagatcatggtaaaaaccatgaatgtgggtgaaatttctaagttgagcagtgaaggaagcaaagagccctggggaaccccgaagttaaagaagtagccagatggaaaggggtccaccaaagagccaaaaacaatagtctgattttgatttttaagtcagaagacatgaccatgttatctgggcaacaggaaactgggcaatcacaaacagtgtagctgtatcaaataaaaacattcaccaagttaagctaacatattaattataacagtgactatgttgcatagtaattatcctgaacagtaagcattttacacaaatagcagtaattagtatatcacaagtttcccaaact

SEQ ID NO: 87280 - DNA, 1091 bp, Homo sapiens
ggatacggcccacttggagagcccgaagagggaagtagaagtgtgtgtgtattggcgggtggggatggtggtccgtgtcattcggagatttagcctttttttttggttgcaaaaccaggaatagaggatgggagctgtcctggggtgccctttgtgcttttcacaggagccttggctcgtgactgaggctgctggcctggggccctctggccatcttcctcctatctggaggcccaggtcccttgctttttcccaaggagggaggggctaggctggacaccttcctgtgctttgcttaccggcaccttggacaggggtggtaggggttgggcttcacctctctcagatgcctggggggccattgtagtcgtaagaccaatattatgtaaccgcaggctctttcctggagagtaaggtggcttttaattactgtaacaaagttgctcctttggactttgggaatgaggcagtggagcaggtgagcttgcaggcaaaatggtgccaatttcatactttcactttgctgtctaaccaggccccacccccacccctgggtttgtaaacagtgcccccttctgagtggtaacctggaataggccaccaggtgacactagtttttcttcacttatacagagccttataatgtaagaacctttctccctgtgctgctgttgtacctttgctcagacccatttgagtttaccccatttatctcatttcaaccattagtatttaaaatgaagatgttgatttgcccaaggtcacgtaactagtcattccttgaacagggttctccgaatctttcctcagcaccacatggtgctcacagactccagttgaggctctgacttttcctctccagaatgtgggggcagagggtgctggtctactacctctttgctctgccagtttctgccgaagtggaaccagccctgcttagtttggcagtgctatctagatgaaggggccttggatgcggtcaagggctgcctggctggcagctggcatgtgtgcattctctgcatgtggtgcaggctgaaatggtggtggtgagttctgttttccctttcagccatctagcccacaggcta

SEQ ID NO: 87281 - DNA, 2190 bp, Homo sapiens
tttatctccaggtttttcccaagcctctgtttttttaggggaaggaaggcttcagcattcctttgaggaaaataagatattgtctcctaacataatacctttcacatcacctaataggtcagtactttttgaatgaatgaataagtttgacatgaggaagcaacgcaccaaagagatgagaaatcagtgttgaagctgggtccaaaatctagggctttcaaaaattatattgggctttaaagaatgaacattgtactgaggagagtggggaagcagaggggaggatgggacagagagagacatgtcctgtgtgaccgaccagccaagtctgaggttgccttcccaccctctctacctcttacgggcatctcagcctggagtacttgagagaaggcataattatcattatctctgccccactggacattggtggcctggaatagggcctgtatagggcaggggttggcagcatttttctgtgaagggccagataggaaatatttttggctttgcaggccaaatagtttcttggaagtactcaactctgctatcgtagcatgttcctgcaacactttattttacaaaaacaggtggtaggctggatctggctgatggacagtcccttgtagactgtccttgtgtgcagatgctctcatataacttcagttaatctttacaacaactcgcgatagagagctatcctcacctgctaaaatgaaaataatcaaatgtaggaaggccaagtgacttgtctaagaccacgagagataaactcaggaccaggagtcaggcctactgagtcctagtccagcttctttctgctatgatgccaatgatgtaatgaatggtcattaaatcagggacttaattctgttcaaatgttaggacacctggtttattctcaggacaacccttagtccccattttacagataatgacataaaaacacaaggattaagtaacttgcccaacgacacagctagtagatgtacactgtaatataatcttgactattggtgctcttcagaatatcggaagtaaattttagagttggaaaatctcattttacttatgataaaaactgatgagttattatgtcctattggccctgtatttcccagggtgggaacaatgtctctgccaaagcttaggggctccctctcctaatgcttcacatccgtgttttctgttgccctcaccttctatactcccctcttgcactgagaccccacacccagcagctaatgttcactgcccagagcaaggagttgtcagccttacctctctgctccttctgtagtgtcacaccatgtctgaccggaaggcagtgatcaagaacgcagacatgtctgaggacatgcaacaggatgccgttgactgcgccacgcaggccatggagaagtacaatatagagaaggacattgctgcctatatcaagaaggtgtgctgggagagctgggactgatggccaggggtggggatcgacagctgagctaacctccagggagatctggagctggggacataagaaagcccgtatatcctgtgcaagcaaaaccctaggaacttgcaaagcagacaaactagcgagtgattccgaattgcccaagcattcaccttaggagttgttaatagctctgccaggtgtgtgtgtgtgtgtgtgtgtatgtttacttttacaggtaattatgctactgcaaggcattggggaaggataagattatgcagagaaacttcagaattaaatatttctggcccagttcagaactattcaaaattaaaatctaggatatttgaaagaataagatgtacaaattttcagggaactacatcatttaaagtggatatgcctgtaataatcctcatcatgtaggaggtttccttttcttttccttaaaaaggactcaggtactacatcacccctttctgtctacattcttaagaaaagggtgggctcaaatatataatttttaagaaatggatgagcaataatggggccataggtttggtccctgaaaaattcctgagtgaatttgtcactggatatggttaacatggtgaggaagcagctgtgccaaaagtaagaaaaggggtactgggaccccctgattcccagtcaggatccatatccattggaggcatagtcccagcatttgatattctcagctctggcatcccaagaacatgtgt

SEQ ID NO: 87282 - DNA, 2841 bp, Homo sapiens
agggaggagagatgatcagggtgtagagtgctggaggctcaggggagacgaataatggaggctttgtggtgttccattattaatgaggggaagagtgtcctggccagctttaaaacctgagcttttgaggttcggggagctgaggctgagggatggggtgggggtgataacaaccaaacgtgtcggtgctggagttgcagggagagactcccattctgatttctccttctccagctaccctaattacctttcttctctacctttgttcttttttaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctctttctgtttagttgcctgggggaagaaggctgctttatgtttatttttcaagactttaaaaatattttttggttgtattgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtgtgtgggagtggggagcagatttgtcttgctgtctttgtcagaatttctaagtaagggctgtgtctttgtggattaccttcttttgttcttcctgccagagatcatgacaggaggatgctggggtaggattagcttgaatcttttttttctttacatttttctcctgtctgctccctgcttagccctcagtttcctcattcctctggagttctcttagagcagcccctgttgttagttggctggcaagggaatttctggtgactgtagttccttagttaggtcttagcaatcaaaccaaattgatgtctcccttgactcttctgtgtatatgtgtgaatatgtgtgtatatgtgtgtgtatgtgtgtgtggggtttggggtagaagggagggagggggcaggacagtgtggaatctctagggtgtatgggtaggtagggggcacagttagttctaagtgggcttttatgctaaaagcctctggggatatctgttttgaaaataaagataggtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcagtgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgcacctctgcactgtttgggtctctttggggatgaggggttggcatggtggcagtggtgccacacagtgggtgagggtggagagtctccagggtggaatagaatggggactgaagggaagaccagccactagatactgattggcctgtagcagcacttatttgtgcctaggcttatgccccttaagtagaggaaaactaaccagcagcactcacccttaagggctcctgggttctgccttccttggtggtgatggccaggtgaatcatattttgtgtctttgggatagtaactgctaccttcccagctgccgtcatggacctgcctgagctttgctgcttcaacttttgcccaaagctcttatctttcatactcctcccttctcggctttcctgaacctggagactatttagcaaagggtctggccactcagaaatggaaagctggggatatttagaaagatggcacctcttttggtggaacctaa

SEQ ID NO: 87283 - DNA, 1051 bp, Homo sapiens
tgtgccaatatagaggttcataagaaagataaaagagaaccagcagaaccccaggttctgcctctccttcctccctttgcccagataaaggtgtacagtgtttgtggtgaggctgctggacactgctgttttgggctttctagagagaatgcaaacatgcaaaaacagtgtggtagtgtaggcagaacaagatctagaatcagaagacctggagtcgaatctcagctccaacacccactggatgaacgtggacaagctgcttgatctctcagatcctcgatttcttcatctgtaagatggaaacaatatgtgtcttttctaaggggaaagatcaaatgacatcatgtatgtgaaaatgcttagaaatgggtgatgatgatgatgatgatactgattattagggtatctaataaagttggggaaagaacaaaatccccccctcacaccctattgcaccaccagccttctccctccctgctcaattatacccatgttatagggaaggaaatagggaagaaacttgtctaaggtcacatggatgttcgcaacaattgggatgcagaacttgatctgactcccaggccaggtttgattttgatttgcagtggcagagaggactaattttttactaggttctgagccctgtactgaactctggattgccctgtacttggtggtggtatacagttcagcagtttttagcatatacacgaatttgtgcagccataaccactatctaattctagaacatttttatcacccccaaaagaaatcatgtacccatttgcagtcacttgccattccctcttctccccagccctgggaaaccactgacctaccttatatctctatgaatttgcctaatctggacatttcatataaatgcaattgtacatgtggccttttgtttctggcttctttcacttagcatgttttcaaggttcatttgtgctgtagcatttatcagtactttgttcctttttctagctgagtaacgtgtgggtatatcacattttgtttattcatctgttgagggatgtttgggttgttt

SEQ ID NO: 87284 - DNA, 1004 bp, Homo sapiens
actggtcaagcccagcattccagcagctctcaggagtaacacagacctgcaccaccaagtccctggcaatggtatggagaatgagagcgggtatctggaagggaatgagatctgctcctgggatggcatttgaggttttatcaggccaagtgctgtgcgccctggggaggattccagagttgggtgacttgtgtgtgggttctacagggccacctggtccggagatcctgtctgtctttttgagcatggcagcagcttgtatttgggtgtccttttgcatctcagactcctatttcccacctgggtgataatttttctttttcccttgtgaagataaccttgtcattggccacaaggagaacagattccaagggaggccttgcccaccctatgacactcctttttataggacaaggtggctcacttctcctacccattcacgtttgaagccttcttcctccatgaggatgaatcttctggtgagtagctcagcagttgatcctgggccttggttcccctcaagcagtgctgtctcttggtgaaggccgcctgtgacctggccgcttctctccttgctcccagatgcactcccggagtggcctgtgctctactgtgaggtcctctcgctggacttctggcagaggtaccgtgtggaaggctatggggctgtggtgctgcctgccactccaggtaaccgctcgtctctgcccttctgtggcccacatgccctaggccctaagaacaagactaacactcgaatgcttctggtgaggggtggagataattgggaattggaaatgtttggcttgaaagagttcctgttcctctgaggactttctgcccccctccattagcgacaatgacgtggccttggcactgacttcctgacagtctctccatgtgcttcatgctcctctgattggactcagggtgagaagctgtatggcaaaattggctcatagcatatgtgtattgaatgaatcagcattcagtttggaataaaa

SEQ ID NO: 87285 - DNA, 1066 bp, Homo sapiens
ggccctgaccagatggcgtacacagggctgcttgcttttcccagcactgtcagagaatgaccactgcagccagcgaggtgccttcattcttggtcgagcgaatggcaaatgtcaggcgtcgccggcaggacaggcgagggatgtgagtgcgggcatgggatgggggacaagcttttactttttatttcctaaagttgggtagttttgcatttttatcagtggttatatatagtattcaagtattactttgtaattaatttaaaaaataaatataaaaatataaaatatcttcctcactcttcatgtggacatttttccaaagtgcctcagagagagggaagggatgtcatttctgtttgtcaaatattttggctcttaaaaaacaaaacaaaacagtatgtccactagctcaaacttcccattctgaagtggctctccactggggtgctccattggggtgtgccagggaagtgacctttctgtggtgtctcccagggagggcggcatcctcaagtcacgcatcgtcacctgggagccctcagaagagtttgtcaggaacaaccacgtcattaacacccctcttcagacaatgcacatcatggcagacctggggccctataaaaagtgagtggcgcttctcactgccagcttagagcctcatccttttctcctctcaccagctctccccttcctgttattatcatcctaggttataggggagggagggactttttcttccttctcttcttagttatgagtgaagcttctcactgccaactcagatcctcatcttcttctcctctcaccagctatccccttcctgttatcatcctgggttataggagaggaagggactttttcttccttttttttcttagttgtacttggaagaaagttttaccatgacagctctccctatagcctctgttctctcccctgcagtgggctcagtatctcttcttgtttccctgaaggaccattgacctcaaccttggtgttttcctgatttctaggcttggctataagaagtatgaacatgtcctgtgtactctgaaggtggatagca

SEQ ID NO: 87286 - DNA, 2332 bp, Homo sapiens
cgccagcctcttcctccgcccaacatggccaccatttttgttgggatagccttgggctcctgccaggggaacagcagggcagtgagggagtcaggactttgggctggtggggaggccgagaatcaaggctctggggagtcaggactttggggctggtggagtggctggggactgaggccctggggggtcaggaccttgggctgctatggaggctgggactgaggctctgggggagtcaggaccttgagctggtggggaggctgggaattgaggccctggtgtgttcaagaccttgggctggtggggaggccagggcctgaggccctggggggtcaggaccctgggctgttggggaggctggggacttaggccctggggggtcaggatcttgggctggtggggaggctgaagggtggggactgaggctctgggcagtcaggacctcacggttggggtggactggagaccaagaccttggcaggggagctgtggctgcctcatttggacgctggagggtggctagcgtggctggaagcggccagccaggggttcacagaactgaaggtgaggcctccagaggccctagtctctacctgagtgtctctgaaactggggggatggggtggagcctttagggggaagggaagagggaactgaagaggaagtgggggagggaggtagaggaggcaagtctggcgccatgctgagtcaccgcccacaaggcccagggcgggccctcggggggccctggcagggttggggggatcttaggaagccacaaggagggctggggggctcttggagcaggagtcaggaggcctgggcagcctgaagagtacacgccgacggacagacagacagtgcagtcacccataaagtagaaagcactactaacagcactggagggtgtagtgtttcctactttatggatgagtgtactgtgggcttcggagatcacgccactgctgccgcccgctgcccgccaccatcttcctcggcgctcggggacctcgtgtgacaggtgagcaccttacggcccctccctaccctgcccagatgcctgaaaggcctccatggctttcctgcccttcctggttccggacagctggggaaaggccacagcagctcctctgctgccctgcagtctttgggggcggggagggctggacatgtggaaccctgatgcagccgcagcgtcaaggacgaggaaggggtgggaagggatggtacgtggaggggaatgggtggtgggaccagggacccaatgctaataaagactggactgtgcttctcttttgtctgagactctgttgctggggtggggagctgaatgcgggcggcaggcacatggacagtatgggcgcacagaagggctgggagggagaacctctgtcgctcctccagaagatacgggtttggccctgcctatgagatcagaagagggctctgggcctggccaggccacagccggaggagagaagggcctgggccatctgcagaaaggggcagggatgtaaggcatcctctcaccttctaccctagctctggccctatcctgcccccctacatacccaaactgaaagctgcctacatccagttttaatctaagaaagtctagggggtcctaggtcatataaaaattgggcaaaatccactgtggcacatacacagcatcttagacaagggcacagacactcatatacaaagcacacactgagatgcaaatgcatttacacacagaggccccattcagtgtgccagtaacacacacacagacacatgtgacatgactggcatgacacacacagggattacacacacccagggcacatacatattcagtagtacacacatgcaatgatagaaacatagggcgtgtcttacacatagaagagcacacacatacagtgacatttgcataataaacacggtggctccatacacatacatagatagagacatgttcatatatcatgataaatatagaatacatagatacatggtgatatatatatataaatcaaaccatgtcattatgcatatttacatgacgatatgagcatgtcatatattgtgtaatcaattactacattgtgccatatagtagcatccatatctatatatatcatgatgtgttgtaatttataaactcatgcaatgatagcctcccatgcacataacagcacacacatagacacagtggcaaacaaacatagatgcaatgacacagaaacatacatacagatacacccaatgtgtttttgttacgttttattatgtgactcatagacacataatagcacacacatatatacacacaatggccccttca

SEQ ID NO: 87287 - DNA, 1030 bp, Homo sapiens
tgtttgtgctctaggaagtccccaagagcacaggagcccagagacctcgcaggaggaagcagcagtatctgtgttccaaatcctgcccagcccccaggcagccatggtatcttctcagctggctcgagggcacacctcccaaaatgcagagaaggcagggtggctaggaatggctctagtagaattctccccttatcttgtctggaaacaaggggcaaagagctatctatttcctcctgccagcctcctgcccccaacaggattcctcacatcccaggaccagctggaaaaggtggtgagagttggaaagagactgctcagtgaggactgccctgcgaaccagcttggattcatcccgttcacctccacgttctgcactcggggccgagggaagggaggcagcccaggcagctagagaacttgatgaaacacactcaatctgaatctcgcttgatcgtcatgctgacccagtgaggtaagtgatggtatccccatctcagagatgaggaaccggaaactcagcgaggttaagtttcaccttcctgaaaatcgggcaccccgtttctgttccccagagggagctcaattcaaagtccccaaagaacaggtcttctgtgaagacctgttctcccctcacaaccccgttggaaaaagcagtgggagcgacccagggcggaccctctggcccaggcttgtgggttggggggcagaggggcctaactgggtggccaggtggcccgcagagtctctccagcagcagatggcctccccagccctttccttcagagcctattaagcagtcaaatgggggagggttggcccccaaggccagggacccagcagcagcagcagctcacagcactggagccgttaaaaagtgactcaaccagaaagtgcgtttgaagtgacgcccgccagggccccagagccccagagccccagagccaaacctcaaaaagacgaagtgagagagacaggcctgcgggggctgggccgggggtggagacccagcctggagctggcctggcca

SEQ ID NO: 87288 - DNA, 1073 bp, Homo sapiens
ttttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcggagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctcctttttgggccatttttcaatacatagaatatgtgcacaatcagccaaaatagtaggggaaatgctgagaaccacaactgcagggtgagctgtgctgtgctagggcagagctgcctgtgctagggctttgtgtctcagccacctggtgttgctcttgagttgattttgcttgttacctgtggcctggagagtgtgggaaggaggagagatgcgacctgactctgattagtttgtctactcc

SEQ ID NO: 87289 - DNA, 1045 bp, Homo sapiens
attacaggcatgagccactgcacccagccgaacatctgtttttcttaaaatgtgactcatgagaggtctaagggaaagatggggtcttaggggagggagagtttggaaaccactgacccctgcagctctgctctctgctttggcttttcctgttggtgtcaatggtgttgtcaccaatgacagagctggggctctcaagccagatagccctgggcttgcagcctgactcctccactgcccctcagtgtgacctggacttttttagctcacctctctaagccagcctctatttcctcatctgtaaaaggggaataataatgggacttgtaagtagttaggaggatttaatgagacagtacagatggaagtttttagccccatgccacgtacatggtaaccactcaataaatgattgcaattatcattactatcatcatcactggcatcatcattccgtgcttttgtagttaacaaggttgcggtatttttccttccatttgttatctcgcttattcttttctgaaaccctcaccataattcttctggaggcttccattcttgtcaccaccccactatcccctccaccctctgtccagtcacccagattggtttctgtttctttattagcagctccacagccatcctggtgataagccagagccttatcacctcatgcctgaactagtgcagtggccttttgcctgctagaaggagctagatctggagaaaagcagatgggtgcaagccctgcctctcttaccatggaggccactacctggtagtaaagaacaggcaatctgaaggctgaggtcctgggtgcaaattctgcctccactgcttctcagttggtgaccctgggcaaattattcagttcctctgagcctcagtttcccacctcaaaagtggggctgatgactatcttatagagttttgaggagtaaatgaaatcacatgtcggaaacacatagtattaataatagttgatataaggaccaggtgtggtggctcataccaggtgtggtaatcccagcactttcagaggctg

SEQ ID NO: 87290 - DNA, 1041 bp, Homo sapiens
ctaaaaatataaaaattagccgtgcgtggtggtgcatgcctgtaatcctagctacttgggaggctgaggcaggataatcagttgaacccaggaggcagaggttgcagcgagccgagattgtgccgccgtactccagcctggacgataagagcaaaactccgtctcaaaaaaaaaaaaaaaaaaggcaactgaggtgaaaagagtcttggctatactactgaaaaggagggacactaaaatttgttggtctctttgggttacaactgggctgcatcagtgtgctttagagttacaggaatatcccgaaattgagaatctgatgggactatacaattttagagccagttctacaggtgagacatagacaacttgttctgcttgtctgaaaacttgtctatagaactctacagagaggctaagagggagtaaactatcctttctttctagatcttcatctgctggtggacgtggcctgcaagcaggagcgctttccaaaggaggaagaattaaaagagtgaggaatggatgacaaatgtgacattgtgcactagctgtagctggaggcagactagccttgcacatgacaaactgttgggattttttcagttctgttaaggaaaaaaaagtattttttgtttcgttaattgagaattttgttaattgagaattgggaatttgtatgtactacagtggttcagttcagattatctgccttgacaaactactgaacatctagcagccacgttttttggctgcccagatcccttttaaatgaaaagttctgaccttctgttatagtcaaggagcatctaaaaactgctccatctatggtactaagaataatctgtgtgtgtgctgatttgttgtcttgccactcaaactgtagtcagcacaactttagtggggaattcagtctctctgattcaagtcacagtgtgatccttttagaggagattgtgtgagaaacaaaggcatgtgaggtcaccagcatcacaggtctaaatgcatcaggaattccagggaagaaactctggagaagag

SEQ ID NO: 87291 - DNA, 1046 bp, Homo sapiens
ctgggctgtaaagccaggctggtggagctgggctccaaaaccaggcagtctggctctgtgatctgcattcctgaccacttgcctaaattattaaaacatttttgtgtacatttctactggatgcattgtttaatggtggaacatttggagaatacttcatagttattttactcttttaaaacactccaccctccaaatagttgttactgttgaaatgattgaaatacttattttggaatttcaatatattcctctattttcaataaaatgaaattactttcaataagaatatatgtttggttagaaaggtaacaaaatgcttaggtgttaaagaaatgatttataaaaatagacattagacatgacccttttaaagacctttaaaattattttgttactgtgtgtgttgttttcaataaataacaccacctaattggactaaatattttgttagacatacaaaagaagttcttcaaatttggatttctttccatgttgaaagaggggagctccttgaatgctatagaaatgtattgtggttgatggcttttctgtgtttgaatttgttccagctgtgctacagtgctgttctcctacccacatggatgctctaagtagttgtgtcactcccaatgcctcttcctatgcacactgcaactacttccaggtaagattcttgcaactgtggccatgctccgcgctttatgtgcaattttatcgatattgcaaaatttcaaagtgtaattttatattaatgagtaaccagaagtaagctgtggattaatgggctttgttttctcaattcttaaaaaaaaaaagagagaattgatataaataatatctcagaattcttctaggccagaactgttcaatatagtagccactagccacatgtggctatttaagctaattaaaattaaatgaaatttaaaaattcctcagttatactagtcacatttcaagtactcaatagtctcatatggttattaaaattaaaattaaattgatttaaaaattattccatacttaacgtagacacattttga

SEQ ID NO: 87292 - DNA, 1072 bp, Homo sapiens
ttgtttctacaaaaagtaaaataaacagtgcttggtgatgtgcacctatagttccagctagtcaggaggctgaggtgggaggattgcttgagcctggaagtttgaggctagagtgagccaagatcacatcactgcactgcaacctgggcaacagagtgagacccggttgctagatagatagatagatagatagatagatagatagatagatagcaaagagcgttacttttttttttatcttgttatatgttccacacccatttcttttattttttggtggagagcttatttttatgcctattattaatgttacaaaattgtttgaaagactgaatggaaaacttttaggaagtagcttacacgttggaaaaatctgggtcaggcaaataaagcgaaaggtaagatggccaaatcatgtataaaaggcttttaatgttgaatttttgatttaacatttgatttaatgttagaatttgggcactttatcttttatgactatcgcactgagaaaacaaaggtttatttgattcttctttcagcattatatgtctcatattcttgattctgaacttgtttttaccaaacctaaacttctgttgtgttaaaaatggctgataggtgaagagtagcatattttatgacctttggtttactatgtctggtgatgtaatgcaaaattagtaaatgtgctcttcctcttttatgtaggaccagtggctgtaggacaatttcaccggtcatttcgtcgagatagtttgtctccttactcctgtgtatcaactccatcccacgaccacagtacttaccctctgaaaggtttagatcggaccccagttcctcatagaatatggcagaactcccttggaatgcatcctggacaagtggagacatctcccacattttcagataaaggggttccgtttcctgtactccagaggtttccaactgaggttacctatacactgcagcccagcaccacatctgtacatgttcaacaaggtcctcaaacaatggtcagctcctcccaaaaatacagtaactacacaccctcagcacagtactcgcaagccta

SEQ ID NO: 87293 - DNA, 1028 bp, Homo sapiens
ccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcac

SEQ ID NO: 87294 - DNA, 1030 bp, Homo sapiens
caaaaacaaaacaaaaagcagccatagacagtaagtaaatgaatgaatgcagctgtgttccagcaaaacctgatttacaaaaacaggcagtgggctagtttggcctgtgggccatagcttgccaacccctggtttagaacataacaagagtctttctatgctgtggtgtagcatatcggtaagagtgtaaatctgaagctacaatactaggttcaaatcccagctttactacgtatcagctctttctctgtggcttcattttcttatttgtaaaatggggatattagtagtatacattgtaagactgtcataagaaataagttcatgtgtgtaatgcacttagcacagtgcctgacacatggtaaacagtaagcgttaatgatgatgaagataatttgttgtctttgccttttcatcagacatgtttgaaggagtcagatggcagtgatactgaggattttggctctgatcacagtgaagactgcctttcagaagcaagctgggaacctgttgataagaaagagactgaggtatgtttaggcacatatgtggtgggtacttacgtgagccagtgagtcatcatattttccagagatgaatgacatgctgtagactgagctgtcccccagaggagtgtcagcctggtaggcaaatggtagccagttatgaagataagccttgtctctttctgctggggtgctttcctcattgcaatgttgctcttccagtctgtcaacaaggaccaggaatttttctttgtgccttctattaggtgactcgctgggttccagaccatatggcatcacactgctataactgtgactgtgaattctggttggccaaacgaagacaccattgcaggtaagatgttttgtatgatttagtatgacaaaaaacagggcaggccaggcgcagtggctcacacctgtaatgccaacaccttgggaggccgaggcaggcggatcatgaggtgaggagattgagaccatcctggccaacatggtaaaacctgtctccactaaaaatacaa

SEQ ID NO: 87295 - DNA, 1023 bp, Homo sapiens
tatatatatacacatatatgtatatatatccgtatacatatatacatgtatacgtatatacatagacatatacatatatgtgtgtatatatgtatactatatatatacacacatatatacatatatacgtgtatatatgtgtatatatatctcaaattttgatatttgtttattggctgagagcttttttgttttttagagacagggtcttgttctgtcactcaggctgggtgcagtggcacaattatagtaacctcaaactcctgacctcaggtaatccttctgtttcagcctcccaggtagctaattagctcattaggcatgtgccaatttttattttttgtagagacgggtctgttgcccaggttagtcttaaattcctggcgtcgagtgatcttcctgccttggcctcccaaaacactggaattacaggtgtgagccaccatgcccagcctggctgaaagtttttaaagttaaaatataacatatgttattggttgaatattataaaggaaaacaaaaagcccagcatcccaaattattggttttagggtcttttgaactaagtcattgtgaggggaccgtgataggtttcaggatttcagtgattttttttttccttccccaaactatgcagaatttggctacaggttcataggtttacttttcctgggagaggggccataacttttaatcaaatttttaataagctctgtgacccatttaataatcatttcattaacttagtatctgatttatcaattcaacaaatgtttctttaatacctacaagttgcgtattactgtactaggttttgtgggctacagcaaagaaatagaagatattggttctactttcaagataattttaagctgtaagataagacacagaacaactagagagagcaattcttttttttttttttttttttttttgagacagaatctcgctctgtcaccggttggagtgcagtggcgcaatcttggctcactgcaacctccgcctcccgggttcaagtgattc

SEQ ID NO: 87296 - DNA, 1035 bp, Homo sapiens
aacttctgttgggtgttggccagtgtccctcgtccccccaccctgggtccccactgctttacctcttgctttgcagccttctctcctcacagccttcctgtggctgtgtttttggccctgatagccccatggcacaactgcactttgcctcacctaggcctgtggcttcttgcctggcaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgaggccagtctattttctttgggaggctgcttcttaccccttagttctcatccctcctccactcctgcacattggtgctctgggaagctaaccatcgtgggggctctgttgcaggtgagcacatacgttgtcgacaggaggcggagcttgcaaggatgggctttgacctgcagaacgtctggagagtctcacacatcaacagcaactacaagtgagagggttggggaccaaaacaccttccacaccaaactacttccgtgtttggataaagtgtggtgggcacagcttctgagtctgagagggaggaaggctcatggtttctcttcccacaaagccatccccagggatcctgtcatcacatgttttagacccagtgcagtgacccccacctggtctcttctcagattgtgccccagttacccccagaagctgctggttcctgtgtggatcactgacaaagagctggagaacgtggcttccttccgctcctggaagcggattcccgtggttgtgtataggtgaggcagtggggctgggaagtagggaggccatttcttatgcaacaaggaaagagtcaaaattggagattttgggtaacctggttgactgagaattgacactctatggggaagtatgaaataactttaaaacaaaaactatcttagttttttctcctaagaataaggctatta

SEQ ID NO: 87297 - DNA, 1071 bp, Homo sapiens
agcagaatgagcctgatgggctaagtggagcttggtgacttaggactgtggccttcctacagggtgaggaggggccccccagcctggagtacatccaagccaaggatctgttcccccccaaggaactagtgaaggaggaagagaatcttcaggtaaggaggagttgggggccaggatagatggggctccctgcccagttaaaaaacaccctcccttctcccaaaaatcctcaagggcatctggtaccagagctctggcttcatgttccctggtctctggaggaggagggtttgtctgcgcatcctggagcctttggccgcagggaaggaaaggcagctttcctgtacagctgttgcctggtgctgttaccgtggagagaactctcctctcttgccttggcccaccttttccagaggggatcccacagatcaggggctgtagaagaggataaggtggtcactcacttctggactgaaggtttctctgccccttgacaggtccccttcacagtgctgcagggtgagggagtagagttcctgggccgggcagccgatgccctcattgccatctctaactaccggctgcatatcaaattcaaggactctgtcatcaacgtgagtttctgtattgttctcctacccctaagctagaatccctatgaagttcaaggtgggattgttccaaggctgtccttgatcatgtcattaaaaaagttggaggccgggcgcagtggctcacgcctgtaatcccagcactttgggaggccgaggcgggtggatcacttgaggtcaggagttcgagaccagcctggccaacatggtgaaactgtgtctctactaacaatacaaaaattagtcgggcttggtggtgcgcacctgtaatcccacctactcgggggctgaggtacgggaatcacttgaacctgggaggtggaggttgcagtgagccgagattgtgccactgctgtccagcttgggtgacagggtgagactacctctcaaaaaaataaaaaaaaaaaagttggggatcccttctgtttctctctgacctcatgttttcctgcctcatttt

SEQ ID NO: 87298 - DNA, 1042 bp, Homo sapiens
ggggcttctctagttccagggtgctgctgttaagccactacaggtgacagctgattgaatatctatcaggatagcatcttcagggtgcccagaatatcaccagaggtggtttacaatgatcctattaattttccattaactgtaacagcccttctctcaccccaagtccagggaagcccttaactcctaagagctaggaggaggcagtgagatgggaaaggcctagagagctgtaggccctggcccagaccaggcccttaacctggtagtatctcttcggtgtcttttaggtgtcccttgtgcttaggggcaggttaaagaattcagtagatgagaggatttcctccttccctcccttccttccatagacatgtggatttggtgtgtgcactattggttcagtctcttctcagaaagcctgctggttttggcccccaccaacagatagctcctctttttctcttctgggctaccctgaaaagagcatgggcttcacagtcagcttcatctaatttcaaatcctagcaccaccacttagttaaattacatactttctctctaagcttgagtctcacgagtaagacaggataaggtttacttcttggggcttgaaaagttttactgagataatgttagaaactgcctggctcattgtagatgcttaataaaatgtcaggttttcttttattactcccttctcccccaaacaagacaaaagccctggtgtctgaaagttacaaggtgcaggaagtttggggttccagccacctccctctgtgactcttggtgacattttgagccccttattcctggtccttattccttggccctctacccaactctctctactccgctgctcctgggtttcaagtttcgtttttttgtatagcttctgtggtcgatacttctagctcttcactttcccagactaagaaatcctttctcctccaagaagggctttcttacccagagatcagaatgtgaaacaagggagagatggagctgaaggagtagggttgggtaggggcgttggaataaaaag

SEQ ID NO: 87299 - DNA, 1089 bp, Homo sapiens
ttttattaataaaacactaaactctcctggagcaagaatgtgagaattttattatttgagcaacctggatttttaccccaggagcaatgaaacaatccatgagacctggaaaaagctgaagctctctttttttttttttttttaacttgtatacagtacagtttcaaacaaaattggggcaactttgtacttcgtaccttattaaaactggggcgaacacagcgtgtttggtttgatcttgtcttcataggatcttctggctgattccttctctggatgagtcctgagaatttctagaatctcgggagagtaaaggagggtctggagccttctctatgtacaaggaaatcccagttttgttaaaaacttgccaaaggcttggtgatataactccaaagacaaatccacagattcctttcaggtacttctttgggattctgtgaagaattgtggctgtacactaggatgtttaataggaaggaagctccttcctttatgacatcaccagacagagaggtagctaaggggattatttgagacactcttagaacaacagccacttttgtgggagcccaagaaacagcagctttaaaacagggtaaatattcaggcatcattaggatcctgaatacaagccagccagtaaaatacgggatctactcagaagggcacaatctatcagatggtcaagacaaataaacctggggccaaggtagcggtttcagcacagagagggtctgaggttactactaacacatcccctcagcagggacatgggtacgttcttgcctcaagccatcgaagtgctgcagtctccctgaacccttcccaccgaagatcagaagctgcacatcccaccactccccattcagcatcagactaccctcgatctgtctccctccagtcaggacctggacactatgcagtacccactcctcggggacccgagactggaccaagaacagaatcatcccgccattcctctccccatctaaagagccagaagactcagacactggcttcccatgcttcaagcagacaatggaaagttagtccacccagagaggaagcagcacgaagaggcagtga

SEQ ID NO: 87300 - DNA, 1055 bp, Homo sapiens
accagtgtctaaatacacattaatgacaaagactccaatttagacaaagttgcttaatttttaaaatgttagtgtttatagttaattaaactataaagtgaaattaatgccaactttgattcaataagtgatagagtcagcataagaacagttttaggccaggcacggtggctcatacttgtaatcccagcactttgggaggccgaggcgggcagatcacctgaggtcaggagttcgagaccagcctggccaacatggtgaaaccccgtctctactaaaaatacaaaaattagccgggcatggtggcaggcacctgtaatcccagctactcaggaggctgaggcaggacaatcgcttaaacccggaaggcagaggttgcagtgagccgaggtcgcgccattgcactccacctgggggataagagcaagactccgtctcaaaaaaaaaaaaagaacaggtttaatatggagagaatacagaagatgctgctgtcaattgctctgtagtcattttgcatttccatgacacactgttggttataatcgcccttgattataaagaccaaaattcctttcccttgaatttaattgaatagaaagaggatgtggtttgtgtctttaaaaaacacacataccaactcgaaacttccttttttgttctttaaaaaacatgtgcataggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataacagattttgc

SEQ ID NO: 87301 - DNA, 1043 bp, Homo sapiens
aggaaaaaagtatgaaatataggtgaatagagatggggaaacatttagattgttttgatgttactaactttttgagagactataaaatagagattaagagcataaaccttagagctagactgcctggatttttaccaattttaccacttactgtctgtgtgatttttaggcaagtttcttaacctaaatttcctcatctgctaaataggagtaacaataacacagtctatttcagagggttgttgtgaagattaattgtgaacattcatcctgaattaatgtatgcgagtgcttagaaacagaacctgacacctggggttctgcaagtgttatgtatgatcatcatcatttctattttgagtgttgtgtgggattttgtcatacctaaagaattcctttcaaacctggaatgccctaaagcagtggttctcaaattttatcagacatcagaatcacatgaagggctaagtaaaacacacattgctagacccccagagtttctgattcagcaggtctgagatgaggcctgagaatttgcattcctaacgagttcccgggttatgttaatgctgcaagtctaaggatcacccttggagaaccactgctctagagaacggcaggacacgcaagggaggaaataagtttcctttggcttttgtgttgtgacagagctcttgaaacagcagcagggctcatccacggtgttgcatgagaacacagcaagtgatggaggaggcactgcaaatggtaagtgaactacctagattgttttcatcaggttcttttaacgctgtccttggcaacacagtggtacatatagggaagtgtgaccttgaggtcaggcacaactccacctcaagtctgactttatagttatttgtatggcaagctgttttactgtttctgagcctcagtcgtcttaatctgtaaaatggggacaataatttctgtctcatgaagtacatattagctccatgtacagagccatgtacaagtactaacattttcaaatacttagcaaatgttagtcctcttccctttat

SEQ ID NO: 87302 - DNA, 1115 bp, Homo sapiens
cccttagagagtatttattcaactctggagagaaaaatgaggcccagacatgtcagagaactcgcagctagtagtacagccagaaccagaactcacacttttttttttttttttttttttttttggagatggagtctcattcttgctgcccaggctggagtgcaatggcgcgatctcagctcactgcaacctccgcctcctgggttcaagcaattcctgtctcagcctcccgagtagctggaactacaggcacgtgctaccaagcccagctaatttttgtatttttagtagagacggggtttcaccatgttggccaggatggtctcgatctgttgacctcgtgacccacccgctttggcctcccaaagtgctgggattacagacgtgagccaacgtgcctggcacagaactcacactttctactcctgagcttagtgccctttcctctgcgtctcacactgggctgatcaactggttccttgtagcaagtagttagtgtactttgttcacagaggggatttatgtaattttcttactttctttctcacagtactgaagatgaacaagaagagacatcaaaggagtcaccaaaggaactgaaagagaaagacatgtatgatcaccaaagagaatgcctagggatgcttgtgtaaagtcttggttttaagggaatagtatattcttgtttgtaaggatctttccatttttacgtgtagacttaatgtgagtatgctgcttctttcaccaaaaagttgttatcaaattggtgatatgatttataactaatagcagcttacactcaaggaaatgtagtgatgataataataatcataataataataagtttacgcttaaggtagattaaatctgttttccacgtaaatatcctggaaatatggaatatttcatctatggaaatagtttatttttagctgctgatatgtttaaagttacagtatctagcaaagaaagtctctatggtgccaggtgtggtggctcatgcctgtaatcccagcactttgggaggctgaggtgggcggatcacctgagatcaggagttcgtgaccagcctggccaacatggtaaaatcccatctctactaaaaatactaaaat

SEQ ID NO: 87303 - DNA, 1025 bp, Homo sapiens
gggaggaaaccggactacctggaaaaaacccatgcagatgcggggagaacatgcaagtgccacacagacagtggccccagctgggaattgattgttttttttttttctcatcagagttacaatgaaacaatgttgaataaaatgacattatttgaggaactgctacatagatatttactatataacattataaaagtggagagtatgcagtgtcactctcatatcctgtgggcattattctttgtatcagttttctcttacaggcttaaaggatataatgtctatttttaatactagtcgtaagtgacattagcagaagtgtttgacaacatttgaaatgaaaacatgcatatatgtatgcattccaaaaatatgagctcagtgtagtctggaaagactagacaaactcaaatagaatactttctattattacacactaagaactatagatgtcatttttcctgttaaaacttcacaggaagagggtctatctgtaagttgtttgctgcctttcaccctggaagtaagcaacaagggctgttgtttgggataactgactgaaattcccttctctctctctgtcatcaattctcccctgacctcccattcaagccaaacagggcaagctaaggatgatgcaactgtaaaaaggcaattgttacactatgagttataatagtattatgtatttcttttagatgaaagcctgtgtttccagtgtttacagtgatgttttaaatgctgctttctcttatgcacagtggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagccca

SEQ ID NO: 87304 - DNA, 1096 bp, Homo sapiens
gaaccatcacctgtgatttgtggcatttgcaggggaggctctgcaacagcccagggattgtgtcttgtgaaactgcgcttcaactgcgggtttcttctacctctgaaaatctcccaagagcacttttataatcatgaaatctaaacttagaaactaaaaatactcttagagatcttatagctcagtcctttcatttcttagccagggaagacctagagagtccactgcccaagccaaagccacacagtttaatagtgcactcttcactctgtcaagccaccggcagggaccttctgcatcacccagctgtcactgggactctaccaggtaaggatccttgtgggctggaaactggtggtggagcgggggtgggggtgggttctggcaccctctgctggtgcaaaggggtcagtgcaactctaggaatggcttagggagtagggaacaggtcctctggatgggctggtgggcttttggttctgtcaagaacttgagcaaactgatgtgtttgtgtccaccccgctccccctacctccaaaaaacccgtgcaattcaggatgagtgtggaacctgtttcttctgaaatctataatgcagagtccagaaataaagatgatggaaaggtacacttaaaatggaaaagtgagtataaagtcatgggttttattagacaaaatgaaatttaaagtatatttctaatgtggttgatatttctaagtacacaacctgtgttgcacatttagaaccatagcaatgtccttctgaatttttttcttttattatatttcattttaaaagcagggcccttctgactacagacttcagaagggaaatgctttttttttaatttctagactttataggaaatatttctaatatataaatgtatattgtataagaaatgtaacaaaacagtgcacaatacaataagtcctcaccttattctgttaataggaaatgacaatgactttaagcaaactacgactttaagcaaaacgatgtataacaaaaccaattttaccatgggctaattgatgtaagcaagagttaagttcctatagcatatttctggtcacaaatacatcaccatacttct

SEQ ID NO: 87305 - DNA, 1088 bp, Homo sapiens
tctcctgtctcagactcctgagtagctgggattacaggcgtgcaccaccacacccggctaatttttgtatttttagtagagacaagatttcaccatgttgtccaggatggtctccatctcttgactttgtgatctgcccgccatggcctcccaaagtgctgggattacaggcgtgagccaccacgcctggccaatctcagttcactttatggggccaatgtgtgagggtcgcttgaagtctgggagtttgagaccacgctgggcaacaaacattgtgtgacttcatccctaccaaaaatacaaaaactagctggctgtggtggcaggtgcctgtggtcccagctacttgggaggctgaggtgggaggatcgctggagcctgggaagttgagcctgcagtaatctgtgattgtgccactgtactccagcctagtgacagagtcagaccctatctccaaaagaattttatttttttaaaaaggaagctgatcagatctaccctctctgattcagcagtctctctgctttctggtccagctggagagtagggcattctagataacagggaattcatatctgtgccacagagcacacacttttttttttttttttttttgagacggagtctcgcactgttgcccaagctggagcgcagtggatcttggctcactgcaacctctgcctcccgggttcaagagattctcctgcctcagcctcccaagtagctgggattacaggcgcccgccaccatgcccagctaattttttgtatttttaggagatacggggtttcaccatgttggccaggctggtcttgaactcctgacctcatgattcacctgccccggtctcccaaagtgctgggattacaggcatgaaccactgcacccagcctacacttttttttctttggaaatagagtctcgctctgtcacccaggctggagtgcagtggtgtgatctcagctcactgcaacctccgcctcccgggttcaagcaattctcatgcctcagccacctgagtagttggtattacaggcatgcaccaccatgcccagctaattttttgtttttttagtatagagttttca

SEQ ID NO: 87306 - DNA, 1032 bp, Homo sapiens
gcaggtgtgcgccaccacgcctggctaatttttgtatttttagtagagaggggatttcaccatgttggccaggacggtctcgatctcttgaccttgtgatccacccgcctcggcctcccaaagtgctgggattacaggtgtaagccaccacgcccggcccctctgggtagtttttctacagagagaaattaatatataaggaaatgaattgtttctaaagtacagtggattagaaaaaaaaataaagaagttaagtgacttgcctaaggttacccagcttcatctgatttcttttccccccactccactctttggtttcctaatttactcttttgtatgactttttccttacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggcaagccctgaagttgttgggagtttatttctgcttacctaactcaggagaatagggagttagagacaagatgaagctagagaccaagttgtaagaaattttggaaatcctcattttattacaccatttctgtgttcttgataatagcctaactgcttaacttggtgaaagcagcatggaattgaggaggggagctagggaggttcaacacatatgcatagtaggggcaccctgtaggcacttagtggagattcagtgaatggtagctattattattgcttttaaggtattggcaataacaataaactagttaattaggactaaagtcagtctacccaacaggaataagagggagtttatcagatacttagatggtttctaaagcaccagtgacattcaggatgactgagactatgtccttgacaatatttcctgtgttacaggattttactggagcccagagaactcaaccaaccgagagccccag

SEQ ID NO: 87307 - DNA, 1023 bp, Homo sapiens
gtgacttttcagcaatataactaaagtcaatactagctttttcaccttcatgacttcatgaactcactgccctctatccaaagatttgctggaagaaactttatttagggaagtttgctcaaagtctgagaagcccatctcatcgtctaaaatctatcctttttccagaccaacaaaaaacttgctgtcacttgctttttaaaaacttaattcttaattatcaactgccagtcattaagtcttgactgaatgcctcccataatattcatactaattctttacatgaaagagcgctttatggctcaccgagtgtttctacatccatgatctcatttgactgtcatgacagctgtgggcacaagtcagtgctgagtttaccctgaggactcttgctgggccagaagacatttaggatgctctgacttagctcttaaggagtctggttgggaagagttatttaagcatatgagtgaacccttgagtgctaaactgagaggacacattcccaaaagggcaggagttcagaaaagaaataatcatgaggagttggggaagtcccagatggctttgataaagcagatgggggttgagagggctcttgaaagagtttacgttcatttattcaacagcaagcatcaaggccctggtgtaagcccagaagtacagtgatataaaagcagatgagttgcctactctcatggagctgactctctagaatggaggggagacagataaactaaatgaacacaaattcagataataagtgctctgaaaccaataaaacaggactactttagattaggcagtcagggagggcctccttgaggaagtgactttcagacaaatatctcagtcacaaaaagtagctagtcattctaggatctgtgggcagagcatgcctggcagaagctgccagtgcaaagacttgaagaacatgaggtatgttggaggaactgaaagaaggtccctgtgacttgagtggagtgggtgagcagtagagttgccagatgaagtggtggagag

SEQ ID NO: 87308 - DNA, 1044 bp, Homo sapiens
cttgtatagagtccctggaaagggtgctttggcctgagatgtaggtttagagagctcttggagtatttaggtttttttcctccatgactttgttctaaatactttggatagaagtaaggagaccccaagaagggctcttcccccaaatggcttgccattccttctgcctgaggacctcctattctgtttttttctgtttttcccccttgagtgagggtattaccttaaagaccatttctctgggggagagacccattaagactttagtcagccaggtgcattgatgtgagtgaatttctgtccccttaggaggcactttctgtctcatctgactggggtaggactgaattggttatctgcattctgcagggtcctttgagcttccaggttctccccagcagcttgggcttggacagggaggcgacagggcaggtttactggtggtatggggggacctcccctgtcagttttccccaagccaatcctggatgcacataccagactttgagaactttcttttcattttttgtggtatgaagcagctcagctgagggaaaggaatccaggtttggatccagggggcctgagtcattgggacgtcaggccattcacttagcctcactgagctttaggttctccatctgtaaaatggggatccttggtaaccatgaggatcatatggaaagactggaaatcacaaaatgctctacagtgtcagggccccagtccttttttttttcgtggcatttcatctcttgcttgcagcggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaaggtgggcataacatggagtgggactttctcctgaagttgatctcccttggggacccttcctatagagacagaatctgatctgggtgggactcctcattggt

SEQ ID NO: 87309 - DNA, 1048 bp, Homo sapiens
cctatacctaagttctccagggtgctttagtacctgggggtgggtagtgggagagaggacccagtagtgcccagtgggcattgcaggttctgtgtggagaccatttctctggtccttgcttaggaaagcttattcattgaaggagtaagtggctgctcactcctttctgctgaaactctttcctgtccttgtagcctagtgtggaatgggagcagggtcacagtgaaagagctgaatctccccacccacccacactgcagcaggctgcggctggccgacttgttaattgccgagcaggaacacagcaggtgagaaggaagcccaaggccccttataggtccaggtctctctacagactcaggttctgggctattcagctctgtgcctgggatagggagctccagctgctctcagtctcagcatttcctgactgttgaaattgattgacttgacttcgaagggctgccaggaaagaggaagagaagttaacgagtagcctgagcagtggggacagtggtggtgaggggctctgtcagctgtcagccgccctgtaacccatgtctctgaatgctgcagcctccatgcaggcccttctgattctcatgctacaatccctgagtccacccactttgggccctgtgcccatcaggacggcatgtggctatcctgttttcatagagcatggcttgcttaagatccagatgtctgaggacatgtctgtgccattgaggacaggctcatggatctccagaccttagggttcctatggctccagagttaagtccttctgctcttgctaggacaggttcttgattcattcattcagtggacccaggcttatcgagctctctcctaagaaggctcctcaacttctgcaggaggcatgtagagaggccacattcttctttttgtggaagtcggcttgaagggaccaaaggaagctgaaagaaggagcctgggcaacatagactttgacatgagactgagttgggcatgcaaccttaggtgaattcctgacatatttcttcctattttttttgcggggagg

SEQ ID NO: 87310 - DNA, 1033 bp, Homo sapiens
aatataaatgacgagttaatgggtacagcacaccaaaatggcacatgtatacatatgtaacctgcacgttgtgcacatgtaccctagaactttaattaaaagatcaggaattatgaactgtttatagtaattttgctataatttgtcatctttcagttaaagaattttgttatccaaaggagaacattttgttattaaaaagcattgtttttctacaattgccaatacatccaaacaggtaaaactaattaagagtgttttgttgtttcagaacaccgaaaagctttggaggatttcactcttgataatattctttctcatatttattattttcgctgtcgtgactacacagagttactggcacaagtttatcttcttccagatttcctttcagaacactcaaaggtatgagtcagactactgaaatgtaactaaccaagtattttttgaggtgtttgataagcatgaaaaaataaccagtacagtagcataaaatcaaagtcaaagccaattgagaaaatctcttccttccttgacctacaatttatttatatttatatttgttttgtgtatgtatatgtatatatagtttatgctcagagtaagaaattgaaataatatagaagtttcatttccagtaatagtggaatagctcctatcaaaccacattgtatagaaaggtatgaaatgaaaaataaaaacttccttgtgctactgttttctagtgcctctccccaaaggtgatcactattggccaggtgcagtggctcatacttgtaatcccagcacttagggaggccatggtgggaggatcatttgagcccagtagttcaaaaccagcctgggcaacatagtaagacattgtccccaccaaaaaaaaaattagccgtgtgtggtgtagctgtagtctcagctaccaagggctgggtggagcaggcctgaggtgggaggattgcttgagcccagcagttcaaggctacattgagctaccgtgccatcatgtatcacctttttttttttttttttttttttt

SEQ ID NO: 87311 - DNA, 1051 bp, Homo sapiens
tattctcttcattcacagtggttgataaatttctatctcaagaactttctttttttttgagacgaagtctcactatttcgcccaggctagagtgcagtggcacaatcttgtctcactgcaacctccgcctcccaggttcaagcgattctcctgcctcagcctccagagtagctgggactagaggtgtgtgccaccatgcccagctaatttttatatttttggtagagataggggtcaccatgttggccaggctggtcttgaactcctgacctcatgatctgcccacctcagcctcccaaagtgctgggattacaggtgtgagccactgcgcctggccctagaataaagtagctttcttattagttacttaaaaatatttctaagatcagtcttcaaatgttcttaaagcatatttgtatatatattttttatctttcagcctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccagatcatatgaagtgaatgggaaaaatacctaaatatgattctgtgaaagtttttctaaagcagtattctgcaattatattttaccctgttttcattttcagtaacattcagtagagatgattattatatttcacaaatgtggaaagctgatctcatgtggccagtctgaatttaccattcatactgttttcacccctttctttcccagttgcctataaaatcttaggaagaaacatatcatattcttattgtgtttttttttttttttttttttttggagatggattctcgctctgtagtccaggctggagtgcaatggcgcaatctctgctcactgcaacctccgcctcccaggttcaagcgattcatctgcctcagcctcccgagtagctgg

SEQ ID NO: 87312 - DNA, 1044 bp, Homo sapiens
aaatgttttacctatatgaatttttagtatatagttatggaatttactgggttgttttttaaatttacattaaaaatgatctgggccgggtgtggtggcacacgcctgtaatcccaacactttgggaggctgaggtgggtggatcacctgaggtcaggagtttgagaccagcctggccaatgtggcaaaaccctgtctctactaaaaatacaaaaattagccacgcatggtggcatacacctgtaaccccagctacgtgggaggctgaagcatgagaattgcttgaacctgggaggtgcaggttgcagtgagtcccgatcacaccactgcactccagcctgggtggggtaatggagtgaggctgtctcaaaaaaaaacccaaaaaacaaaaatgatctgaaaacctttattgtaatcttgttccattagagttccaaaagaaaaggatatcttctgtgtaattattaaactatctggatgtaggttcaacaaatgtaagaaatgaaaactttagagaataaggcaagaaccattagtctcattaatgtgtcatctgcaatacatttttagtcacagttaatataatttttttaccttttgtcagacagaatgaaaatattttcagtgaagtagggaggaggattagctgactaatagctagatataaaacattaagctagatgcttcacccacatcagttattcctacatgtcagaaagctgtaacacttagcatgaataacttcttatggttttgactttgagttggaagtgattatttctgaaaaatcagaattgcaaatatattttagagcagtcacatcagagaatatttgatacacctcaaataaaagcttatcactaatgcttgtcatttgaagagaatcactaggagtgactaacatgataataacatagcaagctgctttctttcatcatttctcttaaaatacttgaaagatcctgatacagaaagttttaaagttcggcaaatgtaataagcatagcaaatatcaaaagagagccaatactcatagcagtttgg

SEQ ID NO: 87313 - DNA, 1074 bp, Homo sapiens
aaataagagggtctctctctgttgcccaggctagagtggggtgatgtaatcacaactcactgcagcctcaaattcctggggtcaagcaatccttctgcttcagcctctcaagtagctgggatcacaggtgcatgccaccacacctgggtaatttaaaaaaaaattttttttgttgttaagatggggtctcactatattgctcaggctcatctcaaactcctggcctcaagtgatcctcccacctcagcctcccaaagtactgggattacaggcatgagctgccatgcctgtccctactgttagcatttttatgtaactgaaaaccaagggtgaatttaaaagagaaaagacaaagagcaaagacagcctgtggaggtatatagaagaaggaaactgaggccaatagacaatccaacattttgattgttttgagcaactccaatttttatttaagcactagctgccagagactatttcttccagccagcaattacctgcttgtatcactgcaacctatctggtctctgcagcagtataggcccccaaatgcagaccctgagatggatgtgtcctcatctgacatagccataacaggattacaaaacaatcaagtgaatttagaaactttgagggagaatggagtagggtgaaacgaataacatattaactatcaggatagttcccagataataatataaactattatatcattctttggcttgtatattactcttatgtagatctgcattgtcaagtacagtagctactaactacatgtggttacatttttctttttttttttttttgagatggagtttcactcttgttgtccaggctggagtgcaatggcacaatctcggctcaccacaacctccgcctcccaggttcaaggaattctcctgcctcagcctcccgagtagctgggattacaggtatgcaccaccatgcccagctaattttgtatttttagtagagacggggtttctccatgttagtcaggctggtctcgaaatcctgacctcaggtgatccactcgccttggcctcccaaagtgctgggattacagatgtgagc

SEQ ID NO: 87314 - DNA, 1053 bp, Homo sapiens
gatagtggtatttttattgggggagagctagctaacctacttgaaagaaaaattattctattttatagctccaaggaagatctgggcatggaatatcatgagtctttctgagcttcctcatgttttcactgtaccctttccaactattttgcctccatggcagagaacttcttatcctatttctcttcccacttccagtaagtgaggacaggctagtgcctattttgtgggaaggctcttgagcagagagaaatgaataaaactttggattaaacctgaatctgtgccacttctttgagtagtggtggcgtaaatgagacaatctagaaactctgtttcccggggatttgaactgttcattttccaaccctgaacagacaggagacaagctctgcattctgtatatctgctcccctgttgaacccaaattgaaagcagtgggaaactctccagcaccactccattcaggcaatgatgactgaactgattttttctccatcattaactcattaataagatttgctttctttggtgcaccaggaccaaacatctcaactggtagcaaaaactgggcactgtgaggtttgcttgcttctatttgtgtgagatctaggtagcctgggtcttccagcacgttgatttgggaccctgggctcaggctagttctatcagtgaatgaatccacacgcccatcatagcctaggtcggctggtgctgagcactggtgctgaggccaagggcgtttgcactctccatgattctccttatcatccccaccatcttcttgccctccttgaaaagagttctctgtccaatctgattcctcactaacatttacagctttgttcatgtccctcaggaataccacaataaccgtgatgttatcacttgacccagcatcacgagctgatgccactaatttgtgggcaaccatgctgctgtctccattattctctttcaggtggtcggacacaactttcactgcctcatcagggttcacggtgtcatagaagccatcacaggccagaatgaggtagtcttcggtcccatcca

SEQ ID NO: 87315 - DNA, 2111 bp, Homo sapiens
gctctcgctaagaagtgtcccccgcctaatcatgtgtttataggatagtacacgttccccaggcccataacagaggactaaaatctctgaattttaaagacacagatgactggcatattttggataccagtatagctatatcaaatagacaaaaacagcttcactttagcaatgatcagattgttaatctacagattttattttttaaaatttggatgtaagtagagactttcagtatttgttttctcttgattttgaagtcatttcttcttctcacgtctgtgacaaatggttgaaaaggagtcaacatggccccaactatagtgccggaaccttttcatcattctgaggctttgccccacacatggtcctcactcatatctgtcaccttctgaagcctagatcttgttaacccatcaggtgcagtgtcagtttcaaatcaaattatctaagaaaacaagaaaacaaaggcagcagactattggtacacattatagtccaaagtgcttagcgaagtaaaaaaaaaagctttttaaaatttctattgttgtctattggtaatgtttttgatcagaataaagagggtaaagggaaaaagttactacacatgctaggctttctcagtggggaaaaaaatggctggatagaactgggacaaacacagacccatctttaggggtctggattttgtaggtccgactacacagcagtgttaactcatttctcatgccattagctctctacaaaataaagcaaagtagttctagtgtggtcgttataaaccaatattgtgaaaaatagcaactattcatttgttcacaacatgcgtatttatagagtagttaggtaccatttgtaaggtaaatcctttaaaattctataatacatactaaaatagtggttattggtctgatatatgctgctcttggttctataaactagataaaagcagtgctttgtgaaatgcagtgttctctcttaacgccactggtgataggaagtagttcccttcagttcaaatcctgtgcccttatttgctgcttgctgacgtaagcaataagtaaccctctaactaatggtatctacatatttctgtaacttgtatttaatgatggtgtacctggtgattgtaaaaatattagacagatataaaagtatctatataatatctataaactgttaatgctgaggtatagtctgtgaattatgtgttttgtatttttattcattgtgtaatttagtggtggtgaaagttctacactcaatccttaaagagtggcagtatccctttttcaatttaacatggtctgcatcaatctgtttgcctgctaaacaagttagaataggaaatagtaaaataaatccaaacaagagtgtaatattggttagggaaacaaacttcaggtcaccaactgaagtcattacaaactccttgtacattcactgtgagtttcaaagggagtcagtccctaatttacaggtttcctttgttcactttctagatgtgtacttttgagggacatgaggttaggcaacattacagcaacacacactggggctattaatcccatttaggtctgtactaaagaggatgggtagaaacacatatgtatataccttttctttacctagaagtgccatccattgtccttgaattattatgattaaagttactgttgcatttaggaggctccttgaaagtaacaccttttccaaggacaatggcaacaatgtcaatgtcaacactgagtctaattttgaccacatttatagtggtatagtgtcaatactgcattttcatgacaaccacactccactgttgaaacactgtgccagtgagaagtgcaacatccagtgggcagatgaaaatgatgcatggccaagttcagtgtttacagataaaactgctgtggttcaagtgcttccttccccatcaaatccttgataaggctttgtgggaaaatgatctaaattattgttttaatttttaaacctaatttattcactcagtgaacattcttacctaagcaaggctataaaagggaatactacagttttgtccacactttaatttgagaccatttttctttgaatcgtaagttagcaaaaga

SEQ ID NO: 87316 - DNA, 1734 bp, Homo sapiens
ttagtccttggcaggtcgggttcctcttttcttttaggattataacaccactccctctcctcgcagttcagctaatgaagagaacatgtataaggctaaatacctctcttctggggtaaaataatgttacagcagcatttagcaaatcttctttttaaatgttccaagcttccaaacttaacgtccatctcaggattttattttccagttctgaagaaatctgcacaaatttaaacagtaaataacttacctttcctttaaataaaaagacaaatgactagtggtttttaaattgccaggttttattaagataattggcaaaatttcaacatacaccttacctgaatgaacacttttaataaaatatgaaggatcactcatgactacaactgaactcaaaagtgagatgtagagcagatttgtaaattgataaatttatttggtaagaaattattcacttcattcgcttcactccatagagaattctttgcagagaaatgttatgaacaagagaacaaagcctgtctctcaccaaagagcacctagagtaagagtttacaatgatgtatctggattatctaattcatcaaagtttatttccttttcaaaaacaactgctgtgtcagtctggagttccctatttcatgttttctaattattacaataaatagtcttcaaaatagaagataaaatgctgctttaagaagtaacagttatttttcaacaccataccatttgtctggaaaatcattgtgttgtaatactggtggtatcttactttgttttgcaagagacatttaagctatttgcagatcagaatagaagagtgggcatttgtcctttaacatcacgtgattttcaaaggtgaaaaaaatttcttttgctaacttacgattcaaagaaaaatggtctcaaattaaagtgtggacaaaactgtagtattcccttttatagccttgcttaggtaagaatgttcactgagtgaataaattaggtttaaaaattaaaacaataatttagatcattttcccacaaagccttatcaaggatttgatggggaaggaagcacttgaaccacagcagttttatctgtaaacactgaacttggccatgcatcattttcatctgcccactggatgttgcacttctcactggcacagtgtttcaacagtggagtgtggttgtcatgaaaatgcagtattgacactataccactataaatgtggtcaaaattagactcagtgttgacattgacattgttgccattgtccttggaaaaggtgttactttcaaggagcctcctaaatgcaacagtaactttaatcataataattcaaggacaatggatggcacttctaggtaaagaaaaggtatatacatatgtgtttctacccatcctctttagtacagacctaaatgggattaatagccccagtgtgtgttgctgtaatgttgcctaacctcatgtccctcaaaagtacacatctagaaagtgaacaaaggaaacctgtaaattagggactgactccctttgaaactcacagtgaatgtacaaggagtttgtaatgacttcagttggtgacctgaagtttgtttccctaaccaatattacactcttgtttggatttattttactatttcctattctaacttgtttagcaggcaaacagattgatgcagaccatgttaaattgaaaaagggatactgccactctttaaggattgagtgtagaa

SEQ ID NO: 87317 - DNA, 1971 bp, Homo sapiens
tttcgcattttttaatggcaagaaccaaaattacttttatgccaatctaatagtagttaggagttgtgcttggttcaagattggatttgctatgattatccttagtggtctcgagttcctgtgatgataccttgtatttctgattggtgttggataccagagcactgtgtttctgaccctgagtttccaggctcagaagctttgtgctgggtctccaagagggtctctctctctgcttccgttgctctgctgtcctcctcctggaaatactctgctgtttcttgaagtgtaacgggggctggggaggggctggcgttcttggattaggttgcagttttaggcactgtgtccctaggtttgggagggtctctgtttacttgccccttcccagctaattgtgggcccagtgatatttctgccccctcctctgggatggggcttttcttccatagtcccttctctctgctgcagtgacttttcaccagtgtccagacggcaacagtatttgtgctccttttccctcatagggtgcttttgttctgtgagatgagagaaagggtatggtaagttcctttacccatgcccaaggccgctgtatactcccctgggtgtgtgtcacagccgacacttcttagggctctttacagtattttctgagcccctggtagagattgtaaagaaaaagcctgcaagatagggcgactcccctagtttctgcaggcccccgggtcttaacactcctgcagcccatattctgccttcaccaatcatcacttttagctagcctattctttccagtgtctgtttacaacgaccctacgaaactagtgctaatgtcttctctccccttgcaggcaactgcccctctccatttggtgccacttggttactctgcaacctcagctttccaatggattcgaaaaaatgtcctaatttatagttcatctggctcgtttgcattgtaagagtagaagaaatgctccttctacccctacatcccggagtggaagctggaagtgctgtgatttaaaaatgtatatatgtaaaacacacattttattgaatgtaaaacatgagtgtaattaatcctaaaaccagaattcagaaaatgagccatttttaatttttttatctagttttttaaatgtttgaattataaaggtgataagattagaaaaatttgggaaatagaaaaccccaagagctattttcttttttgcatattcatttgaatttttatgtggtaatatttttagatttctcctcattctacctctcattctcacatctaccaatacatgccttcatagtctagatttatagaagttttagaactctgcttagggatgcttaagagcaaatggtaagattagccacagtgtagtttgggacatcagtagtacgggctgctctctttctaaaatccttttctctggctggcatgttgaccgggagtctcccttccattcctgctctgcagaccctgcgggccagagtccttgcccgagaccttcaggtcagtcagtgtctcctggtgtgcatttgggaaaggctgctgcataggctcacctcccactgggtttcatttgacctagtgaacccgtagcaactcgatttggcttaattggccacccctaatcctgtagctgtcatactactcaatgtaatgactagcagggacaactttttcatcatctttagttaaactccagttactcatttggaaaatggtttccccaaatgtgtatcattcttgacagtttttcacatttgtttccctggtcctaaagcaagattataaaaatcaaatagaacctgtgtgtgagggcccttgtttgcacaatgaggagaggacacacttcatctggaggttgcgtgactggggcagcatcctacagctcagcataagaggcaggctcaaccaactgcccagggaagagcgcttcttactaaacatattcaacagttggg

SEQ ID NO: 87318 - DNA, 1065 bp, Homo sapiens
tgctctttctgtaccctgatagagccctcagcatgtttttttatttttatttttgtaacctttccttttttgctgaagaacagtctgctgttaccttgcttctgtatttagtattttatctcaagttcattcctggaaaatctctcctgaatagagttttcttagggctagagatacattaatgcttgtgttgtctgtgaacgtgtcctttctggacaactttaactacttgtgtcattgatctttaagtaacctttgaggtagatgagttgtgtatcaaacctgtttggccatggagccttaggttcagggaggttgtatgattctcttcaggttcaaaaccactggcagggatggggtgaactgctggtctagtgccttttccactttatctcacttgcagcagacccaacattctgatacctaataatttaaaacctaaagattattctttttttttagcttttaattttgagataatttcaggtttgcaaaagagttgaaaaaattgtgcaagagtttccgtataccctctgcccagcttctccttttgttaatgccttacataatcacagaacagtgatcaaaactaagaagttaatcctggttgcaatattgtttaccaaactacagaatttgttcagatcgcaccagttatttcacaaatgttctttttctgttctaggatccggtctaggatcccacattgtattttgttaccatgtttcctcaggatccttcagtatatgacagctcttccgcctttccttgctttcatgaccttgatatttttgaagaggatgtgttattttattaaatgttcttcttatttgggtttgacagatgctttcctatattaaattgaggttatgcattattgggaaggcccttagtgcatcacatcaggggggatatgatgttgatatataaatatacatatatatacatacatacacacacacacacacacacacacacacatatatatatactttttttttttttttgatggagtctcactctgttgctcaggctagaatgcagtggcaccagcttggctcactg

SEQ ID NO: 87319 - DNA, 1078 bp, Homo sapiens
caactaatgaaaataaagaagaaaagggggctttaaaatatttgttgcactacagtcgtatagtaagaggcagaaaaaaatgaaagaattttaaataatcttacacgtgtctacagggccaggaacgtaatgaatccatgttaacttaatttcatttaaaattacatttgtagaagtcacacaacagaaagataccatgcggttgaacagtgtgcctgtacttgaacaagtgagagaagatacatactccaaaaaggagattcagtctagtgttacttcagttattcacatagtgtctacagggcagaatctcttccaaagcaattttctgttcactaatctacaggcactaatggaactgtaattaaaaccccaaatataaagatgattatttaaacacaactaagctctagccaaagacagtagagcaccaatgccgggcgggttactgacggcatgcagggcctggaggtacattttctggcagttaaccagccttctgctgtagtagacaaactgccttttgtgaatgtacaaatttgctaaattaatagagaactacattgttatttccttacattacaaagaactcttcccatactgtttttcccatgtactactgctgtcttagactaaactgtgccaccttccaacagtttccaaattactatttcaggtcgagataatgaagaaataagaccaaatctgattatctgactgatgacaaatttgagcaccaactacagcaaaattcagggtcaaggtagcttgcaagtcagttctcttgatttggcaattaccttccactattttcatctgtattgaagctgagatcttcagggcctatttgttcaccatcaggaaaactggaatgtgtatctatgattaaaaaataaataaaaaatttaaaatttaaaagcatataacaagggcagtattttccttcccaagtctttaaataatcttaccaaatgtgttatttaagtgataaagatgtgctgggttgtgaacaaatctctgtcttcagagaatttgtgatctgagtcaggtataagcaaacacaaaggaaaaataaagg

SEQ ID NO: 87320 - DNA, 1731 bp, Homo sapiens
tcttgctatttgtaaggatttgtagcagaaagattttcaggttttcttgattgctatcttgctgaaacaaatactttttatagaattattcttttaaaaatcaactgatgtggccaggcacagtgacctgtaatcccagcactgtaagaggctaaagtgggaggatctcttctcaagcccaggatttcaagaccagcctgggcaacatattatagcaagaccctgtccctccaaaaaatttttaaattagcagggcatggtgtcatgtacctgtggacctatctacttgggaggctaaggcggaagtatcccttgagcttaggagtttgaggctgcagtgagctatgatcaggccactgcagcccagcctagggtgacagagcgagaccctgtctctcaaaaaataaaaataaatacaaatcaaccgacatacacaaaaaaattagatgcccaattagaatacaaactattattagaattgccagaatttctaatattcatacaccatgtggatttgtataacacatttatatttatgttttaggctagggaatataattatgtctataatgaatcaggattaaaagagttcctgttatctcttgtgactgaaaaaaaaacagtgtttgatttggaaaaaagtattatcagtataataaaattaatgctggtttcaaataataactttcaggtactatggaaagggcaattttaaactttgagaacagaaataaaaccactctaaatagctaaagagaatcgaggtttgtgcggttacttttgtctttgttttgttagtgtttagtttgttgaattcttggcattccatgtaaaattcaataggaatctcagtttagcagatacggagatttctgtttccttttacttacagtggtttcttttcagaaacatgttctccttccttcctgccaggaatgagtagcgacagtgacattgaatgtgacactgagaatgaggagcaggaagagcataccagtgtgggcgggtttcacgactccttcatggtcatgacacagcccccggatgaaggtgcagcacatgatgtcattttacacagattactaaaaccaccgctgccgcttctctttcttcttcttctgctgctgctacttctactttttccgctctactgcttttgcttcttctgcttctacttctttttttttttttttaattattgtcatttgtgagacaacattctttggttaactattatggtgagtactaaaaaaacacagccagtaatatttggcttggttgcacctaatgagtgctacttactgggcagagacggggtccacaacctgcttttgtatagtctgtgacctgagaatggtttttactttgtaaagagtctttaaaaaccaagcaaaagaaacaaagaagaattttctttgtgggttttttttttctttttttttttttttgccccgagatggagtcttgttctgtcacccaggatggagtgctgtggcgtgatcttggctcactgcaacctccgcctcctgggttcaagcgattctcctgcctcagcctcctgagtagctgggattacaggtatacaccaccacgcctggctaatgtttttgtatttttagtagagatggagtttcaccatgttggccaggctggtctcgaactcttgacctcgtgatccacctgccttggcctcccaaagtcctggtattacaggcgtgagccaccgtgccc

SEQ ID NO: 87321 - DNA, 1022 bp, Homo sapiens
ccaagtctttgaaagaatggagttattcatgtaggatttagagttaaatggtcagtgttattcagtaacacattttatctttatatgtggggtgttgtgctataaatagcacctagaactcaataagaaaaattgctgtgaatgtgcaaatcaacagggacacagaagtacacccttgtaatttgttggtatctgaacagcttgtttacctccagagtcccaggatagactgtgagaaggagactaactgatgaggctgagagaaggtagtacaggagacaaaggaagccctgtgcctcctgtaatcagctttgtttctcgaggagagtgcggccttgctcactgttgccagtattattctatcatcagcaagagcaagttctcaggaaacccttatatacctataagccttagtagacagttgaatggatttgtcttgtatccatgcttaggaaaaacaagactctttattttagctgaatacaaaaagaagacattcggtgtcatatcactgtggggttctctctctttctcaaagagaaggttgtctggaggactttaaggcgttgtttgtggtactggctgggaatttgggactactaaagtgtctcttaattgctcttaagcatcagtttaaaaataacttttttcttagatatgaacataaataggccttttcctttttactggaaccatatgggacaacctttggttgtattagtcgctggtttaatgatctgatgctgaaaaggttgacttattttttctttcaattgatgacctgcacaactgtaggtaggccagtttatttcttgttctttgtaaaactaaaggctttgctctctgacttcttgctgaagtagcacatacccccttcagttaaatcaggggtactcaaaacaccatctggggaaaagccttggcatgcctgttaaaaaccttgctggtggcctctttaagaggaatacaaagcctgatggcctgccattgctgatcatttagggtaattattaagatgcctt

SEQ ID NO: 87322 - DNA, 1032 bp, Homo sapiens
aggcaggagaattgcttgaacccaggaggtggaggttgtagtgagccaagatcgctccattgcactccagcctgggcaacaagagcaagactccatctgggggaaaaaaaaaaaagattctgctctacaagcaacaagatgggaatgttttatgacaaaagtctaaaccaattggggctacagaatgttgtttatttttagacagtagagagaacagcttccatgcaaggtaagattaaaactttttctgacagactaaatagtgagttttgtgctgtagtagcctattcagaggtgttcttaaatgtctttgcagccacaaataagaagagtaattcgcccaagccagctcgatccagtgtagcaggtagtctatcacttcgaagagcagtggaccctggagaaaatagtcgttcaaagggagactgtcagactctgtctgaaggtaaatttgagggattcagaatgtacttttagtggggtaaatatttattacctgaaattgatgttatcgtggagctttagatcttgaagggcaccaaaaatgctaaagttggatttgaaagtttctttttttgaaacagggtctcactttgtcacccaggctggagtgcagtggtgcgatcttggctcaccgtggcctcgaccggtggtttaagagatcctcctgcctcagccccaccaagtagctgggactacaggtgtgcaccactacgcctagctaatttttgtattttttgtagagacaggttgcccaggctggtcttaaactcctgagctcaagcaatccgcctgcctcaacctcccaaagtgctcggattacaggaatgagccccaccacacctggctggaaagtttcttgatctcaacagaacagacccttaacaaaatacagccattagactatgtattctaaacaccttaattttatttattctttatttttgttgttttcctgagacagagtcttgctctgttttccaggctagggatgcagtggtgcaatcatagctcactgtagccttgacctcc

SEQ ID NO: 87323 - DNA, 1215 bp, Homo sapiens
ctctcacctcagcctcctgaagtgctgggattacaggcataagccactgcacctggccagaaatatgtatttttaatataatgttatatatggcagatttgacaaagtatttggtttctagatttttctttgtcttttttttcaattataaacataataaaagctctgtagaaagtttcagaaaagtggagaagtttaaagaagaaagcacaaggcagtagggcagcttttaaacttttagaattaaatgtgtaattcgaacttgagtatgatgtgactcagattctaactctgaaggtgtgaataaggtaggattctttatctttattttcattaatggaatttagtgcatgttttattgttgataccacgtaaagcacgctagcttattttacacatcaaatttgcatatattcatggtacaaatgatttcattaatattaacgtttatgttaacatgacttgtcaatttctctgaagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactgtaagtaatatgttcccagtgtcatttctccacacgttatttgggaaactagatgactggttttttcaaaagaataatatttaaataccactcttccagtgagttaagactacaaattacatgtgacttttttcttcatccaaaattgattccgtatatttttactatataatagaactaacatttcttgattgcttactctgtatttggcaataaacaagacaaaattcttaacatcatagatcttgtattctagtagtgggaatcagacattaaaaagtgtagacaagtaagtaaagatcatttcagtgggtaaaaggtgctgtgaaggaaacaaccgaggagtgggatgggaggagcagatgagacatgttctattggggtagtcagagaaagtctctgtgaggaggcagcacttgacctgag

SEQ ID NO: 87324 - DNA, 1868 bp, Homo sapiens
ttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccctggttccttctttctgcttcttatcatgaacctgaactcctaagagataggtccatagacaagtattcatataatgttaaccagttcattttttcatttaagtatagctaagtttgtgcatatatatatcattttctacgcctcttttgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacaggtaaaataataacaatgataatttcctttttttctgtggttctctaaaagaactcttggattttcatttaagtatttcagctatgtgtggaacatggtgtatttctgtgtttttcattgtataccataaaaatgacatttatgtcaaccaaattagtttttaaattaccgttcaaaggtgatttgtgcaaaaacaaagtaaaaatgcctgcaagaaggttttttgtgacttgctactcagattttgcctgacagtttgatccatatgaaatacggttatcttctttatgaatggactttttttggtcaggcttcatgaattcccttacttccaagtggaactatatctaaattgaacgtagaaaaaggtgacttactcattctttgatgttcagtagcttaaaaatgtatgccagttggcagcactgttttctgtgcaaaggttatttgttaaatagaaattacatttgtgttactataataaaatggagatttgtatagtcaaatatgggcttttttaaactctcggggatagagtcattttggacaactaagtatttgcctttaaaagctacattttaaaaaccatttttgttggaatgctttctaaagtatagtcagtatattcaaaaatatatgccaaatatttttctaccttcttaaacaatagtattatatacatcaaatcaatgatttagaactctgattttgatgtagttttaaggcaagataactcatttttcaatcaaagtccaaggcagaacctctgtgtaaataacagagaaatagagctcttctactggtgtagggacatggagcccagattatttaggcttcttctttcctaagagccagatatacttcctgaaagtctggatcctcagcttaaaagactatcttcaggttatgaaacagttgccttttatgtgtgcgccaagtatgctttatataaagttttacttaaatgttaagtgttgtttgcaaaggcccagtgaaacagacaggttctgattctgtaggtagatatgtaagttggtttaacctttttgaaggacaattttgtagtagtttaaaaatatctatatcctttaaacttgtaatttcactttgaggagtatattccaaagagaaaacaagcagatgtttaaaaatattcaacaatacagttatagctgaataaattacagtgtaaccatgcaatggtatattttatagacaagt

SEQ ID NO: 87325 - DNA, 1071 bp, Homo sapiens
ggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcttgatctcctgacctcatgatccacccgcctcggcctcccaaagtgctgggattacaggcgtgagccaccgcgcccggcctggcatattcttaatatgctgggataactaaagatttcttaaatactagtcctcaccatttcaactccaacctaagctctatattctttctactcctgactttaatcctgggtaatcttatccacacctgtatttcagttactgtctatatgctgattacttttcaagttctttctttagcctttgtctttccatagtttccaaacccatgtcttggtgtgtgattcagcacttcccaaacacaaattactgtcttttcatctgccagcctgcctgtcagcagtagccaccgtgactgataatgctatacattctttacttcttcctctccctaaaactttacctttagtgtattaccaagatctgttggttctgtgtcctaaatcgtgcataaattcatttggtactcccactcctttgccatttctagtctaggcctctgtctttcacctgggttccttgtatttattattgttcccctccattgtatttttacagcatggattcagaatgagggtgtttttttctttctgattaatatctaatcatgttacttctctaccagtcttggtgactcacgcctgtaatctcagcactttgggaggctgatgtgggtgcatcgcttgagtccaggagtttgagaccagcctgggcaacgtggtgaaaccttgtctctacaaaaaaatacaaaaaaattagccagatgtggtggctaaattgctgcctgtggtcccagctatttgggaagctgaggtgggaggatcacctgagcccaggaagcggagcctgcagtaagctgagatagcaccactgtactccagcctgggcaacagagtgagac

SEQ ID NO: 87326 - DNA, 1075 bp, Homo sapiens
agaactggctgattttttttttttttttgagatggagtctcgctctgtcgcccaggctggagtgcagttgtgcaatcttggctcactgcaagcttgcctcctgggttcacgccattctcctgattcagcctcctgagtagctgggactacaggtgcctgccaccacacccagctaattttttgtatttttagtagagacagggtttcaccgtgttagccaggatggtctcgatctcctgacctcgtgatccgcctgcctcagcctcccaaagtgctgggattacaggcatgagccaccgcgcccggccgatattttttaaaggttgtttaaacaataacattaacgctacttaaatttggaaaatgacaaaaatctttctcctttttgtatttagaaatatcttatttcacagaaaaatctgcatatcataaaatttattgaggtgtgaaaaacaacgtttattgtatcactctatataaatgatggattttgtatattcttaggtctggagaaaatgatgtggaatataacaacatggaattagaagagggagaactcatggaagatgcagctgctgcaggacccgcaggtaatgaggtcactccactgcctccaagccattctgttttctctctgctcttctctgactgtattatattttaaataggtggtagccactgcttgtacatggttcatggtgttggaagtggtatatcttataatatggattttttagagtttattactaaagatatttaaaacaatagctaacatttgaaaaatgttttatgtaccaggcactgtgagaagcactttaagtaccttatattaataaaattctgtgtgatacattcactgatgcatagagaaattaaagcaacttgccaacttttaacaatttagtaaatgagagtaattgaatccccagatttgtttgtatcccatgctcatattttatactattctttctgatataaagtcttatttgtatatcttgctagactatagaatgatctcagtggaatcattgactcttagacttacgaaggatcttaaagagctcattttatagtt

SEQ ID NO: 87327 - DNA, 1020 bp, Homo sapiens
tttttgcttaatagtgggtattttttttctgtgcagataggtgacagtgttaattaatgaccttgataatggtaaaattaggtagaattgaggagtgatggtttgaaacgttactctgtgaggaagctgatgtggaatatgtgaaggattccagtcacactgagggcccagctgaaggcggcacgcataagttagtaaaatgatatcagtcagtgtggttgtgtgatttttctctacagggctcagcagctgaggcacaggagcagaaaatagatttttgaaaactgtattattctttggtgcttggtttatgggctggatggggtgatcaactgagtagaaacatttggaatagacgtcttgttttcttggcattgatctagcacgagctttcagatggagatctggatctggatcttgtttatgaggatgaagtaaatcagctcgatggcagcagttcctctgctagttccacagcaacaagtaatacagaagaaaatgatattgatgaagaaactatgtgagtttcccactttactactgtaaagcatttaagtggtaattattagaagcatattaactaactcacacttaaatgtagggatattcagcacttttttgaaagattgaatcaatagtcagttttctctctctaatctctgggctcttagccaataatttttgtttgtgttttaacttttaaatttgaattttgaaattattttatacttaagaaaagttcagaatttcatgtttccttcacacagattcattccctatgaatattttgctttatatttctctgtatataattttttctgaaacacttgagatcgaatatacttctcattgtgtacttttctaaaaacaaggatattcttacataactatagaatagttatcaaaatctggaaattaacattgatgtaatactgtaaccttctaaaaatttgccagtaatgtcctttgtcaggatcatgttgcatttaattgttaaatcgatttagttatcttcaatct

SEQ ID NO: 87328 - DNA, 1059 bp, Homo sapiens
gcataaatggggcagtttatctttgtcatcaatttttttttataaataaaaggcagtagggattcagagaaatggtttaagaaatggtgccaagtgaggtggctcattcctgtaatcccagcatgttgggaggccgaggccagaggaacatttgagcccaggggttcaaaaccagcttgagcaacatagcaagataccgtctctaaaaataaataaaaatgaaattagccaagcatggtggcacacacctccagtcccagccacttgagaggctgaggcagtaggatcgtttgagcccagtagttcaaggcttgcagtgagctatgatggcaccactgcacttcagcctgggcaacagagtgagaccattctcaaaaaataaataaagcaatggttttagaaacatctggatgcatttttttttcacttgagacatcttttactgtgccagtgagctgtggctaatatttgtgcttttcttgttttaaaagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatgtaataatgaggccagttttagatttttgtgtttgattaaaaaaaaacagtagcatcatggcttttaacatattatgtgctaaaacagtaggctaaaaatattgtccattgatttccattagtaatgtatgtatgcccttatgtaaatgttaataagtcagaagttgttgaatcaaagcatttcaaggttgtgaaaaaaacaatacattgtataaaacaaaccgtgatacacattttaaaacctaaactaccatacattgtggattttaaaaatgtgttctggccgggtgcggtggctcacacctgtaatcccagcactttgggaggccaaggtgggtggatcacatgaggt

SEQ ID NO: 87329 - DNA, 1051 bp, Homo sapiens
gtgtggtggctcacgcctgcaatcccagcacactgggaggccaaggtgggtggatcacctgaggtcaggagttcaagaccagcctggccaacatgaacccccgtctccactaaaaatacaaaattagctaagcatggtacacgcctgtaatctcagctactctgtaggccgaggcaggagaatcacttgaacctggagtcagaggatgcagtgagctgaaattgcaccattgcactccagcctgggcaacaagagtgaaactccatcttaaataaataaaaaaaccccaaaatactgctgtttttataaatgataaaagaaatgtaactgcgtatatcaataaggtttcttctcaggtaattacttagtgaccttaatgtttagatgagtttgttttttattcttactttactaactgtatagtaatggtctgtttttcaattttagatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtaacaggaaaaatttgatgttgtggtttttattgtggggaaataatatcatcagaactatatttcaaagatcatttggttaacaaagatgaatattgaaattcatactaactataaccttatcacctttttttttttttttttttttttttttttttggagacatagtctcgctctgtcgccctggcgcgatctcggctcactacaagctccgcctcccgggttcacgccattctcctgcctcagcctcccgagtagctgggactacaggcgcccgccaccacgcctggctaattttttactatttttagtagagacggggtttcactgttttagccaggatggtctcgatctcctgacctcgtgatccgcccgcctcggcctcccaaagtgctgggattacaggcgtgagccaccgtgcccg

SEQ ID NO: 87330 - DNA, 1060 bp, Homo sapiens
aatttatccctcttcccatttaatttgtcttttcttagggttacttttgtggctaaaacatagtctctttgaggtttttcccacacgtattaaggtttagtgtactcttgttcttcaatattaaaagatgattatactgcagagaagcgaggaagaaacattctgggttttgttttatttttaatggtgaagactgcttgttgaagcattaattaattttgggagacttggtgatacattccttttcccttaaatgtcacaattttgagggttttttttcccctgaaacttaaaagatattgctgaatatttcagtatctttaaattttctttatttcaggatgtaagcatatctaaacttttacagtggaattttgacctgttcagtcaccttgttatttgtctaggatttcaagtatgtaacaaagaaactggttggtctttctttttgcctgttgccatttcacaacagttttgatcttgggatttggttggttttctttttcgttagcactttgcgtcagagagcagatcctgtttacagtccacctcttcaagtttcaggactttgctggaggttaaaagtttacccagtaagtttttcatatttctaataaattttgaaaccaaggtctttctttcagagttctgtagtatactaatttgattactgagaactgttaactcttcttttttttgttacatatgctgtccgcattccctgttccccttcttcccccatattagacaactgtttgtttgtccacaccttgttctctaatacattctgctggaaggcctattggaaacaatgttccctgagttctcatatgttgaaaacagtttttgccttttatattctaaggctagtattgctggatataaaatccttggctcatattttctttcattgggtatcttcaatatgcaattccattttctttaggaaaagtctgataataaactaattttctttacctttaaagatgtttggtgatattgcctagatgctaaataatctttttgagtccagtaatttactattacacattttagccct

SEQ ID NO: 87331 - DNA, 1032 bp, Homo sapiens
atttcaaaaacatgtcaaatttgaaggctatactgggaagactcccttagagctcttactaggtttatggttccagaaaggcttcctaggcactaattgcattggtcctgctaattggagtttgtgtatgttgagtgctaggagatcatataatgggaagaccttagagcaaacctccaagagtatgtgacttctaatctgttatctgaagaaatagtaagggttaaccaggcaaaaggatatggggatgaggaatgtgagtcttctaagaaggataacaactgactagggatatcataggaattcttgacatagtcaatttggatagtagctatacagttaatcacagggcaaagtacatctgcttactgtgtaaaagacgtgacctatttagctatacgtacttacattgaaataaagaattatttgtctatattgtattgcaagccactaatttctttagacactatcatagtgtggcagtgctatagatgtatattttatcttgttttgataataaccaaaattatgatgaattgaactttagaaaatatatctgaagatgtggtgaaatggtttgcagtttattgttttgggaaatttgtaattttatatatcaaatttataacactattaaaacatcgtatgatagtctttttcatagtatagtgttttaatgagttttgaggtgttctaatgaaagtgtacaaaccatccacatgattaaaggtagttagcagcaaagtgacttttagtccattctgtgattataatacagttctctctgaagaagattggatgggactaaagttgcttgaagtagttttgacttgccaagaaagtgtgagtgtgctagtccatcacagttgccccttaggtgatgaggtattcatcctataaaaatgtgtagatttatttgctagtaaatagtttcaaagtatttgaggtctgttaatatttcccataatccattccagagtaggaagtttggggattaattgtgttatcactgactgttgtttcattttttaa

SEQ ID NO: 87332 - DNA, 1007 bp, Homo sapiens
tgaaagtgcaatatttaacattactgtttagatattgtttaggtcaaacagctttagtgagctatttataatgttatttctgtgaaaaaatgtgataagcccccaagaatgaaatactaagcatgtttttagaatacattttgtttcaagttgttagaatgacagtcataaatgaggtttatggaccatttcctaacttaaaatgaagtttgtggaccatatcctaaattaaaagcagatgtcttctttgttttacctctttaggaatcaagaaccaagtgatcatttataacattctttatgcagaaaatttgtgtttttgattgcatgtctgccattttgaaatataagcaagttgggtcatttccatttgaccttcctctaactacctttttcatattatctattcttggcaatattataatgtggtgcttctgtttttaaaatttacccaattaaaattattcttacctctttatcttctaggaaaggaatgtagaagctgtaagaaatgcaaaagatgagcgtgttcgggaaattaggaatgcagtggagatgatgattgcacggttagacacacagctgaagaataagcttataacactgatgggtaagtgtttatgtatgctgctggggtacctggtgctttcagcttctttgagattcagtctttgaagaataagggtgatcatcctaggaaggaatcttgagattttaggcaactccatgttgttacaatttagacagataaatgttagacttgtatttagaaatgataggagagaaaaattttcatagccatttggatgaaaatccaagttttcatagccatttggatgaaaatcctaatggccagtgggcatcattgttaggtagctttttctccaaatctaacagaattccttctactaatgttccatatcctttccatccattttcattggggatgaagaaactgacatttgtaaacatcggcgtcatcccctgccagcattttcttagagatt

SEQ ID NO: 87333 - DNA, 1091 bp, Homo sapiens
agttcaagtgatctgccctcctcagcgtcccaaagtactgggattagaggcatgagccaccacccctggctaataattattttttaataagagggagtaatttttgtaaagtcctggtggaaagaagtttgaggacatggaagaagactagtttgccttagagaagagtgactgactgataaggttgtggcagatgatttgggctgtggttaaagatcttggttctttttaataagttaatttctagttaaatgaatattttgctaaagccctttatttataatcttgaaagagttcctacttggaccaagtgattttaagcgggcactggcctgcttcaacaaaattaaattagctaataaggtaaagttcatttgagagatttaccagtttattagtgtccatagagtgttacaaaggaatgtaaatgcagatgagatatgtgaaagtgttctaaagctactctaatttaaatagcatggcggacatacctttaaacctttggcagaaatttatgagcaacacgtcactaaagtgaatgaagaggtagccaaacttcgtcggcgtctcatggaactgatcagcttagttcaagaagtggtaagactactactaaaatataattattttgtttttaatctgtaatatataataatatatttatataatataagttaatcagatgttgaaatcaaggttttcaagatttgcaaatttgataggctgtacctatagtcaaattccataaatttcagagtatctgagaaatttgcatacaaagcccctggcttgtaaggaagcagttggagtcagagaattaccacttatgcagaattagaaaatcagtgaatttaaaaagtctgtttgttacagagtcaataattaacttattttttcttttttttgagatggagtttcactcttgtcgcccaggctggagtgtaatggcgcgatctcagctcactacaacctccacctcccgggctcaagtgattcttttgcctcaccctcccaagtagctgggattacaggtgcccaccaccacgcccagctaatttttgtatttttagtagagacagggtttcaccata

SEQ ID NO: 87334 - DNA, 1002 bp, Homo sapiens
attttccatgagggtctagtattaaatcgtgcagttaatcatgtgtcttgattattgttatcgttgaccacatgtaggaaaagtacttgtgcatgctcatgtaggtatagatgcataatcaatatgattattaagcacatgcccaaaatgtagtagtacaatagaatatatcatctgtagtgctgtgtggaaatgatgcaatatgtgttatgtttttaagaagcaaatctgtatttcgcatgtgattataaagtccagatcaatgaaaacagtactttacaaaaaattgtccgcataaacttctttagcttccttttcagaagccatggagtacattttatactgtgtttcttgagatataatcatttaaaactgacctgtttgcccaagcttaagaatttgtggaggtgattatgttccaatttaatttataacttcattttcttttcataatgtatagatgtgaaaatcaccatgaaaaacttagtgtattttgctggacttgtaagaagtgtatctgccatcagtgtgcactttggggaggaatggtgagcagaacaaattcagtattttttttaagttagaggctagaaggcactgaaatacttattcagatagaaaatagtgtcattatgctctcgtagaatgaaagttaaaatgcatctgctttctatacgctttattaaaggtattgtacttttattccagaagaatcttgtttgtgtggtttgatggaccccttatgtaaatattttaatctgtaacacctataaaacatatcctctattcatttgcagatcttttcgttgtaggatctaggtcacttttttcattaaaggtcagttgatcagatgtactggccaacatttccaattttagttcctttaaaatggagcacgaacttagacacttgtgaaacaacatgagtacgcctatctagatcttataattattttttattttttagattattttttccaattgaattcaagagcagttttt

SEQ ID NO: 87335 - DNA, 1096 bp, Homo sapiens
cccaggctagagtgcagtggcaggatctcggctcactgcaacctctgcctccttggttcaagcaattctcctgcctcagcctcccgagtagctgggattatgggcgcctgccaccatcaccatgcctggctaatttttgtgtttttagtagagacggggtttcaccatgttggccaggctggtctccatcagctgacctcaggtgatctgcccaccttggcctcccaaattgctgggattacaggcgtgagacaccgtgcccagccctgtgaaactgttttaagacttaaaagttgtgctgtattgcttattcatttttttcggtttaatttacatgtctataatgtatgtaactcagaattagcttccttttttttttcgaattagcttttcaaaaaataaatttagtagtaaactagatagaaataaatcatcactgtggtttatttttgagtgcaaaggagacagtgccattattataagacaataataagattatatagacgttccctgtgagaatcagttagtcctgaaatcattgcttttcctgtgtgagagtagccttttaacagctattttgtgttgagttttgtcccttcaaaagtttatccctatgaggatgacagtgagggaaacagtagattgcctgttacttttataagtatctctaaaactaagcactagagagttaaacccattagatttgtagtattttatatatataaatattatataatatattatacattattatacattatatatatattatatatataatgtataatatattatacattatatatattatatatataatgtataatatattatacattattatacattatacattatatatatatgatatgttatataataatatattatatattatatattatgaatattatatatttatatattatatatattaagaatattatatatattatatataaatataaaatattaagtaatatatatatatagtaatgatgttttctaatcgatatctaatcttttgcccccttagcgctggctgacagagcagagagctcaatgtcctcattgccggtaagtgtttccttacgat

SEQ ID NO: 87336 - DNA, 1048 bp, Homo sapiens
ttagattgtggaatacaagataaaaataccacaaatattcagagaatgtaaaactcactatagcctgggaaaggcaggaaattttatggacatgatccagtgacatttctatgagacgggatatggagggagggaccatataagcaaatgcacagatatatcgacagtgttatatagtgcagcagtaagcctgttttgactgggagggagggagacatttaaaatacgatctggttactccctatcatagtcccagtctttataagttttatagtctagcagggcaaaggagaccaacaaataagtcgtcgtaataaagtatctgaagggggaagtgtaggttgctgtggtagagcatggcaattgtatctaaaatagtctgcagagtgtcagggaaagctttttggagaaagcaacttatgaactgaaatctaaacaatgagtaggagtaacccagatgaagaaaggttttgaagaatatcttaggcagagagaggaaacatgtaaagacattaccttgctgggttatagggccagttctggagaggagttcatgagaccagttctggagaggagctgtgactttaacagaagagtggcatggtcatgccattgtttcaggggaagaaacctgacccaaatttcgtttttgcctagggaccaaggtaataataatgttcaaggttattaagaatggaggaatccttttccataggctttttattttatttttattttattttttgagacagaatcatgctctgttacacaggctgtagtgccgtggcgctgtctcggctccctgcagcctccacctcctgggttcaagcagttctcctgcctcagcctcctgagtagctgggactacatgctcatgccaccacacctggctcaatttgtatttttagtagagacgggatttcactatgttggccaggctggtctcgaactcctgacctcgtgatccacccgcctcagcctcccaaagtgctgggattacaggcgtgctctgtatgctttttctttcagctttattttctttgctctg

SEQ ID NO: 87337 - DNA, 1081 bp, Homo sapiens
cactgcactccagcctggcgacagagcgagacttcgtctcaaaaaaaaaaaaaatttctgtttccttattcttgcctaaggaagatacatatgcctttgtcaagagtattatccgtaacacttaaataatttttttctagtcacacagctcacaattgatggtactggatttgaacccattaagttcaagaactctatagcctgttctttgtcactgtaccatgcgcagaagacccagttaaatatgatgttagttctcatacttctaaaactaagagattcactctttcttggccttctttcttcagctgtagaattcagatatgatttgctttacagggtggttatggcattaaatgagataacctaaggagtaattcagaaattatgaaatactatatctacttgtttgtaaggtgttattttattgttaaaatagcaactaatacacattaacacttacccatgttttaataaacagtgaaactgatgctagataaattaagtaattggactccgttatagttaattaagtggtagaatctggatctgggcgcatttcttttgatgaaggtcccatgtgcttatggtctctggttgttaccttatgcctcattgattctgtattttttcattgttacatcttcttcctcctgccccttaaatgcatttatttcttaatttcctaagatcttgttgctgtcgttctctactctgaggtttctgggagtattcacctactttgggaaatttgatttactttagcagctttagctatcatctctgtgtgtatggctcctaaatctattccttcagcactgacttttggatgtcttgtccttctagcatcttgaactttgttcaagatcagattattcatattattttctcaaaccgattctaagttcattctttttgttctgttctgctagtcactcaaactggaaactttataccaatgatttttttattttttattttttatttttttttgagatggattcttgctctgttgcccaggctaaagtgcagtggcgtgatcttgggtcactacgacctccgcctcccaggttcaagagat

SEQ ID NO: 87338 - DNA, 1038 bp, Homo sapiens
tataagggacttgagcatctgtggattttgttatcctggaatcaatctcccacagatactgagggttgactgtacttttagaatatggcatccaaacatgacttctttggttctgctataatccttaaattgtttgatttcttggtcttgtttcttcaacttaattgcaagttctttagaagctcaaacatcataggaccttgtatataaatagccaagtatctgttttttcccttgcctttctaaatctgtgattacatacatagtataagcttagggaaacatttattggtgtgacaatgcagaagttaactaaactgatttaagtctttgaaagtttttgaaataaagattttatcatttattttctagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgc

SEQ ID NO: 87339 - DNA, 1008 bp, Homo sapiens
tagaactcctggcttcaagcaatcctcccacttcagcctcctgagtagcttggactacaggggtgtggcatgcccagtgaactgacgagttttgacaaatgtatacagtcatgtaaccaccaccacagccaggatatagaacatttctgttactttacaaaaagctcctttgtggccaggcatggtggtgcacctgtagacctagctactcgggtggctgaggtgggaagatcactcgagcccagtagttccagaccaggctgagcaacagagtgagacccctacattcctttgtgcctctttgtggtcaacctcttcttccccaagtccctggcaaccactgatctctagtttaacttttcctagaatttcatataaatggaatcatacattatacagtcttttgtgtctggcttcttgcacttagcataatgctttgagattcatccatgttgtatattagcagttggacagtttttattgctgagtagtattcattgtatagaatatcacaaactctttatccaccaacttatagacatcgggtcatttccacgttttgcatattatgaataaaatggctgtggttggtctcgaattcttgagctcaagtgatcctcctgtgttgccctcccaaatgtctttgtttaattttttttttagcaatatttttttctttttctttagagacagggtctcatactgtcacccaggctggagtgcggtggtgtgatcatagcttactgtaccatcaaactcctaggctcaagcaatcccacctcagcttgctgagtagctggaactacaggtgtgcatcaccatacctggctagttgaaaaatttttttgtagagatgaagtctcactatgttgccaggctggttctctaactcctgggctcaaatgatcttcccacttcagtctcccaaagtgctggggttctgggagtgagtcgccatgagtatgtctttgtgtggacgtaatgttttcatttcttttgagtaaatac

SEQ ID NO: 87340 - DNA, 1412 bp, Homo sapiens
tgttgttatgacagcccttagtaaactcaagataaaaagctgtaagatggtaagtgcttttgtgttttctttgtttagtggtttagattccagagtgatagattgagtatgtagagattgagaaacttattattttacttttcatttgttttctttgatacttttattcaaagggcttgttttacatggcgtttaatcagtaaattgccttgaagaaggagctaaccaacatctctgcagagaacaaaaatatttttcacaactttgccttagtagtaattataactggttttgttaataccaatcctaaagtattaacaatacccattctaattactattaaggcttagggcatatttacaaaattcctttctacatctatgcatgtttctgttcgaatgttaatttgtatattagtcatcaataagcaacatcactttgatatttaagtcttatccttttttaaaaaaacattgatataaatgttttttggttttggatgtttttctgtccaaaatggcaaccctactttaaattcgtttctcactgaagcttcaaccgatgcaagatgcttttgtgttcctttcctacttattactgctaacgaatgctctgactttattgcactactgtactttacagctagcagtgcaatagtattgtcaaagcatctgaaagcaggatgcacgccagaattttgattcttaccttacatctttcttcggtatcagtaaataatttaccacaacctttgttgctgagaactataatgttgttactaacagtatatcttttagaaagtcataatttgaaaaaaaaaaaccttttaactaattaaaaacaatattttactgcattatgaaacacgtctggagaatattttttatatctaagttgttatggtttgtctaaatgagtaatactttataatttgttgctttctgttacatatttggataggttctgtcaaactttaggttttatttgagttttatgatgaattggtagtgatggaaacaatttctgctgtatatttttcctgcagttacttgccccaagtcatttttttttctccagagacagagtctttctctgttgcccaggctggagtgcagtggcccagttacacctcactgcagccttgtactcccgggcttagataatcctccctcctcagcctcctaagtagctgggaccacaggcgtgtcctaccatgcctggctaatattttcttgaaattttttgtggagacagggtctcactgtgttgccgaggttggtcttgaactcctgggctcaaacagtcctcttgccttggcctcccagagtgctgggattataggtgtgagccactgtgcctagtcctccaaatcttaattggtgttaattttgtgtattgtctaggaaatggtt

SEQ ID NO: 87341 - DNA, 1366 bp, Homo sapiens
gattggctgagatagcacagagctccagccaatcagagctgaggcgcttctggtatgaataaggagaaggcgggagagaaggggaaggaaagccggaggggaaagaaggtgtgttacgtcccctctgctgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcgggtaaggggttacatccgggaaactcgtcagggaaatggcgggagatgctgagggtgcggggcctttggaattccttgttccttgccctcacctttacaccccttacgaaactgcgccgggtgcagaccgcattctgtgtttgtaccaaaaaagatgtgaatggaacggtccctaagcgtcccaagaagggagaggtggttcacactccaagaaaggggaacggagggtggggtggggaataaactgacgggggcgaggagaaatccctgtagggccaacccgctcacgttctaaaaggcgggccgagaaagtctgagaaaggatgctagacttgtatgcacaacttcctaacggccaaggaacccgtttctgtttgatccggaggtggcaaaccgtgggtgagggaagaggtgtgagcgaaggggatcgtaaccacgagctccgctcccggagcgcgggcgggattgagacaggaaaggcatcctgctctggagttgtgcactttcattcatctgtgaaagtagaaaacgggggcgaagaattggaaagcactcccgttgttgctggcgtgtttggcctgctcggggggcgcccagctggggggctgtcctagttttctttaaggatccgtccctcacttgttctctttattccctccctcccatccttagattac

SEQ ID NO: 87342 - DNA, 1038 bp, Homo sapiens
cattgaccacatacatgctctttttgcttttaacaatataggctcatgcctataatcccagcactttgggagaccaaggtgggaggatcacctgagcccaggagttcaggaccagcatggggaatatggcaagacctcatctcaatttgtatacaattggggtcgggggtgctggagggagaagtcatttcatttcaagttaagtttttgatgtttttattttagtagttttggatttcccaacaaaatgtatatattaggaaatgatttaattaggcaattttatctcccaacccttagtctgaagaggtagagacatcctttgaagctctggaataaaaattgggtagcatactggatatatcttacacaaactcagcactcagatatttgccgtttttgcatgtttacattttgagtgatattttaaaatttgttttaataatgtctcattttataattaaagcttataccatcgccgaaagcacggaatccactagttaccgtctctgacttgcagcatgttaccctgaaacctaactccaaagtgttatcgactcgagttacaaacgtcttaatgtaaggaactgcacagtactatgctctactactacttaaaagaatgatattgttgtacaaaggcctaaagaaaaggaaaaaaagattttttgtgtgtatttctaatgttaaaagttatatatgctcattatagaaaaactgaaatctacagaaaagtttaaaaaagaaaacaaaaattatctaaataatcctatcactggagatagccactgttaacatactgctgtttatcattctagtctttttctgggcatatggtttattgccccatttaaagatgctgtttattataagatatggcattgatttaataacagattttgggagaaaaagatatactatcaagaattttaggctgggagtggtgggttatgtctgtaatcccaccactttgggaagctgaagtaggaggattgcttgaggccgggagtttaagaccagcctgggcaacatagtgag

SEQ ID NO: 87343 - DNA, 1064 bp, Homo sapiens
ctggtcatgaactcctgacctcgtgatccatctgcctcggcctcctaaagtgctgggatcacaggcgtgagccaccgcaccctgcttctactgctattttttaatgtaacacatagaactactttctaggatgttgcctatagaaatgattgctttcctttgggaaaaaaataataaaatctggcaagttctaattttttttttttttggagacagagtcttgctctattgcccaggctggagtgcagtggtgcaatctttgctcactgcaagctctgccttccgggttcacgccattcttctgcctcagcctcccgagtagctgggactacaggcgcccaccaccacacctggctaattttttgtatttttaatagagacaaggtttcaccgtgttagcaaggatggtcttgatctcctgaccttgtgatccacctgcctcagcctcccaaagttctaatttttatatctttgttttatcagcactcctggaaaaagtcagatggatctgcggaaactgcttagaaaagtcgatgtagagaggtaatacactctcatatctttatgccttctacgtccattttaaaagttgccataaaatacagctactgttattttcaatacctttgcaggagcccaggtggaacccctcttaccaataaggaaaatatggaaacaggaacaggactgactccagtgatgacgcaggccttaaggagaaagtttcaggtaaccctttaggaaaagaatattggttcctttgcttgaaaataatttggcctggtgtggtggctcatgactgtaatcctaacactttgggaggctgaggtggggagattgcttgagcctagcagttcaagatgggcaacatggtgaaactctgtctctacaaaaaatacaaaaaattagccaggcgtggtggtgcatgcctgtagttccagctacttgggaagctgtgttggaggatcacttgagcccaggaggtcaaggctgcagtgagctgtgattgcaccactgcactccagtctgggtgacaaagcaagaccctgtctcaaataaataat

SEQ ID NO: 87344 - DNA, 1041 bp, Homo sapiens
atttgtataatatcacatggcagtatgtgctatgaaggaaaggaatgaggttctgtgggaacccagagaggaacttgatctagcctggatgatctaggagggactcccttaggaagtgatgatgcttgaggtgagagtcgaagaaggaagaggcatttactggatagggtaactgtggggtgggtccaccatgagtgtcaggaaggagagagttccaggcaaaaagaacaaaattcgtaagagttccatggggtgagggatcatggcctattcaaggaactaagaagtgaccagtgtggctgtaacacagagagggagcccaatggtggtgaaagacagggatggagatgtagttaggagtcagaccctgcagagttgaaaggaaaaggtcttgagagctttctttgtcacattcatatacaaccacatacccaacccagtagatcagctggccctggtgtgacttcttccaaaccctgttgatcttagtcatctccctaattgcctctatcattagatctgtgaagaacagccatccgtcggctgcccctgctggagtgctggaacacagggctgctggcatctttggctttgaagtttatagttcgttctctctctggatgcagggacatagcagactccactgctgacactttccaccccaatattgtcttccttttgttccgtgtttgagaatcagtgctttttgtgggacaatataatttctctcttaccaatcaacttggtcctactgggcactatacagctttctgcgtagtggagatgtgaccaggttcttctttcctcctcttagagcatgctacccctaatcaagttccttggtgatacccaaaattgtgaagggcaggagcaaagggacgaggcctcacgggtcttagccccttgctttttctgtttagctctaagatctttgttgtcactgcccctacttcatagcaggtacagtgagttgagaactctggaaatggataaacgataataaattgtaaagccacatattgaacaacaacaaaaatcaca

SEQ ID NO: 87345 - DNA, 1033 bp, Homo sapiens
caaagtccactgtatcattcttatgcctttgcatcctcatagcttagctcccggacttatttttttaatttaaatatttctttgggcagtaggaagtccacaactataatacagtggcttcaccatataatcactgttcttccatccttaatgtgtggcttttatcctcttaatacaaaatgcctacatttcctgaagcctcatgtccacattctaggcaagagaaggagaaaggcaaatgttaattaagctatgcctcatttcttcaaagaagccctatccaggaacttctgattgcatcagggaaactgggaaaagtggtttttacaatctgaatgcagtgttgccatgcaaaaattctgggttctgttgagaaaggagagttgtacttatcacaggaatataattgatattataattgggactttttttttttatagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctaaggcaggagaattgcttgaacccaagaggcagaggttgcagtgagccaagatcgcgtcattgcactccagcctgagcaacaagagcaaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccaga

SEQ ID NO: 87346 - DNA, 1030 bp, Homo sapiens
aacaggtgtccgggtgcggttactcatgcctgtaatccgagcacttgtggaggccgaggcaggcggattacttgaggtcaggacttcgaaaccagcctggccaacatggtgaaatcccatctctactaaaaatacaaaattagccaggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaattaaatgggtagtgacgttaagagatatatatcagcttctagtaaaagtttttttttttaaacctgctagctacatttacattatgtaaaaataaagggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgtgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactca

SEQ ID NO: 87347 - DNA, 1050 bp, Homo sapiens
tcacaaactaaataaggttagagtcagtgactgcatagattgataatgctcaaggaaatgtgataccctagggatcagcattgttttaaataatgccttagtagaagagatcattttactgtaggagagagcctattttcagagagagttggcatgtcatggataaaataaggttgtatgaaccaatcattctggcatttatgtaattatcttctagtttaacttgtttcattcatggttagtttatgtcaaattactaaataactctattctgttaaataaattatataatgatataatgtgaataaattttgcattttataaaatattctaaatttacatattgattcttccaaaagttatgctattcattcacagatagtcaattctaattcattttttaagtgaaatgttgttagtggatttgcaaataggcacatgcataaaattttgaattttcacacgtaggtttcagagttggtgaagcggtataatcgagaacacttaacagtgtggggtaatgccaattatgaaattgtagaaaagtgctacaaagaggtaagcttcaaaaatgatacagaattatctatctttgttgttgttttgtatctacaaatgataagttattatagtaataattttttttctttttcttatttttagagatagggtctcaccctgtcacccaggctggagtgcagtggtgcaatcatagctcactgcagcctcaaactcctgggctcaagtgatcctcctgcctcagcctctcaagtagctgggactacaggcacacaccactgcacccagctaatttttaaatctttagtagagatgaggtctcactatattgcccactctggtatcaaactcttggactcaagcaatcctcctgccttggcctcccaaagtggtgggattacaggtgtgagccattgtgcctggcccttattacagtaataatttttaaagcatcttatttcaggccgggcgcagtggctcacgcctgtaatcccagcactttgggaggccaaggcaggtggatcataaggt

SEQ ID NO: 87348 - DNA, 1199 bp, Homo sapiens
tcctgtaaggaacaaagtggaattttaaaaaaggatctaatgatttatttaaatgatagctttaaaaggttatttctaaatgtaccaagactgtagtggataaatactgttataaaaataattttctattttaacatttcttctcatacttctcacacttctaattttcaggtgtatatttgggtattaaatgaagaacaagaatacaaaagagcttttgatttgggagcaactggggtgatgacagactatccaacaaagcttagggattttttacataacttttcagcatagaaaaagaggtacttagaagtattgaaggaaaaaatgaagacctaagaaaaaaatatttcatgatcatttccctaagccatttccagaatggtaaaaggtttaatcagtttttattacctcatttttaagcctgtatgagaatgtagaaactatatattatatgtatatttattttaaataatattgtatattttatgtttgtaaattgtttagaaagataattggttatgagatgtaagttttaatttcttaatgtgcatttttgtttctagatcttatacagaaatcttgattaataacatacacagaaatgtacatactacatcatctacagaaatcttgatcaataacctagaaactaggttatctaggttattgatcaagatttctgtagatgatgcagtgttctatcataagtaattctggaatcaaagactattggatacatttggcattgggctgagtgtggtggctcatgcctgtaatcccagcactttgggaggctgagacaggcggatcatctgaagtcaggagttaaagaccagcctggccaacatggcaaaaccccatctctaccaaaaatacaaaaattaaccatgcgtggtggtacacgtctgtcatcccagcagctcttaaggctgaggcacaagaattgcttgaacccgggaggcagaggctgtagtgagccaagatagcaccactgcactccagcctgggagacagagtgagactccgtctcaaaaaaaaaaaaaaaaaaaaaaaatgggaggccgaggcgggcggatcacgaggtcaggagatcgagaccatcctggctaacatggtgaaaccccgtctctactaaaaatacaaaaaattagctgggcgtggtggtgggcaccttagtcccagctactcgggaggct

SEQ ID NO: 87349 - DNA, 1029 bp, Homo sapiens
ggcgagtctgcggggccaggtttggggcgggggtgcggagctggaatcgccgcttcctcctccgcgtcgtccccatgggttcggactccatggggtccgggtggggctggggacgccctccgtcctctcgtgacgccgcgtttccctcggagagtcctggggacacttaggtccaggggcgccgccctgggggccttccactgtgggactgggcgccctcgaaatttctcggagcgcgtcgtctgccccgacccgggtcgaggtaaccgcagccgagttcctccctggccgcgtctcggcgcctccccggtgtccttgccaagggggtgggcgcgaggtcctgcccgacggaacgcgggagcctctgccgcgagcgcctccccggagctggcgcttaggggcggccccgacctttcgccacttccagttcaccctgcttggccgccgacctcctctggtgtctttcccggagtggtgggcttttctccggtcttgggggcgtgcgggggtgggggacacctgttcttctggacttcttgtccggaagattgctacctctgccttcagtcttagctgcgagagtttaaaaagccaggtgagcgagtgtcttgttttcctccgcttggagcggagctgcaccctcgcccgccccccagtcccgccgctgtgaaaggccccagagaactgctccgaagctttgctggggtttttgctttctggcctccttgctgatttgctgtccttgcaacttgggaggctcttgagtgagtccttgcctttggtgaatctgaaggctaacgagacagctgtcttttcctccctgcccttccttccttgttcttccttgttccaaagcattgggcaagaagggtagcggtcagcttccctgtgcctcacagagcattaaagatgcaagaagttcagtaaaccgcctcactggctctggggtgggacttgatttcacatggttattgctcccccgtgctttcctgcctctgggggccacagggcctatgaatggctgagtct

SEQ ID NO: 87350 - DNA, 1087 bp, Homo sapiens
gaatggttgtttttgtttatgaaggagcgtggtttcttgagtatccaagctggtttttattaccagctggatggatgtgaagtcccacctggttccagtgctgtaaaagaggtgtctagaaaatgatgattttcctgtgggccttgcacatcagctccttggcagctttaatagacgattttcagagaagttttagcagtggccccgtcctgagattagtagagtcagtgtagaccacagagataactttttcaatacagtaagtgatggagtggtctgtgttaggaatgacagcaataatatcaggtccccagctaagccacagaagcctacttaaaccacaatgtacctttaagtcgattagtttaggccctaacctcctaaccaccgtgagtcaacctgggggacgggaacgccattccttttggtcttgtgaataggaacaattcctgtgctttttctccctcactggtaagggtgactgtagctaatcgggattattgagtattagccatgtgctgggtgctgtgctgaatactccaattgcgttatctcatttcatccttctgtctcctgcaggaggtaggctctattgttatctcctttcaggcaatttgcccagtggtaatgtagctggtgagaagaaccaagacggaatccaggtccacccacctctagatcctgcactcttaaccgctgggcaacactgctgcccacctctctcattgggcgggcacaggtctctctgtgctctctgctctaggctcaggattctggggagagtaggatggggaaggaggacaactttcccagtataaaggccttctcacaattccacctctctcttttttctgtctcccactcccagaagtagcttgcctcctcctttctgccgccaccaccatttagtgcctccagccagggctgctttcattcttcacagatgttgggacaggctatggctacttagtcacgttcctaccctcccgtccttaaagttagcacaaggtccctttcagtctttctaagagtttttaatttgtttgttttttaaacctagaccagcagtgtaaagaataggcatgga

SEQ ID NO: 87351 - DNA, 1034 bp, Homo sapiens
tctagaggctgaactttcccttctcctttaaccactcaccttggttggctcaggagagggggtccctgaggagtcctctccctggggctgtaggtggtagcacatcttcaagcctgatgttatctagggctgcctgggaatgatgataatgtgtgtgctgggtgtctaatgaaactgctgggatgatactgaacttcccactccagaaaagcagcgagactggagtctccagtggtttctttctcattcattgggtatcttgggcatgataccaggaacagagaagtgggtcatttgatcctgtcagtgttgccttcttcatgggtggcagttggattctgcttgctttgtagggagccctgctccatcagccaatgttagtcctcttcccttgatgttacaggctgctgagaactagccctagacctctgcgtgagggttcttctgccgaagacatcaccagtgtgtggagcctgccacacccacccgctgccaaaccacggcctttacctgtgtcttccggtgtttcccgtgcgacccatcctgtgggagtgcctcgtgggctgccccagagttcaccccacactcagcagcaccaatggtgaagatgacaagatcgaagactttccaggcatatctgccctcctgccaccggacctacagctgcattcactgcagagctcacttggccaatcatgatgaactaatttccaaggtacacatttccagcaggccttccttgcctaccccggggagggcgcttagtgctcctgaagttgcagaggtttacaagctctcaagaatatttgtactccatctttgtacagggagggctgacccacgtgaccgtctcactcaactgagaaaaactctgagttggagggacagagtagtcatttaatttgttattttggaaatgaggtgtcatccttgttggaggctttgggagctggcagcttgcaagccagagaagggaggggctggggattgatgggagccttgttctcagcttgcttggtttaggttggcggacg

SEQ ID NO: 87352 - DNA, 1491 bp, Homo sapiens
atggaaatgtatagttagaaagtttttaaaaacaaatggagtctgtattgccatggtggtggaaagaatccagtaccaggctttctaccttcacagcttgctttagatccctagaggcctagttgcttgcaatcaattgtccaacttccaagcctcagtttctcactcatacaatgggtaaaataatgtttactatgtttaatgctgtcttagtccattagggctgctaaaacaaaatgccatagactagttagcttataaaccacagaagtttatttctcacagttctggaggctgggaagtccaagttcaaggcaccaccagattcagtctggtgagggcctgctttctggttcacagacagctttttcttacttaatctgacatggtagaagggaagggtctctctctgtcctctttataaggacactaatcccattcacaagagctttgccctgatgacctaatcacctcccaaaggcctgatctcctactgccattatctttggggtgaacgtttcaatctatgaatttggggaggcattcagaccatagcagatgtctctagcagccagcacctagtgtatgctcgtgatgtgctatcccagcaacagtcctgtggagtgggcatgcctcactggggagagcaggtttatttcattggattgttatgaggctcagctgagatcatggatgtgtgggtggtttgcaaattacaaacctttatgtaaatataaagtagtctgtttgcttctcttggccttactgtccaaaagaaaagaacaaaaagacaagggggtgggttggaggggattattcctgcctgacaccaactagttttagtttggctaagatggcttcactttggaacctgaggcacaagattggatatgagaaggggtaatagaaagccaagtgtgtctgtagaaaggtaacatggcattttctctgtaaaatggtaaagagggtagggggaaaaactcttgaattgatgacagaactatctagggaatgtgctgaggcatcctacaatttttttcttagggggtgttgtggtctaaatgctggagtgtttgcacacagaggtattttgagttggcatgaggaattgctcacattgttgtttcttccctaatggtacaagccctagtataaaaatatactttgcttataaaataataatagcttcaattggaacagttagtagccagccctagtgagaataatctaaacactcattttagtggacataatctattatggaaacctgggtcttcacaaagcttttgtatgaaaattttctgtctgtcatcctccctttgcctccctcctgccaaccccttgatggcattgtggagtaggccatttaggaaggataaattggattaatctatcacagacccacttcggggccctgtgacttcatgccaacacacggttgctttagtgctctgggtcctggaggaaaggagtggtagggtgctgtagagg

SEQ ID NO: 87353 - DNA, 1043 bp, Homo sapiens
gaggcagacctgtcgcacagtcacgcctgctccctgtgaaaattaatgatctgggcacacatagagttgctcaccaatttagtatcaagggagctgctgggaccaaatctggtgaatcatctttatgttttgtttttcttttgctgcagactgcaggcagctggagcacaaaatctgctcaaatgtgattctttctgtgtggttactttaaataccaaaaggaaatgttgacttgagcgatgaggcgtaccctgaaaattaactctgtggtttgcagatgcctttaaggttccaatcataagactggtttgtatattagcgtctaggctctcagcagggacactggtaatcaagcttgtgttcccagtcagaaatccaaagaaactctttttcatcagggtgttcaacctgggaagcaaggagtgggtgcaggatccctctgtttctgtttgagcagtggcactccctctggcctctggaatggtaaatctgcaccattgctagcttggctgtttgcgtttgggggctgactagaatccactgtcatacactacttgttcagttcaatatttcttgtgctttaaacaacatttaaacctagatggtagggataagatgattcctgcacttaaagagcctgtgatgtttaggaaacaagggaatgcaaggctcaccatggagggtagaagaatgttacagataaggttgtttggtgttgtaacaaacacacaagatggaaaatctatgttgctgctattagctactattgattgaacaccttcttagtttctatgtatatatagatatatatatagagagagagagagacagggtctcgctatgttgcctagactggtctcaaactcctgacctcaagcagacttcccacctcagcatcccaaagtgttgggattacaggtgagccaccacactggtcctaaagacttaccctttttttttttcttttttttttttttgagatggagtcccactccgttgcccaagctgcagtgcagtggcgtgatctctgctcactgcagcct

SEQ ID NO: 87354 - DNA, 1666 bp, Homo sapiens
ggggtaggaatcatctcgctgagtcaaggtgaagctgggaccagaccgtggtgacgctgatacctgtcatctgcccctgcttctctgctacaaaaggcatttccttggccgggtatggtggctcacacctgtaatcccagcaggcatgagggaggccaaggtgagtggatcacctgagctccggagttagagaccagcctgtccaacatggtgaaaccccatctttactaaaaatacaaaaattagccaggtgtggtggtgggtgcctgtaatcccagctacttgggaggctgaggcaggagaatcgctcgaacctgggaggcggagattgcagtgagtggagattgcgtcattgcactccagcctgggtgacagagtgagactgcctcaaaaaagaaaaaaaaaatcattttcttgtctttggtcgttcagtatctcttctctgcttctgtatttcctaggaacatgcttttgaaagcagccagaaatataaagaaggcaaatacatcattgaactagcacacatgatcaaggacaatggctgggactgattggacagcatctacccaacccagtgtccacgtgaacgccattcaaccgaacattcttcccaagcgtgagagagtgactgacacttggttccatccatttaggggccttgccatccggggcatcctcccaccctgacgccatctttctggtgaccggcctctaaatcgctgtctctctgtctctttgctttgtatctgtttgtgagttgatcctggcttctctctctgttctagttttggctgaaaacaaaacaacaaaaggaacagatccttgaccgcatggcggcagcccaccttggtaagggccccagggcccatgcgagagctgcctgatggcctcttgtcaggagagcagtggcacgggggcgtgaggaagagggaaaggggaaactctaagggtcctggcgcggggaaggggtggaagggtggaggtaggaacaaaattgcgccgctcctggagacctgataacttaggcttgaaataattgacttgtctaaaaggacaaagagaaaaaaaaaatacctcatgactgcattctctctgactagaagcttctgttcctgacaccaaatgtgccaggttagcaaatgagcacaagatgtggccctgattctagttggtggggcaagggcctggttctcctgggctgagtgggggagtgtcctggcagcagcgagtgacctgggcagtggccaggtgggtgcgatgactctgatgcctcactcagtctctgggcaatcatcatctttgcctctagccaccgtagataaggtgtgaagggactgctgtttgcaatgggcttaccatccaaatatcccaaaggctttgaccagcaaccaagtaaaatcagtaattgaggagagcagggcacaaaggggctgcagtttgggagctcctgaagaaatggctcagatattgagtcagagaaataaaaagtaggatcagttagcaattctaactgcccttccttctgacccctcataagaggagtgtggtgagggaggggactgggtaggggtcatcccaggaggaggggtttacattggaaccagttcaggttcggtgcatctttcctcttcggttttacagtggcttccgtgggatcgtcaatttc

SEQ ID NO: 87355 - DNA, 2023 bp, Homo sapiens
aggcatgaagttctatacctcagccagcagctgccttcgtttggaactgaagtccagccagcagactctctagctccatctcccctgtgccaccctaggtcatatgaccttggccaccttggagtagacccagacccctcgggacccgggacattagtctcaggctgctgatggattgatttgacatgaaccaaacacagccaaactcgatacccacaagctgtcagctgaacctgactgagtgttcttcctgagttcacgaggataggctagagtgcatttttactggtggatcagtgtgtgcgaaagagatgaccctttataaagagattttcaagtggatatatataaaagaaacagttgcttgtaaaatatacttttgtaaataatatttaattttttaaataatatatttggtgctgttttctcagatcccctgagagcactttttattttccttttaaattctatggtttcctttgcatttcttgaagtatattttaagggaaacagtgatcaccaatacatgttttcagttttttttttttttaaggtctctatcactttaatctggatcaaggctttgaagcaatgcctctctgcattttttccccagtggaacagactctgcagtacattaatcaggttgagaattgaaatattttcttgcatcagtattggctagaaaagaaaataaataaaaccaagttaatttagtagtaacaacttacagtgattcttcctgttggaagaatttccaacaaatcagaatcacgtttttagttgtgcgtgtgcgcgcacacgtgtgtaaaaagcactttcgattgtgcctcctgttttctcgagtggggacactttaactacagtttacacctcgggcgcataaagtttttcttctctttctctctggttgtttctgtttctgagtggaccaacagcagaacccacgaggatttgttttgagtatggagctgttgcgggtttgctcctttttcttgctttgcgtgctcagtttttacagactgtaaaggagatgtgttgtttgtgaagatggagcagagtcaaatctgtgcttctaactgagatgagagtgtattaatcacgtatcgcagggctccagctgttttagaagccacatcatgttaaacattaactggtttggattaaaagaacattaatattataatacacatatcttagtggtaaacagctttttttttttaaggtcagattgcctcaggtttagaaagaggctgagaaatcaaatcttgaacacaatcaacttacatattttaaaggaatctgcctcaaatgagaaaatatgctagttatctagatagaggaaagagatatttacttttttaaaaattaaaatagttatgaaatctggcagaaaaggtaaagcctagaagaaactatgaaagctattctcatgttaccaaattctatctgcgcatatgtttttgtataacatttcggtgacagtgggagtcggttccctttcccaacctgcagagactatcttccaatacagaatctgtctatttatgcttgtgtttacaaactgtatttgttgggtttgggtttttgttttctttggtggcatttttcaggtcactttgcttctataacaaaggtaattgttttcaaataatttgtcttcaccttttcctgtatttgtacatagtgattcagtattagagaaaagtgcattgtttctgtcatatttccaatctgtgttggtgctcatttgagaaaataaaagttttcaaatattaactctttgaagagctcatctgtcttcgttgacccagtgtgtttgatcttgacatttcatattaaagtatttaaaggcctatctaaatccagtcacagatctgttgactgagaccctaagggcttgtttttcccaaggacagtcagctaactaatgaataacagcaggtctcctgcttatctgcaaatgcttctcctggctttagatatcagaaatgcatgagtgacctttatccagttctgtgta

SEQ ID NO: 87356 - DNA, 1007 bp, Homo sapiens
aaaagttgtgagttactttttcagatggcagagtctgttgattatgattatgatgttcaagataccaccctcgatggcttgttaatattgccgtgttatggatcaatgacaacaggtaatttctcattagaatagaaaatttgattttttaaaaaaactttttattgaataatcgtgtttacagaaaagcagtcagatcttaagtgcttaggtaagtttcacaaaccagtctcacctttgtaacccacatccagatcatgaaacaaatcagtgagaaccagcattccttgacagtagtgatttttgcctgaagtctttttacattcacttttttgagagtcgtggatatcccccttattatcgtttagagtattgtttctcccagcaaaacaaaactattggtgagaattctttgaaatgaggacagtagtttcttgctggtattactgtaagtcaaaacctaatttgccattgccacagaatttttagaaattgtgtatatccagctatatctaagtctaaacacagtggattgttttgttttttttttgtgatggagtctcgttcttgtcatccaggctggagtgcagtggcgcaatctcagcccactgcaaccgccacctcctgggttcaagcgattctccttcctcagcctcccaagtagctgggattgcaggcgctcgccaccacacctggctaagttttgtatttttttttttttttttttagcagagatgggattttgccatgttggccaggctggtttcaaactcctgacctcaggtcatctgcctgccttggcctccagaattgctgggattacagatgtgagccaccatgcctggctgtggatcattttccttttaaagtagccatgccttagtctgcttttcaagaatgatcctgttctttggtgaattccaagagcaaatgcaaactcttgatttgacattttggttatagtaaatattgttgaatgaggtttagaatttgttttataaaacttt

SEQ ID NO: 87357 - DNA, 1089 bp, Homo sapiens
gattcaggtcccttatcttttctggatgtagtaaatagtgctatcaaatttttgggtaaatttagtaaggaaacactaagaaattttaagtctggactgacaactaatgcaaagttctttaagactgggttatttatcatttaccgaatatattttatttctttagctaagtctgattgtctgtctccggaaggctgaacctgaatctcaaagatcctgtgtgtttcttctgggtaaaatgatcacccaggtctgagaggaagtctaatttcctctgcttttcttcgttactttaaaaataatggtttcactaagggattaagggagtgctctcctgggtaaattaacctctgtaattttctgtttcctgcacaggcaaaagccattaaatagcatgtttcagaatgttgtcttgttactgctatcctactttggttccttacctgacttgttcaccatttaattggcttagaatggcatgttaagggctagttgaaattagattctgaatctgtttaaatggtctgaagctgactttcaagtttgtgtatttttgtattgaggcaaaattcacataaaattaatcatttaaaatgaaaaattaagtagtacttagtacatttacagtattgcgcaaccactgcttctgcttagttctaaaatatttcaacacctcaaaataaaaccccatacccattaagcaggtactccacattcccctcttgaccccagcccttggcaactaccagtcttactttttgtttgtacgtattttcttttttaaaaaattctttagatgtgtcagcaggaagcagtaggtattttctattctggatatttcatacaaatagaatcatataatatgtggccttctgtgtttgctttctttcacttagcataatatttttgaggttcgtccacattgtagcatgtatcagtacttcattcttttttgtggctgaataatattgcatagtgtgtgtgtgtatatatatatatatatattccattgtgtgtgtatatatgcgtgtgtatatatactacatacatatatgcaaagcaatttgttcatcccttcttccattaatg

SEQ ID NO: 87358 - DNA, 1922 bp, Homo sapiens
attccatttatagaaaaatgaaacactatgtacatatgcttatatatacatagaaattacctggaaggacacacactaaataatgaacagtactttgtcttgaggattggtttatgggtagtgtgactggggaacattgaacttttacatgatattcttttataccattacatttttttttctgtaagcatggattactcttataacaaaactaatttaaaaagtaaattacaaatactatttttaaaaggcaaatagattgggagaagtaatgttgctattcaggtaaaatctccaaagtgatatgaaaagaaaaaaaggaattgtgggagaaatagagcttcctaagagaagttaagaagagttaatatagttctaccttacttcaccccagaggatgaggcagattttaatgagtttctgaaagcaaagtgattgtaggcacttaatgcaaagtataactgaattgcctctccaattcttttagttgatccagagtaccagaaggaagcagaacagagacatcgagaattggcagctaaagctggaggatttaatgactttgcaactttagctgtcatctttgaacaatgcaaatcaaggtatgtaaggtagtcctttgtcctgaaaaatgtcaatttgatgtatagttccaatacgtacttatgatgtggcttgtgacactaacgttcagtgaagatgatattgacttcaaggtattttgaatttcagtgaaattatctatgtcagatgactattgcttagtaggcatttattatataacattgattctcttcttttctcctcaaacctttactgaaaatgaccttatagaattttgcttctatataggtagcctagattaaaaaatgattggatatttgttattgcatatataagtaaagaaatccatttacaaattattttttaatttagtcaggggcacattcattaatttaaatgtttttttcaagtttcctaaaattcttttttagtacttggacaggtctcctgaaggaactgacagttgtttatgggtttccacttttgtaatagaaatgagaattttagattgtcttttacttagagaagatattttaaagataccagttttttgttttgcagtggagctccagcttcatggtgccaaaaacactggattcattggaggtgcttattttctgcatttcgtgtggaagctcaacttcgagaactaatcaggaagcttaaacaggtgattgccgtaatgttttttttcttgagtagcattttggacctatatatttcatattgaagtttcattgatgtacattagcaccctttctattctaccacccttccattctatttgtttctatgacctccttgaccccatgaaacattcctagtagtgataaaagaattgtcttcacagaaatgaagatatttaaaaattgctttcctgatatataattgacgtgtgataacctacacatatttaatgtatacactttgatgagttttgacatttgcgtaaaacaactatcaagataatggtacatatccatcatctcccagttttctcatcctcccccccacctttttttttttttgagatggagtctcactctgtcacccaggctgaagtgcagtggcgtgatctcggctcactgcaatctccacctcccaggtttaagcaattcttctgcctcagcctcccaagtagctgggattacaggcttgcgtcaccacacccggctaatttttgtagttttagtagagatggggttttgccgtgttggccaggctggtctcaaactcctgacctcaagtgatccacctgcctcggccttccaaagtgctggaattacaggcatgagccactgcacctgtcctcattccctttcataatccattgtctcacctactaggccctcctgccc

SEQ ID NO: 87359 - DNA, 1079 bp, Homo sapiens
attttgatagatgtcctcattatggattgtgtttttttgcttctttacatcatacctgataatttttcagcggatgccaaacattgtgaatttcaccttgttgggtgctggatatttttgtgttctagttacttggaaatggtctttggtctttcttgttgggtcttgcttgcatgatttgttaggtgggatcagagcagtgctcagtgcagggctagttattcccctctactgaggcaaggcccatctgagtactcttcctaacatcacatgaattactgtagtgtagtattctcatgtggcttataggaacaggcgccattactagccctgtgaaaacaccatgcccttacttatccttttaagaggttcttttcttgggctggtagtttcctcacattcatgtgctaatcactactcagctcaacacttgaggaggaccttctgcatctctctggagttgtgtctttgtgcacttctcttctctcctgaactcttgtcctgtgaattctagccaccttggtcttcctggactcccagctttctctccctaacccagggagttctctgagttccatttgggctttacttccctgtaccttggtctgcagtctttatcaaggctgaagttggggcagttgttgggcgtactgcgtttatttcctgtctctgtcctttattgcctgatattacagtgttttggaaatcattatttcatgtattttttccatttttttggtttcaggtggaagggtaaatctggtctctcttaatctatgttggccagaaacagaggtctttagaaatgtggatttttcaaaataaaagattatttcaaattgtactatgagatttaccactctctacatattctttttatagcaaagtgatttcccaaaagagacctttgaaggccctaaacatgaagtactacgaagatgtctttgtgcgggctatttcaaaaatgtagctcgaaggtaagcaataaagacttgagagatggatcaagatataatactgtatttgactataatattggactatttaatattaaacattgaagatttgatttaagctct

SEQ ID NO: 87360 - DNA, 1099 bp, Homo sapiens
ggctaacacggtgaaaccccgtctctactaaatatacaaaaaactagctgggtgtggtggcgggcgcctgtagtcccagctactcgggaggctgaggcaggagaatggcgtgaacccaggaggcagagcttgcagtgagccgagattgcgccactgcactccagcctgggcgacagagtgagactccgtctcaaaaaaaaaaaaaaaaagaaaagaaatcttagccactaggtgttctattacagtgtaataacactgccacatgcttgaattagggtcagtttttctgactcattggccttggtgctcttaattttgtaaccatagactacattgcttttgaaagggcaaaatttaatttttctctttattgtttttactttgttaacactgaaaaatcagggcttctctttctcttaacatttctagtactgaatctcaaagctaagttttattggattaatttgtaatgttttcagatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggttt

SEQ ID NO: 87361 - DNA, 2131 bp, Homo sapiens
ggtggcttttctcttgccttccctgaggcagtagggacagaaggtcactgaaagaacggaacgagggtagaatgggagaacgcatttcttagagctatgtcaatctcagagtgtgtgcggtcaaactccctaaggaaactcgcctccccttccccctttttttatttctctggggatgttgtggctcttaacccctctttggttctggaaggtaggaaagagtgatacagaggttatcttttagtcttctcgagtagtagcaggtagttttgaatatcttcttcaggatcgcatggaattgaacagagccctggggacagcacagctgctctgagacctgcagggctatttggtctgtgactggcttccctttagtaagttctagagttcttccccatggttccttatcctggaggcaacatattgttatctggcaacatgccagtggcgggcctaggcaggtgaccattggaaggcttcactgaattaaacctcttcagagcttttgattttcctgtgtcaccaatcctgttttttactgtagcttaaataatttattcctattaatttgctttcttcccaaatatccccttaaagaaacctgcctcagctcagtcgtctgaagggctaattccataatgacagggaatgcagtggtttgacatgacactgatatcagtgacctattagacactttaccattgaagaccatttttatttacatttccccattggcatagcatacataaaggattcttgttaataaaaggttttaacattcaggctataagtaacataatttcatatttctttgcaagtattaccatgtttgcactagcaaggacttattttcctttaaggcttgaaatgtaaagaataataaatttttacccataaaatgagttaaataatgcactttcctcagtcatctataattttcaaataactcatctgaagtaatggaatataccttggcaataaaaacacttttacagagggttaaaaatgttaaataacaaaatggacatttttttttgatcaatccaagtttagttgctgtggttgcttttgttaaagtggggtggcaaatgaatgtggagagttgaggggtgctgttcttaagtgtgaggggaaaacgcgggcttattttcatattaaactgcatctgaaatatctttctgcagacaaatgtttataaaccacacagagaatcaagtacagctgctctttattttccacggcagatgtgtagctcactactaaatcttgtggtggttggagtaatagcttttcatttcttttaaagaggagacaagaattgttaaatgatcccaaagattcgaacccaaccttgtcacttattaaagacaaatttaatacatgtctgttttgtaactggatcaaagtttctgcagatgcttgaatgaagccattttcttctcaaataatttgaagattttgaatataaagcgatttgcaaattgaaaaattcagtcctctgtgttttggattgctatgtcatgcctaaacttaagcttgcttagctaatatgactgtgctccagttgattaattgtggagcccaaataactacagcctctttcatgataatatatctcctaacttcatatcattatctcctccctttttaaaaattaataagcattttgtttttttgaggagacagggtttttgctggaggtcagtggcaccatcacagctcactgcagccttgacctactgggctcaagccatcctcccacctcagcatcctgagtagctgggactacagccatgagccaccacacctggctaatttttgtattttttgtagagatggagtttcatgttgcccaggctagtctcgaatgcctgggctcaagcaatcctttgccttgacctcccaaagtgctgggataataggtgtgaaccaccgagcccaactaataaggattattttaattggcatctttggtctttgacctctgagcttctaccagtttgctaagtagcagaaaactttctgaaacacgtaggataaaaactggaaacaagaaatggggaacttaagtgtgagtgtagagttaccttgtgaaactgtaaatgaacttatttttataccctttaactac

SEQ ID NO: 87362 - DNA, 1054 bp, Homo sapiens
aagattctataaaaatcctaggctacatatataaaatattgcctgtgattcttaattttttggtgattttcaattttctggcacattaagtatctttaggccacttgacacattccattgtattcctagattctttgggtcttcaattaaaaatctccctaccctgttctttcccctttgatccatagatgcaggcatggaatgtgttgttgagtcaaatgttaggggttcttgctatagttagttcggattgtgaatagaaagcaatgctaagtactgggatttactacatgcttagttgtactctctggaagaggtagacttcctggaattatgcggcagtctcctgggaatagcttctaagtttaaaatgtatcatattcttcagaattttcttgatggtcagtttacccagcttaaagtgtgtggttaattttagtgaaagtgctttcactctgattaggaaataagacacagaatggtgtgtatgtagaacacaatcattttcatttgagtatttaggaaaattcacatttcaggaaccatggtagttgctcttgaacaattgtttctgaccataattggaatttgtaccttgcttttaaaagattccatttatatcgaatcctcagcttctttgcaaaattgttttttccatacatatgtttatatgttattcaaattatatttaacaaggtgttttccctgtcattgttaccgttgtggctttttctctttgagttattgtccagtagaactttcttcaatgatggaactgtctaccagctacatagggatattgagcacttgaaatgtggctgatgtgactgaaaaactaaatttttgctttaatttctttttaatttaaatgtaaatagccacatgtgacaattgactcctacattggactgcacaattataggccatgctgatgtgttttgtaagtttgaagatttatctcaccactcatgtttatgtatttagaatatttcgttagctaaaattaaaacactcattgttcaaaagttttaactgaatactgtctgtcttggaa

SEQ ID NO: 87363 - DNA, 1140 bp, Homo sapiens
gccaagaaatagaagcttgaactcaacgaaggcagttgtgcatgaaagggataggaaatgaaggtgacaatggaatatatttgctcattttgagtagcatcatggtagaaaggaaaatggttacagacttgtagggttgtgctttggaggcagactgccagtactgttaatacttcttgttcctaatccttaggtaaataaggattttcttcaagttctgaagtaagacggttttaaagattattgctgaaagaataggaaccagatccattaaagccatattttgtcacattaaaaaactctgcagtgtgctattctggaaaatgtctcagatgtttaatctgggcttatctattgattatgtcaggttttcaacttgtctcaacttcctcatttattaaaacaatatttcctggcaattttaaagttagactacagtatgtttttgtatttgtagtataatatttagccccttaaccccttacaggcactcgaatattagttcttcccctccaccctggaagagtttccctttgtccacttgagttgaatatatgtgccgtactaaaggagaaaaactaccatctacccagttattgaagccaagatcttgaagttacaccagactctctaatttctcattttctgcatccgtcgatttctggagttcctcagtgatgcacactgggggtctcagggatgacagtttttcatgaccctaggttgaaactgggagtcatagaagacgaaaaaacgagaattggattgggagttgactctgttgcccaggctggagtacggtggtgcaatcttggttcactgcaacttccgcctcccaggttcaagcaattctcctgcctcagcctcctgagtagctgggactacaggggcccgccaccaggcctggcgaattttttttgtatttttagtagagatggggtttcaccatgttggccaggctggtctcaaactcctgacctcaaataatctaccctcctcagcttcccaaagtgctgggattacaggcgtgagccatcgtgcctggccaacttgcatttatttctgattagctgctcatctgagaaaggtggcttaaaaaaaaccaccaaagtggacagactgaagctaaagactgtcagt

SEQ ID NO: 87364 - DNA, 1049 bp, Homo sapiens
taaaatgtagccttgtagtcttatgttatatcttattcagagcctggcctggttatgtttaagcactattagcagaagagtttcagaagagaatttaaataaaatacagttaacttggctggtttagtccataagataatagtgacagtggtggtgtttgtggaggaaaactgtattgctagaggacaagggtgacagaaagacttgatttttttttttccatgctttttcttttctggggtgtgtgtgtgtgtgtgtgtgtgtgtgtgtgtgtgtattttgtaccatgcgaatttattatattacctttggaggaaagggggataaaactagtctggccaaggctaataaaataaagcctccatgtagcttcttttagtaggacttaatctgttacaacatagttagtcacccagagtattaataacccactatggtagagatttcttcctagtaacaagtgacttttgttcttacatacttaattggtttgcaaagacctaccatctttagatccactatatttgtttagcagatactttagtattttctgagtacacaaagcaaatctaattccattattttccttgttaaaatccttaagtagctcccttcgcctgtagaataaactcaggattcttactgaggtatgtttagcttgttggtctggcccttgctcatttctctaaccttaattgtgtactccctcaatcctatagtgttacaaaagtacttgtagttcccttagccaaccacacttttacgtctctgtgctttaccacatgctctttctgttgagaattctctcgcctgcctcctttgaacacattgctttagctgtgtagcctttgacaagatccctcttacatatctttgttttggcactttttgcacagaattagaacttgtttgctcttgctattcaagttcctttatttagatcaagaattctgtgacattttagatctttttatgcttgtaacttaatttttcagcttcttgaagcgtgaacaaataactgctacatgttaaggggggtgagagaggac

SEQ ID NO: 87365 - DNA, 2082 bp, Homo sapiens
ttgaaaagattttcggagcattgtacaataacatcatagatttgtccctatatgtctgcactatggagtcaagctgtcatcccttgtccccctccccaagaccaccccacttatgtatatattccaacccctaataatctgggagttgaggaaggcagcaaaggaaagtaagtcattccaaaatactgcttccctctgaagccagttttgaaccccttggcttctttttataaacaggactgtaactctcacaatttttcaagtctggttgtggtttacatactgtgtgggatgggaataacattcttcattttatgaaagaaatttttgcacatgtgttacggagggttgtagtacaaagctgtatgttttgccccccttctttgtccccccagcacccgaatcttaaaattttggtccttcaggagccagattctctgtgtctcaggaatggtgtttttcttagtctttaaagactaatcttgatagcctagtgatagttgtaggctttggcctctattaatttataccaaatcacattttgaactgatggatttcaaactacaagtacaagcctttgcatctgactcagtggactcttaacactcaaggcaaatttcatccttttttaactaaatgcttgctttcttaattggatgaagcttgcactttgttcttatctccagtatattaacagcatctgaaactatcctcttcctttgtctccctctcctttcctccagcacctctaccttccctttgttatcttaagccggttaaatgtagcaggcacttctcttacgtgctagtggcaacaagacagaattgaagcagatcctctttttaaaaagcagtttccacaagatttatttagatgagagatgactgcctttaaaaaaatacattttctttcccccatgtgtttgttatcagagttgctttgtcttgtgtacatgcaactaagtttatgtgtaaagtaaacatacttaattacaagtatgaaggtgacagctttgttttcaattattgttaagaaaactattcattaggcttattttcagttgggatttagaattccatggaagtcatactatctgtttaaagtgtgtttattagaggtaatgtagtttttgcttaaaacgtagatgtagattgtttgcttagtcttagctgttacctctttaatggttgctgctgtatcgatgcaactcgtctcgtaatagaactatttttgtttggaagtgacagagctagtctaggtaggtattcattctaaactttactcttttaatgatttataattcttgattttgtttttagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacaggtaacattttaactatttttttatgaagaagaggtttagaacacggttgtgcccagaatgcagtttgattttgaaattaggtctttctatactcaatcctgttgaatttcacttattttggaagactttttttttccttcctcccatcccttctcttctccttcctccctcccttctcttcttcctcgctcccttgctatactgacatataatttcagaatgctcttaccaagcgtttttagctcttctgtggagattgagtagaaattgagtttctgtaagaatgatttgggatttattatggagtatttactgcagaatgaatgcttctatacctttttgtttaagacgtatatgaggcatattttaaacatttatgttaggctttaacaagataatgtttggggctgattttaagttaagaagtatcaaatctacagtgagagatgaagtgacaaataattataaatcctgctaaagatgacaaagcatt

SEQ ID NO: 87366 - DNA, 1040 bp, Homo sapiens
gtacatctagagagtttgatttagtaggtgttgcctataattttttttgtttatttgttgctttttgagacagggtgtcactctgttgcccaggctggagtgcagtggcgcagtcatgggctcactgcagcctcgaccttctgggctcaagtgatccctctgtctcagcctcccgagtagctgggactacaggcatgtgccaccatgcctggctaaattttgtatttttgtagagacagggtctcactatactgcccaggctggtctcaaacctctgggtccaagtgatcctcccgccttggtctcccaatataatctgcattttaaataccttatatggcttgatatagaggcaatgtagactacaggtgaataacactgacttaagttagaggttttcaaccatgactacacattggaatcgcctggacagattgtagtactttgtatattagacttagttgcaggtaatagaaacaaggtctggttgattagagcaatggtctgtttagtgaaggatattggatagtttacaacagctggggaggctgtaaaaccaagactgggaaatgaggagaaataatggaaaatgagcagtggtcagggtcccagccaacaactattccacagaactctgaggacacttctggatccatgattgcatttctggatgcttggaaattcgatttgactactatttccactaccagagtagcatctctgaaatcctaatacttttgtgttcctagctccctgttcaaagtctagttttaggcaagatcagatgcccacatcttatgtctgagaggtttggaaataattatttggtgtttggtgctcctaaaacagaaggctggttctaccaccaacaaaacttgtaaagagtatcttccctcttgttgtcccatcaggaagagggtttagattctaggcagaccaaaaaatttgaacttcacttttgttaggacatgtgtctctctctttgtaagtaagcagtttttaaaaattgagatagagattgcttaagatatcatctgtag

SEQ ID NO: 87367 - DNA, 1103 bp, Homo sapiens
tcaacatgacagatacaataatgaaaaggtttgaaatattgtgagaattaatgaaaacgtgacacagagacactgaagagagcacatgctgttggaaaatagtgccaataggcttgctcgatgcagggttgccataaaccttccattcgtaaagattcatctgcactgcaaagtgcagtaaaatgaggtatccctgtaatacgtaaactgtgctatctaagttttgaattgtctttcctcttatcagtttcatgttatataagagcttgggatatccatatttaaatgtgctgtagaaatgaaggaaactttaaatattagcttataatttttcaaataaccctcttgttctggaattttaccatctctaaaatggaattagactgaatgtttttattttctgtttgtagattcattattttactaaagtgttgattttctttctgtagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagtaaggaaaccttgaaacttaagcaataaaataagataacctgatgagttgggaacaatcctgtccttttgagaaattactccccaagattaaaaaatagaaaataaacatattactgttagtttttttccaaaaagtaaatagtaactttggatattagaaaataatatatatcaaagcacgatgtaagctgataaaaaagaaaataatatatacctaaaaatagagatgtgtatgaatacaaagtctctctttaatcctgtctcagagaaactggtttatagccatctaggactgtatagatgcattactgtcaaaagaagtgattccccatgcaaagaaacaatttagggtcatatttgacagactatttttttaaggaattttctgttatctccaaggcagagcaattatcaactacagggaaaagaattctacctacatcccttttcctagctccttaattaagcattactatta

SEQ ID NO: 87368 - DNA, 1134 bp, Homo sapiens
aaatcctaaaattaaaaggagtataccttaaacaacttgcaagtgaaccctaaatgtcatttagatatcatagcttcttcagtgtcattttctgtaggttatcaagattgaagtcctcaagaagttttaaattatgtggagttgtctttcagagctcaattaagtgggaatgttaatttttgatactgactgtgttaagaatgaatagatggtatcaaagcagttagtttggacaatgaagtaagttatttagattatagaatagccatattttaggaaccacataatggcctaacaccctatgacatttgttttcaaatctccttaattttttttctccttgtcttccttcctttcattattttttaatggcagcaagaaaacagctgtcacaatttcattacctttgtgactcagtattaacctgttctaaacagatttggtatcatttgtatccaaatgaacacattgcagctacattttattctttaaattgcaggttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaaggtaaagagttatgaaaatgaagttgtcatgacattaatccattgttaatattctgtttcttatattactagaaaaggaaccagcttcctacagataaactgtttttagattacatttgggttacattttcctttagtagaattccttgtcaatgcctctagatttggttaattttctctggatttgattagttttttaaaacccagattgttagaaggatatgtgggtctagcaagcttttgatttacatagatgtagtaatgtttagtcatttaggtgttatactgtttgacctcataaatgatagttactgattttatttccataacttggacatgaaatacatactgtccaattttatagtgggtagagctgtcaaaattaggctgaatttattcttatcacttttgatgttagtttatggtggactgaattaa

SEQ ID NO: 87369 - DNA, 1105 bp, Homo sapiens
ctgaccaatattcattatgaaatttgtacttaatttaatatgaacttgggataatacttagctataactgttttatgattataactattctcttacacactgacattgtaatttaagttgatgtatttttgattctggataatttttttttttttccaaattctggataatcttataacattgaaccaggggtatgaaagacagtgactaaatatttactccagatggtaaagatttgaaacttcctaacttgatgttaatagatggattcattcctttaagattgacctaagagattgatctctacagggtgtttagtgtgatgtttggatcactttcgaagagcgtttaacatttctccttcttacactttcgaagagcgtttaacatttctccttcttaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataaggtacgttaaattatgttgacataatcttgctttggttgcattaaatatgatattggcaagttaaaatcatttaggctgcaccacaatgtctccattactgctggtagaaacagaacaaaaacacacattgcataagatggattcacttatttccttttgaaaaaatatatattttttcgccgggcatggtggctcaggcctgtaatcccagcactttgggaggccatggtgggtggatcacctgaggtcaggagtttgagaccagcctgaccaacatggagaaaccccgtctctactaaaaatacaaaaatcagctgggcgtggtggcaggtgcctgtaatcccagctacttgggaggctgaggcaggagaatcacttgaacccgggaggtagaggttgcagtgagttgagattgcatcactgcactccagcctgggtgatagaacgagactcggtcttaaaaaaaaaaaaaaagttggatcttagtaagacaggatgg

SEQ ID NO: 87370 - DNA, 2032 bp, Homo sapiens
caagtcaagaagatagtggtgcttagatccctcagacatatataggttacactgtgagtttaataactgtccttatggtaaacctcatctggctccttcattatcaaattttcagttgataacattacattaaaagttgctttttgtttttgaaaaattggggccatgtgatgtgagtctgatatctgaatattcttagtagctagaagtacaagaggtacaagattgtactttgaagtacttaaatccttaacaaggtagttgatagtatctataagattgcagtcttggtgagctttttatcgttaaacaggatttgtggagaattctactgagacattgctgtgaacacaagattaagagtctaccaaccacaacccctgcatatttataatatattctgtgaaactaagtacctttcatactagttattacttatagtggacatagtgtcaactgctcatttctaaaacagttcatggatcactaaacaatctctttttcctttggacagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagtgagttcaatgaaacacattctcagcatgaattcattgaagcattgacagagaaattagcctgtattaactcttgattactttaatagtgaatttcctttcattttgatttactttgaaatgtataaaaattctcttacccctcatatcaaattcatacttgttaaattgagaaaattacttttgcatggcttatcagaatttcagatagcaggcacgtttaacatgttagaacaaacttttgaaatattcatttattgaaaatggataagccaggccaggtgtggtggcttgcgcctgtaatcccagcactttgggaggccaaggcaggcagatcacttgaactcaggaatttgagaccagcctgggtaacatggtgaaaccttgtctttactaaaaatacaaaaaagtagccaggcgtggtggtgtgtctgtggtcttagctactcaggaggccaaggtaggaggatcacttgagcccagggggcagaggtttcagtgaatcgagattgcacctctgcactccagcttggatgacaaagcaagaccctgtctcaaaaaaaaaaaaaaaaagaaaagaaaagaaaagaaaatggataagccagttataaaaattgacagatgtttgttcaaatatgtcatcaccaaggtctaactgggcaccttaaattgaaaatgaatttgtgctttcaccagtagttctatattagtgagattttatagtagaaaaagtctttaaatgctataaaattgaaacttaggagcagcgtttaagtctttgtttgtttataggttggatacactccagattggatatttctgctgagaaatgtaatgcgaatcagtccagatcagggacagcagtttgcccaaatgttagttcaagatgaagagcctcttgctgacatcacacaggtaatgtgattaaaatatattttgtagaagctgattgaaatggagagtgggggccagccatggtggttgacttgggagtccaaggtgggagtattgcttgaggccaagaattcaagaccagtctgggcaacattgtgagaccctgtaactacaaaaaatttaaaaatcagctgcatgtggtggcacatgcctgtcgccccagctactcgggtggctgaagtggagggatagcttgagcctgggaggtcgaggctgcagtgagctatgatcgtgccattggactccaacctgggcaacagagtgagactctcaaaaagaaaaaaaaaaaaggaaaacttacagtttgtagaaattaaagctttgtcactctatatggataaacctcaaatgccttgcaaaaaaagcaagttgcaaaagaatggacagtatgaaaccatctgcatgtagttt

SEQ ID NO: 87371 - DNA, 2364 bp, Homo sapiens
gtcaggagtttgagaccagcctagccaatatagcgaaaccctgtctctactaaaaataacaaaaaattagctaggtgtggtggcagacgcctgtaatcccagctactcaggagctgaggcaggagaatcgcttgaacccgggaggtggaggttgcagtgagctgagatcgtgccattgcactccagcctgggcaataagagcgaaactctgcctcaaaaaaataaaataaataaataaaataaaataaaggtctgtcggttcagttgtattctgctgttatgtaatatcttgaaatattttgtagttgtttttatcagaactcaaaataactatgatccctagaggacaaaaatttgttcttaagtgtttatattgtccaaataaaattctcaggtaaagaaagagttcatgcataattttgtctacatactctccatagtatcttaaaacaatttcttttaaatctttttttgtagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagtatgtgttttaatgctttttaggcatgtttccaacattgttttagtaattgtgcagcgcctctcagattgttatgcaaagctactgaggggcctactccttattaaagaaaatgtagctattataatattcttttgtactttaacagttcactattaaaccttaatctgtaatacggatattgaattactcatgtaagtggagtggacaataaacttgccttgtttgtggttttacaggttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgaggtatttcagtttcttacctaatagatggtgttagttgtgattaataggtacactgaaaatgtgtttgtggtactaaatattaataatttcataccaccatgaggttcaacattatttcatttattcattcattcatttattttgtcttgtagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtaattaggagtttttgagtttttaaaaaaagtacttaaggtagccaagaagaggtatgcttatgatcaggctgttggaaattttgtttttctaaaaatttggttctatgggacattttaattttttaagttttattcaatatatgtcaaggcccttttatgttggattctaaggatatgcagtgaaccagaccatctgtttggatattttatagatgaattaaaggtagaattttaagagaaaaatatgtagtggtgttgaaattgtataaaatgaaaatacaggttgagtgtccctaatctgaaaatccaaaatgcaccaaagtccaaaacttcttgagcaccaacataacgctcaaaggaaatgcttgttggagcatttcagaaatcggattttcagattagggatgctgatcaggtaattataatgcgaatattccaaagttcaaaatctgaaacacgtctggtctcaagtattttggataagggatactcagtctgtactaatgatcaggtataataaaattttatgcttatatgtctgactcttataatagcaggtgattctcactaagggcattttgtgatttgttgctatttagcaggatttcttaaccttagtactatagacatttagggctggataatcattgtagaggggtgttcctgtacatgtagaatatttagtagaatattcagcagcattcctggtttctacccactagattccagtagcgtcagctccaccagttgtgacaaccaaaaatgtcttcagacattgccagtgtcacctgtgaggaaaatcacctcagttgagaaccactgctatacagggtactaacgtaatcactgttgggtgtctaacttctggtccccaactgcctttctctcctctctgtactagtagtactctattgagaaggggtaagagagtctagtagttttcttaattttttcttaattttcccagtttcaaaatgttaactgtgcactaaatttacactgtttagta

SEQ ID NO: 87372 - DNA, 1026 bp, Homo sapiens
ttagtggctattatattggaaggcaaagataagattttcatcattgcagaaagttcttctggacaatactgcactaaattcttcccaaattattttgtatgtttcctataaattgcatattgaaaaacaccaggtattggggtcttcatttaaaatttcccatataggggcacaatggtgtatgcctttaataatcccagtgctttgggaggccaagtgcttggggccacaaattcaagaccagcctggctagcatagcaagacaccatctctacaaaaattttcttaaaaattagcctggcatggtggcatgcatctgtagttctagctacttaggaggttgaggtgggaggattgcttgagcccaggagtttgaggctgcagtgagctatgatcgtgccactgcactccagcctgggtgacagagacctgcctcaataaaaaagaaaaaaaggaaacattgggttgaattgtctattcttcaggattaaagtgcaatccattttactgatctgattaatggaatagttagtatttttatcgcgctttttaagcaaccaacttatatttgggagtattcaatataacagttttttaattacataaatgtttttcagtcattctcaaaagtgtgcctatgcttaattgtaattacttgtttctttaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggtaagtggttttgagtaatgtgttttctggttggattccaggttagcagttctacaagggtttggtcatagttcaaaaatattttttccctaaatgtgaagttgttagcattcttaagttgtgtgctggattatttcttccaaacataatattctgtggtttcctttgaaatacggaaggaaattggtgagtaa

SEQ ID NO: 87373 - DNA, 1109 bp, Homo sapiens
aaattttaacacctatgcatgaaaacagaataagtaatcctagattatctgtaagtgataaagataacaaaaatattttatatgtgtataggtaagatgactagtgtgttgatccatacttttttgatgttcatttagtaggaaaaacatgacatactaaaatttttacatagatagatgcagacagattctagaaatgatcgtaacagctattagtgcagagtttccatggtgttaaacaatacttattttagaaaaccttccttaatgtggaaaatctgcagctttacagacatttttattttttaatttaggatggctatattaaaattaagatttaccttggtgttcttgggacacttcatagactagtcttcgtattatttataatcgagtaactaatatcccctagtctcaggagccatttaattctaaccttgaaaataatgttcttagtggccatcactggggaaagttctaccctacttagttctgcttccctagtagactgtgttagaggaatcatttattgaggaatgtttcactgtgtataaatgaattcctgatggaaactgttgttttttgtgctctaccttatgtctgtggaatgtaacaggacatgtatcaggtaaatgcccagtacaggttttacttacctgtctataacatcttctatgtcagtctataagtaggattgtagtttggtatctgtaatggaatgataaaagcagttggcaatttaaagatatcttttctttaaatgctgggtttttttttttgtagggggtgggttttcttatggccacatgtggtcaccatcatgctgctccttgtaggctttgttataatagagtattagaggctggttgtatagattggatgtggggagggatagaaaatcattagtttgaaacaaatgtaagccatttatgccatatgtttgacaatgtgactatagttattaagttgattttaaatacggtagaagtgttattaccagtgaaagtcccagtatggtgaatttatcatctgagagccactggctcaggtatcttaatttgttactcttgttttttggtaaagggtgtgtatgggaaagacttggtatc

SEQ ID NO: 87374 - DNA, 1017 bp, Homo sapiens
tcaaaccatcttaaatacagatattagataattcaccttctaactgtagaaacaggcagtattgctataatgggagcctttttattagacagtcttgcatagtcatctttgactgtatcttctttggacttatttatcatatggaacaatgtttcggtaactaaccaaaccggtagagacagaatatagtatatgtgctttcaatacttattaaaccatgaagtcttgtttttagctggacttcctgctaaattcctctatctagttgcaaatttagaccctcagtttattactgaatttaaaaactgaacttaaagaaaaaaaaactgagcttaaaagcgatagagataaatgcttttttaaaattcctctttgcttttaataacataataacattcttctacttctttttaaccacaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacaggtgtagtaccattttaacagggataagttactctttcttaacatggcaatagataaaaatataggtagtcatttgttccaaagctactaaataacacatggagaataatttcctgaagacacctaacatagaggtgataagctagctaatagcactgggaaaaaatctgttttctgaaacattatagctgtcataggagatctgttaacttggttgatcatttttttggcatgtttataattacagctatgtggtttgactttatatgtttttatataaactatgtactaagtctcctgtttaggtgtgatacctgtgtatttaacaactaattctgtactgatcaatcatgtggtgtttccaacctgagaaagctgattaaaaaaaacagtgtggtgtttaagtgtgaggcaaaagagttccctgtgcaactcttgagttcaattgatattta

SEQ ID NO: 87375 - DNA, 1094 bp, Homo sapiens
ggagagtgaaaaatagccttatataccttctttttattcttggacaactcaatcatattttgagtcttaatttcccaatttataataggatcactgataattaaaattaatgtaaagccaggtacagtggcttgcacctatagtaccagctactcgggaggctgaggtactaggatcacttgagcccaaggctgtagtgcacaatgattgtggctgtgaatagccactgcacttcagcctggacaatgtagcaatactcggggggcggggaaaaagtatgtgaaagcacattatagaccataaggtatttacatagttagcatgtcaagagtgtgttatttataatacagtatgtgtgtgtgaggtttttttccttttttcctagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtgagtactgctagctgaatatgtagagaagctgcatttttaaaaacctgttacatgagagtttcagggtaattttaggtaatatgggacatttggggacggtgggtgcttttttaaaactttatttggaaataattgtgaatctgaaagtggccaaatagtggataaagtctatataccctttattctgattgacttgctaatgttttaaccccactagccttaccatttgtgttctcacactcttacactcaggcacaccattcatacatatgtgtatacacacacatactattttttaaccacgtgggaataacttgaatgcatcatggccttataccccttccgagtgtatggcctaagaataaggatgttctctttcattaaccacatgaaagataccagcttcagtcagtttgacattgataggatacctttaaaaatctgttctattctagttttgtcagttaccca

SEQ ID NO: 87376 - DNA, 3945 bp, Homo sapiens
gtggaggttgcagtaagccgagatcacgccattgcactccagcctgggtgataagagcaagactgtctcaaaaaaacaaaaagaaaaaagaaaaagaaaatacatcccaaaagacctgacttaattatataaaactctcttggttcatcatagtttaaaaggaaaataacaaactaaacattaaagattgctattattaacacttaagtggctaaattgattggaaacttcaagataataagtcagaaaaatataaggataagagaaaatacaaaagaccaagtgcatcagtgttatatcttactaataagaagtatagaactgcaaatgagatggggttttatacctaaataaaatagacaacatattttaaaagttctaaaaatagaagagttgttataatgagtcttaaattctcctgagataagtataaataaaatattttggaaacgaataggttgaaggctattaatatttcattcctttcctaggaagcacttctaagcaacattcccaagtagttacaaagcttcctaggggaaggttgtgggggtgggggcgatggttggaaatcattgcagcatctagaaaaccaagcaaatagccaaaaccagacgaattaccgatattttaattccacatctgtgtagctgaattttgaattatgtgtagccattaaagtgataatgatgattgctagcctggataatgttttaatcagggaaaagatagaaattatataattagagtaatttttcaacacaattatacatattgtatagatttgtgtagaaagacctctctatgtaaatttaaaggtctttttcctacttcattcttttctgcctatttcaagttttctaatgagaggccaacttacgcttttttaaaaccaacttgattctcagtacttatgtcccatatatcctctgtaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggtatgctttcagagggatccattggctatttatagtcagtctttaataaattatggcccatcagttttgggaaggaacaaaaagatcagagaaagttgcctgaattctcactcttctaatatcctcccccctaccctacctcttgagacaaaaacctctccgttagtcacagtggttattttttatgtcggataaacttaaaatattgcatttaaaatattcttttttttcttaaaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtaaatcttcagattacctaagttgaattactaaacactgtgctatgagggtgggcctaattggttgctacggcaatagagcagcaataaaatactaacagcttaaatgtaattgctttgggtaggattgattttactctaaccctaatttcaaacttggatacttaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggtatgacttcttaccttatgtattgaaacctcataaaatgattaagctaagcattaagatatctgtctattctgaattttagaagagttggatactgcatggtttcttttagtgctccatcttagtccagataaaaagaggctgtattttgtgaatttgtaagttcacaaaacttacaagtggggaagatgaatcttctgtttttgaagtctcataaaatcctgatagtgctctaatcttaaaactttaaggaaaaagaattcatctattcatttggtccgtgataatacagaagtgaaatattgcacggtttacatttgtcattatccatgtttccttgaaaaggaaatgaatgcaattttcatttacttgggtgaaagataaactaggatgttagtgtttggatatattttttctttttctatacttaggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagtgggtttccttttcagatttaagaaaaactagttgggctacttgattagcttggtaggatcaaaacatcataactgaagaattccaaggaaaaatctataggaaaacaaattctttctcattgtgaagatatcaatttgaaaagaggattaagctcacactaatatcttgctgaatgtgggttacctttttttttccaggttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtaatctaaacccaagtttgagtgaagaattaaagaaacgctatttaaacattagtttaaataactagccatgttttacatttgagttcacagaaaggaaatgtttattctaggtctgcttcgcctgtgtagatgggaaagaattccgtcttgctcagatgtgtggacttcatattgttgtacatgcagatgaattagaagaacttatcaactactatcaggtattaacgagacttttatatgacctgagatcttttaccatagatattcttatctttaactgcacatttctcttgttcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtaaccagtcattgtaacacagtgaagcaactgtgtagttaaaactaatgcttcaaaatatcttattctttttaaggctgttagctagactcatatctaaagcaattaagtctttcttatgcaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggtgtgtactttcttcagaagataaaggattcagaaggagaaagctcattaggaagtaactgacttatgtatggattttcccattgtaggttgccaatgtggaactatactacagagcaatacagttctacttagaattcaagcctctgttgttaaatgatttgctgatggtgctgtctccacggttggatcacactcgtgcagtcaattatttcagcaaggtaaagtaataattttaaaccaaagcttcatagcaaggaattaggacatacttcgataacttttgtccctgggacttcaataatgtgctatatttgtaacaaactctttattttaaaggttaaacagctaccactggtgaaaccgtatttgcgttcagttcagaa

SEQ ID NO: 87377 - DNA, 2760 bp, Homo sapiens
aaaacatgaactcattgagttcaggagaattgctgcttatctcttcaaaggcaacaatcgctggaaacagagtgtagagctgtgcaagaaagacagcctttacaaggttgataaagttgcggggcaggggctgttttaaaccaggcctaaaatggtgttacaagtgattataatctataaataaaagtattggttttgtgaatatgagagctgactttaaggcaatttaagttaatggatttcttgattctaggggctctcttatgttaaggtcaaacttgtctggggaaaaaaaagcttttagcttatctcttctttgaaaattttaatttaaatgatacaactaggaggcttttttccccttgcaaaaccagatttatattggaaagtttccattgtttttcttggtttactagttcagtatgtggggtctaatgtttttgactttcactatttctttgaataggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtaatgactcttctaagtgtattcagaactagtttccttgcatgtaaaattctacatgcacattaatttttttaaatgcttttttctttagtagaagtaagtcatttagtcgatcataaaatattcctgttcttttgaaatttttttttaatagctgacaaatgacactgattggaaggggaactcaaatgtagctgtttaccctcagtgtatttatgagggtgaaaataatctatgtatttttttatttaaaaaactttgataaattttatttcaaaatagtatttttctcaaaatcagttcttgtgactcaaatattcatgactagtattgtagattcccttttatttggttggttcctgactttaatgatgtctatgcctgtttcccctggggaagctgcatgtatattcttaacatccttttaatcttcacaatttttttgatagtttaacccctgatttaaaaataccataggaggtgaacatgggaaaaaaaaaacaagctgggggtctaattgccttataacattcactattcgtcttagtgtccttttttgatgtatgaatttactcaccctatcttcagcagttactagctgtctctctgtagaacatttttaaatggttttagaggatccttttcgtcaaagcaaaaaacatgattaaaatcagagtctcacatctgattccttcagcctgcctgagttggggggatgggagggtgaagaagcgctaccaacaacccctcccatactgaatttttcctcaggataccatttaattagataccattgtgtctgtttaaagtttttaaagaattaacattttctgtattcaatgtaagagaaaaaacatgttgccttatcttagccatagatgagaatagcttcttaaacataatgccaacttgtgagacctgtctttaagctgctgttaacctaagtgctgtaaatttttctagtgattaagctgctttctttcatactgtagcataaattcttctgcattaagctttgaagttacacaaaattctaaattttgcttccagtatgccctttattttcacttctctcatacctttttagtggttagatgtttcttccctaaacctttgttgctgattctacctttttatgctcaatatggaattgattttttttctaagctgcaccttctgaattcctttgcaggttgatgcaataaaggaaaaggtgaaagttgattctttaacatctttaagtctggaggactaagtctaaggaatttgcatgatgtttttccttcctcttctacactgctgctgctgctttttccccccaataaattttcactaaagcctctgcaagtcccttgaaacataactttaatagagctgtaggacattagtagacgtttgctactaatcggctaataggctttaggaagggcaggaggctaatcagtagttggttcacagtctctcttaaatatattatgaaaaactgagtatggtgagtttccatattaatttcaaagtaacaggaaatttctcttccctgtcagggtatctggaccataataggactgtcataatccttgaagtaaattaaaacagcctctggttttactttgtgagcttgcctgacagttgtcgaatttatatatgtatatatacatgccctaaaaggctttttggggtttttttttttttgtattgaaggactgtgatccagtttctgatctcttgattcttactaattttttgctgaaagtagatacgagagatactagctgcttccgaagagactttcctcatgtttctccaggtgtccagttcttatggtgctagtccatttttaagaggaatcaaaacctttttaatcatgagagccaagcttgctataattgttgctaagcaacatgaattatttttaacaaagtattaacttctactttctgtaataaggcatacctctgaagctacctaaaatttgctctcctatttatcagttggcttgtccaaggatgtcaaattcaggcaccttttggttgctgcttccttcattggcttgtctccatcccaatataaat

SEQ ID NO: 87378 - DNA, 1046 bp, Homo sapiens
tgaattcattgacatgcttacctgtaatttttctttttaaatccaaggatcagaaactttagttacagctcttaacaaaagcttgtgttcttaaaagacttctctgctttttttttgagcaatctaaattggatcagtggaaacaaaaattgaaagtccctgtgccagaggctgtcccattatatagaagaatcaaactttttgcttagcttgatgctattccttcagaattcttccccctacgcccaaacttcctatgtgtatgccagggcattgtgatattgccagctcttctaagtcttccatgtgtttctctaataggacttctgtgttcaacatctgattcagaccttaacttttaaacacatgttcacttcagattcttttccctggaagtccggaaatgtattatgcagtggtggctttttggttgtttcatttttcttcttttttcttagaagttactaatatacaggcatccatgtatttttctttataacttctgtagctctttcttgaatactggttagttagcaaaaccccatctgatccttgatggcacagagctgtgctttaagttctataactaataatttttgttctaagtgtggatgccaaaaaatggacatttcatatggtacttatactacataatagtctttaatttgatattagggtaatttgtaacacatcatttagactataaagtaggataatagtgtataaaagtaaactaatccatcttcctaggctagaaattaaaccacatttcatctgaaggagcctacttaggcttacttttctcaaactttcagttccctaacaaattaagatggattagactcatatttatggtatttaatatgaaacaattaaatataaaacagtgccctaaccttaatggcctatgtgaagactgaaagatacttttttaatagtttcaaacagaaatgaggtgctgccttaatctttttaggacctggtttttagaaacttttccactgaagtctacaatttttttttttgagtgatttttcataatttgc

SEQ ID NO: 87379 - DNA, 1053 bp, Homo sapiens
ctgcagctataaccaatatcatcagaagttatacacaattggcaaaagaatagcttattctgcccaaatacttgtccagtcactaggatcatttcacttttttgaataccatttgctttggggagggaagtattgccagaccatgaattcattattacctctgatcagttttaaacttcatttgaaaagtggttccttctcgttttctccctccctcaggctgcatcctagcatgcccagttttagtctggcatgagcttttatggcattttgaatccctccttcctgagggtttataatgacagtgctgaaaaccacctggactgaagtatgaacattgccattgaatttgagggggactgagaatgttctttctagtctgttttattttgacagaatttaacatactaaggcttttccactttctgccataaacctaggtttataatacttttggggtgctaattaacatgatgtgtttttctccaggtggataaattagatgcttcagaatcactgagaaaagaagaagaacaagctacagagacacaacccattgtttatggtaatctctctctgtaacctcaaaaaattcattagacaaatatttaattacttagagactgtgcctcaaaatagaatacaacaagcttctaaagtgcaaaaggctttctaagaaatactgctctctactgtctgattttttttctgagaagtcataaagcaggtgttgatattattcactaaaataatcttaaatacaagaaaactcaaaaatagtcatttaaaatcataacatgaatctttcctatcatctggtccctcacgcattacctgctcataaattactgaaaaagaaatattgatgaattccattttcaaaagagcaaaaggtgagagaacatgccaaggctgtctttagtatgctttacataaagaatacatcctcattttaaattctaactggggcagagaactgggtagagtttccatttgagaactttccagagagataggatcttcaaactctcaagtgaatatttaagacaattt

SEQ ID NO: 87380 - DNA, 1628 bp, Homo sapiens
ggaggagattggagtgttctaaatgctaacagtttgtcctgcctccttgcccctgccccctgctcctttttgttttcttctactgtaggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctaca

SEQ ID NO: 87381 - DNA, 1198 bp, Homo sapiens
ggacagcagcatagtcttggggaagggctaccaacacaaagggacctaaccatgtatagggaaatgctgtttcctccattttaatccaattgtatcatgacctgtttctctcatcttaaatatctgtttcagcctctcacttgaaccaccaagaccatttaaccaacagtactgtttttaagcccaagatgacaactgccaaccatagaacatgggaataggttttattttcatctcaagaacatttaagttgggtgaagaaattcagcttttgttgttagaatctgacaggcttcaaacacttgtgatggaggggttgttgtcatatcaaagtccacctagtaaagttttaggtgaccagtgactttgtcaattaggtctgctggtcctggcccaatccctaggacagtttgagagcctggtgcaatctgagtacgtccagcatcttgaattaaacttacagtcagtcccagcatttttgcatgggccaataatgcaatcagggtttcttcatcaggagctttgaccaccaccttgggctggccacagtattcccattgtttgagcatttcaggatttcttctttgaatctgcttgtaggctgaaacagcagcatgagagcactgggcagccactttcccttttcccatctttaagtcatttcgaaccacaagaatcatcttgtactccccgctgtctcccaagatgcttgcttcactttcagtatctgtgtgtgtcttgctcgtcttgcttttggggagcatcccaaagcatactcgaaggctccagcccaggcacatgccacaagcaactccaacagccaagccgagtgtactgggatgagccaaatattccataaccaaggatttggagggcatcttaaaggaaaggaaaacagttatcactatccggcagtaacaacttacagaggtataggcttatcagagaaacattttgactatacacttaatggtcatccagaaaaaaggcaaaacacacctttgatcttatgcctgcaccctgtttccaacaccctcttgcccaccaccagtgtactagaaaagattcaagcatccacatgaaacagtttaggtcattttgaatcttgatgtaaacgaagttgcataaagttcaaaaactctattcctcagtcttcccttagtcttgtggagatgttccgttttaccaagatgcctaa

SEQ ID NO: 87382 - DNA, 1031 bp, Homo sapiens
taacctggctaccgccagcgtgagacatccagggtgagacatccagtcagcagcgtcctaaaacactgctggaagtcggaatcacagtgccccagatccgcaatgcctaagtgggagagctccggaagacgccaagctctgaggacagcctcaggcttcggtccccaattccctgagttagtttacctacccgctccgaccccggctgctccggatctcaggatcctggaagctgctccttacggactctcacacccgccgctgggctccagacaaccggaacccgctcacgtcacttccggtccggtccctctgccccctgagacagcctccagaagggatacgttcctccctcctttcggcgagctcggttgatcctcgcgggatttcagttaggctcttagtgcgggccctgtgggtgtggcaagaggaagaatgactgctcgctttgtgattcttgatccggaacttgtcacccaggaaccccggaagaggtagctcacgcgatagaaacgtgttcgctgcccagaagaagggaaggcgcgagtgaggaaaggaggtactgtaggtaggttggttggctccttacagggcgaaggagaccaatatcattattcattttctcgccagtaggaacgtttcttttcacctcgttgcattacccaccttcttcattttctcctttataaactgtcttccgcccaggggccgctgagccctctgttcctgttctgcgaaccgtcctttggaggaaaggaacaggctgctggggaggggaagactcagaatttctagttcccagcaaagcctccaggcaggcagtatcgatgcgctctctccgaaattgataaaatagcgagcaggcctcataccctcagctgggcacttatgaatatccccagcgtttcgagctgtcgagctctgcgtggaaagaattggtttctaagaatatagtcgaaaatttggggccgggcgcggtggctgacgcctgtaatcccagcactttgggaggctgatgtgggcggatcacc

SEQ ID NO: 87383 - DNA, 1017 bp, Homo sapiens
agcggcccctgggcggaagacagtttataaaggagaaaatgaagaaggtgggtaatgcaacgaggtgaaaagaaacgttcctactggcgagaaaatgaataatgatattggtctccttcgccctgtaaggagccaaccaacctacctacagtacctcctttcctcactcgcgccttcccttcttctgggcagcgaacacgtttctatcgcgtgagctacctcttccggggttcctgggtgacaagttccggatcaagaatcacaaagcgagcagtcattcttcctcttgccacacccacagggcccgcactaagagcctaactgaaatcccgcgaggatcaaccgagctcgccgaaaggagggaggaacgtatcccttctggaggctgtctcagggggcagagggaccggaccggaagtgacgtgagcgggttccggttgtctggagcccagcggcgggtgtgagagtccgtaaggagcagcttccaggatcctgagatccggagcagccggggtcggagcgggtaggtaaactaactcagggaattggggaccgaagcctgaggctgtcctcagagcttggcgtcttccggagctctcccacttaggcattgcggatctggggcactgtgattccgacttccagcagtgttttaggacgctgctgactggatgtctcaccctggatgtctcacgctggcggtagccaggttatttgggacaccttctcatggttggtcacccggacattgaacccagacaccgggctgttcgttctcctctccgcgtacttggaagccttgctaggcttctttagagaacctcttagtcccgggatgtccaggaccttggagtaagtggagaaggtcttccctgctgatgactgagctatttctcaggatctgtcagtttggtttttgctctcccgaacctctggcgcatgatgctagatgtattcgctcctaaacgaaatccaggcgtgcaagtgccatctaaagctctggtggtacagggtagc

SEQ ID NO: 87384 - DNA, 1057 bp, Homo sapiens
ctctttagtctttctcggagatgatagttctaggtgctactgtcattcctgtttttgcccaagtgcccttgctgtgtctcccattttggtgtggaaatgaactctagattagagaatcctaataaacaggacaaattgaagtgataactttgtcgtggttttgtaaattgttactctgctttcacaaagccttgcaaatattttgaggaatagtaaattgctaagagcatattgcctcaagaaattccttattttatatgggaaagcagctttggatggagtttgctgaactgaagttaggtattatgtaggcccttatataaagcttattttaaaatatgctccttgatttgcagcatcaaggaaatttgaacaggagataattttctgtgtcagataaaaggtgatacttaaagtttaaggcatatttaaattaagcaagggcaatctattgagtaattatatcacagctaatatacctataattgctcaagagtttgtttgtattcttgaactacttaatcttttcagtagttcatgggagtattttctcttgtccttgagttttttaatgataactttgttctttatagattacctggaaggactaggcaggtagtgttaaaagccagggctataaagctagactgctttttttcaaattctagctctattactatgcaactcttggattagttactttttacttcttgctatctcagtttcctcctggacaatgaagtcaatacccttcttgttaggattgaatgaataggtttaaataaagcatttagaacagtgtctgtagcatatagttaaccatgattgtgatcattatcatcatgtggccccctaagctattgccaagaactctttcccagccctcttttaaaagcatagctttatgttgctgcttacttaattattgtttgctcattattaatgaagttccagtaaataaatatctgagtatacacttcactttgtctatattttacaacatatgtgagattcttaaccaaatgaggcattcttttgggccattctgttaactttt

SEQ ID NO: 87385 - DNA, 1066 bp, Homo sapiens
tgttaactctgttttaaatgcttcagctgcagttaaggtctgttacactcttttaatgcatttcttgtatctatataagtgttcaaaatgaaaattatttgatgtttgagttatgcttctgcccggtttgtgttctcaaccccatccacagacctataagatttgtttcagcaacctcattcttacaaacaaaactaacttacatacgtgcactcggtgcaaagtagatgccattgaaggtcaagaatatgtgttagatttctgtttgaggacatttcaacattttaaacagactaggaatacttggatttactcctacatctaggaatctcactgacattgtatcatcacagatttcaaaaattattgctactttattgaattttgaaaagtggctctcattaaaaatgattatttcatcttactttagctatgtggatagactagaacccttttacctcataataatttttgacggattgtccttgtcttacatttcaagatgtttagattgatgaataataattcatttttgttattcaacataaactaagattgttctaaatctgtggctacttctgttatgtaggctatggaaaccagttacataggcttttgtatagcatactaatatggaaaggaagtacctgtaagtgaatactcagggcagcatttaccatgatttttttggaaaattgtgacatttgagaagcatggagattgatgggtatgatactgcatttaaaaatattaaacagcatggagaaactaacattaagcgactgctatgtgccagtcactgtgtagtgcacttatatattatttatcttggctgggcgtggtggctcacacctgtaatcccagcactttgggatgccgaggcaggtggatcacctgaggtcaggagttccagaccaccctgaccaacgtggtgaaactccgtctctactaaatacaaaacattagccaggtgtgatggcagacgcttgtaatcccagctacttgggaggctgagacaggagaatcgcttgaacccgggaagcagaggttgcggtgagccgagatt

SEQ ID NO: 87386 - DNA, 1964 bp, Homo sapiens
aaataataatgataataataataataactggcacataatggaccgttggtatatatttgttgaattaagaatttgaagtggctttgtaattgtgtgattttcttcagttatgttcagcttcttagacagatcataagaatgcagatgattctggaggcactgcagttttacaaagttttacagtacgtatgattgggggaagaagaggcaaagtgaggatgttttcaagggaattttgaaaggcaaggaaaaatgttaaatcctttagaaaatggttaaaatgcagaaaagctttgaagtttttataagcttaactattaaaacactagtgggtcttttattttggctgtttcatacttgggatggttttaaatcatgctaaatggtcaaaatgccaaaaaaaaaaaaaaaagggttttgatgcttttataagcttaactgtttagaacctcagtggctctcttgtttggccttatgctatatttccttcttttgggaatggcaagaaggttttgaaaagttgttttttaaactgcaaatttattttgtttatgaagaaatagactgatgaaaataacttagttccctgggttatttcttacaaaacaaaatttcagactattatgttttccagagagaattttggagaaggaaatgtcagtatgctgttcttttttagcacgttgtgtaagagcacattatttgctcaaatgaaaacccctgttgcaatagcttaaaaacaaaaccttcaaataattgtgcaataccattgttataagtacgcactcatagacccaaaatgttttgggtaaaacaatgacactatgggaaagagtaaataggggcaaatgagttcaattatcagtgttttgtaggagaaaggttttagaatgttatttataaggcaaacctttttgtgccctgtttatcttttcatcacaaattaaataaattttacttactgtgatagagatgaatggctggctttaaaatatcttaaatatccttaaatatcttatttgtaaatatttatcatatatttagatatttacaaatgtttaaatatcttcaaaatattttttaaaagatattgcctataggatttggctgaatatgaacacacatagttttttttgtttttttttttgttttttttgagatggagtcctgctctgttgtccaggctggagtgcagtggtgcaatctcggctccctgcgacctccacctcctgggttcaagcgattctcctgcctcagcctcccgagtagctgggattacaggcgcaagccaccacacccagctaatttatgtatttttagtagagacggggtttcgccatgttggccaggctggtctcgaactcctgacctcgggtgatctgcccgcctcagcctcccaaagtgctgggattacaggcatgagccaccacacctggccaaacccacatagttttaagtatttgcagaacttaagtatagcttcaagttaaatgactggcagatggaaaatcattaacttttttatatggttccatttcaaacatcctcagttgatttttttattaataaaattcagatttgtgaaatagatttccattttgtaaacctattgtgatgctctagcatctttggtttttgttgttattgttttgtaattgcttgggctacattatcttttggctgaatcttcacacaagtatgacttaagtttgcagagtcaaactttaagcttctatgaactggtctgaatattttgtcctgtgagctccgatagtgctttctacttcacgatcttcataatagctagtatatattgaggtcacgtgaaaggtgaggcaatatgttagtattttatgtacattatcttgtttaatcctcaaccctctgatgtgtgtcatgttatctctgttttacaaattaagaaaaactgatgtttagagagatttacaaatttctccagtctg

SEQ ID NO: 87387 - DNA, 1047 bp, Homo sapiens
tttttttttttttttttttttttgagacagagtctctttcattctgttatccaggctggtcttcagtggcacaatctcagttcactgcaacctctgcctcccaggttcaagggattcttgtgcttcagcctcccgagtagctgggattacaggcgtgtaccaccatgcccagctaatttttgtattattagtagagacggagttccaccatgttggccaggctggtcttgaactactgacctcaagtgatctgccctcctcagcctcccaaagtgctgagattataggtactactagttgccatttttcacaagactctaggacttgctattagttgttatttgggagataaaactcttttcatctaaagtgattgaagagaataagcataaatgttagaaattctgttttaatctctgcactattgtttttcagacccctcttcagtgaatgaaaagaagaggagggagcgggaagaaaggcagaatattgtcctgtggagacagccgctcattaccttgcagtatttttctctggaaatccttgtaatcttgaaggaatggacctcaaagtaaagagtcttctcccactaccttttacatacacctcatttactcatttaaaaaatcctcagtaatctcttactttctgccctctactccatcaaaatggattaattacctttagaatattaccataggaacatatttattctcctttctttaggttgaagaaaaatagattagggaaagacattgctatttgctgtttgcttactggattatcacagttgtccactgttttttcatgttgaatctgcagtggagaacactgaaaaatacgatttttattttctctcctgattttaccattgggagaaatcaggtctgtgtaatttagatacactgattctttagcagggcaaggttcagcatatgtggcagttttactgatagtttgagccaatgaaaaagaactctgccatggaaatgtgttgtctttaaatttagtacttgtaagccctgtttcaagtaccataaagaacaa

SEQ ID NO: 87388 - DNA, 1054 bp, Homo sapiens
ctctagaatggtattttaaaacagtttactgccaatcactgaaatgactctagaatggtattttaaaacagtttactgctaatcacagagaagtttttacagttctaaatgcatttattttaaatatatctaaaattatcctcaaaattatcttattcataatttgctttttcctgtgtcctgtaaatagtaggactttaaaagtttagaaacaaggcttttattaaaggtttagaaataagacctttattccagttagattaatttttttgtcatctttgccattgtgtattaaagaaattaggcctcttcaatgggtttttaatcttattagttttttcctatttgaaacttactttagttgatttaattttgatgatggtttataaataccgcatttctgtatagagaattcacggttttcacctcatccctttttttcagtatgtgcaacgtatagagaaacagtttcttttgtatgcctactggataggcttaggaattttgtcttctgttgggcttggaacagggctgcacacctttctgctttatctggtaagaataattttattttaataagcaaaaatgatatttcctatctttttattggtgcttttatgtcagaagtaaaaattctaagatttgttttaattacctttgtgttttgtaagcattctgatcctccaatcagtgctttaagtttgacttagagttctgttttgtttttcctttagggttagtatttaaaaagcaaagagaaaaccccagttaagcaaataaggttgtttatttaaattagtttagcgtggaaggtttttcttttctttctagatttaattgcttaagcaattgttattttaataaatgaagtccatttaaatatgcaaaattccatgtgagaaatgtcttcccttacatcctctaacatcatttacatacttggatatttattttggtattcttgttgaatgtaattgatggagtattaacatgtagaactaaatgctttcttgagtcctttgaaccaaagtataaaaagtgccccttctgggct

SEQ ID NO: 87389 - DNA, 1049 bp, Homo sapiens
attacagatgttgtccaaacaactccagtctttaggaatgttttatcagttctgagggagccgtctagagtggaagaatgtctgtctgtctgttttgtctgcttgccttccttaaaaatactcatacacacacaacacacattctgcactcttaatgtgatgttgtagtcttcatctcggttgataagtatacttgcctgaattaggctaataattaatatgaacattttaggtctttcgtttttaaaagatatctctgtaagacaggaccctaaagtaaacccaacagtattctgtctctggtcttttggatggtatactgtttttcttgatgaaacatagacatgagtataaccttttcagtcctttaaatgctacaaagtgtgtgaagaaggtacaattatagtaaatcatgagccgctgtagtataaatccagaaaacttgaaaagttcaaaatccagaaaatgttttacttaatattaagcagcagtgtacatactgatttatcattttactaatatgattttttcacaaattcaagtatgaatatattcacccctttcttactatgaccctaattagtgtttgtggcacaaggatttctttctctgggcttaacatagatactatattattatcagaaaactacttaaaactcttcactaccagattaggatggagatagatagatagatagatagatagatagatagatagatagatagatagatagatgtggttttgtataattttacccttctaggacaattttttttgaattctaagtttctcttaattagaagaactagtagtgtattgttattcttaaagctagagtaaaaattgattacatagaattagtttggtttttttctaatcactaaaacttttctaatcactaaaactcatgaaagaatgtaaatcatggaaatgtaactttttaaacttatgtaaaaagagtttttaaaagataaaatatctttttccacagacaagtacctacatctgctcttactagaaatcttaccctttcatctaagtatagttt

SEQ ID NO: 87390 - DNA, 1724 bp, Homo sapiens
aaatacaaaaattagtggggcatggtggcaggtgcctgtaatcctgctactcaggaggctgaggcaagagaattgcttgaaccagggaggcagaggatgcagtgagccgagatcgtgccactacactccagcctgggtgacagagtgaactttgtctcaaaaataattaattaattagttaattaattaatttagtgaaaacttttaaactcgacctcctaaaaatttcttttattcggcttacacttttgtaacaaaataagaaaaacattctaaaaaatgtggaagctagttattcctcacaggaaaaaatatacaataatgaagtttgaaattgtttatgttttagccatgctgtcagtcatcaaactaaatttaaaaaaattatttgttttgatgacaaagcaattatcattgaaacaagatgattttcaaatgaaaatacgaggttaatgcagtccagtcattagcagggaaaaaaagaataaatatttaaggtttttcttgttaggttgctttgcacattggagtagaaaatagttttgggcttggcgcgttggctcaggcctgtaatcccagcactttgggaggctgagggggacggatcacaaagtcaggagctctagaccagcctggccaagatggtgaaacaccgtctctactaaaaatacaaaaattactcaggcatgttggagagctccggtagtcccagctactcaggaggctgaggcaggagaatcgcttgaacccgggaggcgtacattttagtgagccgagatcccaccactgcactccagcctgggtgatggagagagactcagtctccaaaaaaaaaagaagaaaaaagaaaatagttttgtggctgggcatggtggctcacgcctgtaatcccagcactttgggaggccgaggtgagcggatcacctgaggtcggaagttccagaccagcctggccaataatggcgaaaccccgtctctactaaaactacaaaaaaattagctgggtgtgctggcgggtgcttctagtcccagctgcttgggaggctgaggtaggagaactgcttgaacccagaggcagaagttgcagtgagctgagatcacaccactgcactccagcctgggcaacagagctagactccatctaaaaaaaaaaaaaaagaaagaaagaaaataattttgtgttatgtctgcttgttcttttcacttccacacctgtttgcagatatggcggtggaaaaagcactgggtaagcattaggttacctttgttaaactaaagtctttttttttttttcaggtttgtgtttcaaacaccttttataaaatgcctttagaaaggccccttttgggccgggcgccatggctcatgcctgtaatcctagcgctctgggaggccgaggagggtggatcacgaggtcaggagatcaagaccatcctggctaacacggtgaaatcccgtctctactaaaaatacaaaaaattagcctggcgtggtggcacgcacctgtagtcccagctactctggaggctgaggcaggagaatcccttgaacctgggaagcagagattgcagtgagagaaaaaaaaaaaagataaaagaaaaaaaggccccttttggctgggcgcagtggtttacgcctataatcccagcactttgggaggccgaggcgggcggaaccagtctggccaatatggtgaaaccccatctctactaaaaatacaaaaa

SEQ ID NO: 87391 - DNA, 1127 bp, Homo sapiens
aactagcacaagctgtgcaaatgtaggatgttcttttgcttctgggataatgaatgcttacttattgccacataactgttttttccatcttctggctagtgatcggcagagatgtattcatgaagtctggcaaattatagaagaaaggaaaaggtagatgttgtaggccagtgtttccaaaataataaattggttcatggttagtttacagtattttgttaatccctagaatatccagagagaatactaaatttaaatttacagtgttttggtttattcttaaaatgtggtaagagcttaactttaaggatgtaatagtctatcattattttacttgtgtttcagtgaacaacctactgtaatttttttcatcattcatcttattaatcagtgtcatcagattgggagatctttaataaactctagaaagaaccatctttccttcttttcctacttctcattaatgtttctaaatttgcctttttacaggactttgcctcccgggccaaactggcagttcaaaaactagtacagaaagttggattttttggaattttggcctgtgcttcagtaagtgaattgtattaaaacagaacttttactaagtggtagtgttatattttgatccatatatactcctgaattaacaaaagtgctatcacttttattgggtatgtaattttgtgaatcattcacctttttttttttttaagacggagtctccctcttgtcacccaggctggagtgcagtggcatgatctcggctcactgcaacctccatctcctgggctcaagcaattctcctgtctcagcctccctagtagctgggactacaggcatgcacccccacgcctggctaatttttatatttttagtagaggcaggatctcatgttgcccaggctagtctcaaactcctgggcccaagtgatccacctgcctcggcctcccaaagtgctgggattacaggcatgagccactacacctggcccattcaacttttttttttttttttttttttttttttgagacaagagtttcacttttgtggcccaggctggagtgcaatggcacaatctcggctcactgcaacctccacctcccgggttcaaacgattctcctgcctc

SEQ ID NO: 87392 - DNA, 1090 bp, Homo sapiens
gctaatgatatgagtgctttccagataatattcacatttcaagctaaagattttagaaccctaactgctgaaacaatcttaaggctctttcttcactcatacctcaccttagaaaacagccaccaaatatccaggaatcaactgaacgggattaaattcctgcaggtccacttactttatccagttctcatgtgatgggcacacacacaaacacacacacagtgccttagccatgagtaatataagcaaaaggacaccttggtttgctgtgagcagattgaacacctaaggtgaatatgagacccagcttctagacacattaggatgtttgcctaacctccttttgaacaatccagtagtgatcaaggaacccatatattgctttgcagtgtaagcaggctgaaagcagaataccacatatcaatgggtgataaaattaaattgttctttggattataatatggaagtccttctttttctctctatagattccaaatcctttatttgatctggctggaataacgtgtggacactttctggtacctttttggaccttctttggtgcaaccctaattggaaaagcaataataaaaatgcatatccaggtaattataccccctgattcactgcctaatgatgatgaacccattacaagacaatgaaacatgctcattcctaagtgaattatttagttattctttctgcttttttggttggtagcttacttaggtaataccacatagaatgtcatttggaattagtgatctccttgttttctttcttttcttctttcttcctccctccttccctttcttccttctttccttcctttctctctttctttctttattttttgtcctgtttaactatttatccaggactttcaccaaacaaaaatagtgtttgtgtgcagaaagatgcacatcatttttatatacacagcccaaaaaatgtagttttttgtttgttttgttttgttttaccaaccacaagctgagagaatattgccattcactaattcttactttctttcacatactctatatatatagagtgtgtaaagcagttcctcccatgttaccaatatcct

SEQ ID NO: 87393 - DNA, 1004 bp, Homo sapiens
cactgcattccagcctgggcaacagagcgagactccgtctcaaaaaaaaaaaaaaaaaaaaagattcttctttccaatgaaggacttcttttacagatggttccatctttgttcattctagcacaattagtttctccctcccatgtcttttttcctcctcctctaccctttcctttgtttcttctatgcatgtggttaagagggctcttccgtggtctgtgccttttatttattttgtagaattcccactcagacctcctgcctgaaagactaagacatatgttcttaaatgtgtgacacattttttgtctaacccagaacagtgacttttcaagctgctacatacaaaaagaaaatcttgttttgctgttttgcattgaaattgtgcaattatttaggcattggcttattttgattgttaagaaatgatagtagggaaagttcatggtgatgaaatcactggaaggcaagaactactagctctgttgattaataaaagatttatagctctaaataactggtttttggtatagaccccctgcttttcttcacaaattatctgtaataatagccttgctagcttcataatattcacataccaattgtatacctttgccttattagtcttcttgccagaaataatgtacgttagtctaacctgtccaggttcctgagattcatagtgagtggataaaaagaagactactgttggctgggcacagtggctgacgcctgtaatcccgcactttgggaggctgaggtgggcagatcacgaggtcaggagatcgagaccatcctggctaacacagtgaaaccccatctctactaaaaatacaaaaaattagccgggcatggtggcgggcgcctgtagtcccagcactttgggaggctgaggcaggtggatcaccaggtcaggagttcgagaccatcctggcctcctggccagcatggtgaaaccccatctatacaaaaaacacaaaaatttgctaggcgtggtgtcgtgc

SEQ ID NO: 87394 - DNA, 1008 bp, Homo sapiens
atttaatactaatttttatttaattttagactttctccagtgggagagacctgtgcatatttcttaaagagcataaccaaatctaacttttaaagttatgattaaaatgacatgttcccatattctcaccaaataggggatgtgaattcccagaaaataacattaagcatatgactcgcagcaaaccatatgcagaacattggctcattgtcatgttgccagggtcttattggaagacaaagtccccagttttaccacacaagaaaagtttccataactcaatcattgaacttgagggctgggggatggtgttggctggaacagggactttttaccagatacagaatgttccatgctcttctttgctgtctcctatttctgagctaacttgatgcttgacctcagagtcaggcttgcctgtggcaagagagatcattttaaccagtgagtaataaagtgcttgaatccgaatgttgtttcttatccctcactctatggaaagtggtcagaatgagctacgtgggcctggactttttcttctacagaaagaaaatctgtcctttcattttagaggataaaatggtccatgtatttgattctctttgactttgatcattgaaaataatcagaaaaagttatggaagtgtggaaccccagcatttgtattatctgatgaaaggatagaatttaaggcttaacacagggtttaaaccccagctgccgagactcagttatacagtctaacataacctctttctgcagcttgggaaaacccctttctcttcttgtccgtggtagtttatatatccttctcttttgacagttaacctttctatatgtttgttatggatattgggagaccacataaaggttaaaacaggagttctggagttagactgttagatgagaaatgggtacattgtatttggaagttaccgttgaccatttaatggagcattttagtagcatgatgaaaattaaaacccaaatatattggattacatggaa

SEQ ID NO: 87395 - DNA, 1079 bp, Homo sapiens
tgatttttaacagagttttgttttggcaaccaatcagttttacctagtccttatagaccactcctttagctctggccacattcatcagcacaaatgcctgcttttctcctgctgctcaagtctgccttctgaaatgaggttttgttctctagagcttctctttaatgttagcttatttcaaagagtagctgctaatgataaggaagtctaacctccaatctgattcttacagaaaataatgctaaatctccaaaagctagggcaattgcagattattttgtgataaaatatgctgtaaggcagtagaaacaatgtacctgataaaatacacctggagaaagcatggtcttccttctacacagccagaaagaaacccatggtgtcatgtgttcataataccactctgcgtacaatggactaacttaagtacaaaagaagttttaatcatttgaaagggcacagatgtgaatgaaattcaagatgttttaatcccagatcctggggtcaaatcacaacgaattttagaaggtgccagggactgtcagtccaaacttgtatatatgagaaagccctagattttctagtatagtgtgtgattttcatcctgaatttattttatgttggggtgccattccaagatcctggatgtaaagaaacatgattagggggctaccacatttcagatccaaagcaagtagaatacatcagttaccagttttttcttatagtatcagcttcaaagattcatatactgagccaggcacagaggcttatgcctgtaatcccagcattttgggaggtcaaggcaggcggatcacttaaggtcaggagtttgagaccagcctgaccaacatggtgaaaccctgtctctactaaaaatacaaaaactagcagggtgtagtggtgcctacctgtaatcccagctactcagggggttgaggcaggagaatcgcttgaagccgggaggtgaaggttgcagtgagccgagattgcgccactgcactccatcgtgggtgatagagccagactccgtctccaaaaacaaaacaaaacaaaacaaaaagattcatgtgttctat

SEQ ID NO: 87396 - DNA, 1030 bp, Homo sapiens
gggattatgggcgcccaccaccgtgcctggcaatatttttttttttttttttttttgtatttttagtagagacagggtttcaccatgttggctaggctggtctcgaactcctgacctcaggtgatctgcccacctcggcctcccaaagtgctgtgattacaggcatgaaccaccatgcccggccgaaatggtaattctttgaatttaatcagagcttaagggcaaattggaggacttccccaacttaactatgggatgagattagcatctttagcaaggtgcacagggttgcaagaatgtaatggcttagggagaatggcatttagggtatttcctaaaccaactatagaaagcctttgaactgtgttgcaaattattactcccaccgtgtgtgcactttaaattaatcttaagtgtcagaatggactcttgcttctggtctgctgcttgagaataacttgacacatgagatttagagctggcattattgtttgccttaaatgcatgttaagagtgagagctgtaatttctatttttatctagtccgttactaaaatagctttagtgataattaagcaaactatagtataagagtactttgttgaagctgaggcatcagtagcctaagtcattgtagaggtagagaaatgaaaaacagaagtaactaaaattttgatgacagtttgggaaaccaaggtgggaggatcttttgaggccaggaatttgagacccacctgggcaacatagtgagactccatctctacaaaatataaaaagaaacataataataataataaataaaacttttaacctcttgtctgttttcaactgttttcctagtctttcatggaaacctccatagagacacataacaaattggtatattaatctcagcattatcctcaagataagttatacatcatgtgaatacacatcatatgatgtactctatcagctaaaatgtatctatcagctaaagtgtatctctttttaaaattattatgggtacataaagtgtatctcttaatgg

SEQ ID NO: 87397 - DNA, 1195 bp, Homo sapiens
caaagcgattctcctgcctcagcctctcaagtagctgggattacaggtgcatgccaccacactcggctaattttttgtatttttttcagtagatacggggtttcatcatgttggccaggctggtctcgaactcctaacctcaggtgatccacccgcctcggcctcccaaagtgctgggattacaagcatgaaccaccatgcccagccttttttttttttttttttttttttaatacagaacacaaatttgagtgtcattcttgtgcaggggccatgctaatcttctgtatattgttccaattttggtgtatgtgctgccaaagcaagcacccagcttcttttcattagttaagaagatgaaggccaagactaaggcagggaggcctttctctgcctttcactctttagtgcacctcacagtcagttgcacttgagtaaggactgctaaacctctctgagagctgccagatgttcctgcctagcctcaggttgttggttcttcagacacctcttcattctgcccattgcaccagccctttcccatctccatgttccctccatggtaatttctttgtacacaacaaccacacggagcaccagcaatcaagattagctcccgggaactctggcgtgccctgtaccaggaagcacagtggattactacaacttttgataatgattgtttgctttgtaccaggcattattttcagggctgtttcacatgtgttgtacttaacaaccccatgaggaaattaaggcagggtggttcagtaatttgtcaagggaaacaaggaagtagagcaggcagcagaggcgttctggctctgaactactctgttctgtagaaatcagtgcaaaagtccaagcttcagcatacttgtttcatcttgtgatcacaggtagttttttttgttttttttttgttgttgttgttgttgtttatttgtttgttttgagatggagtctcgctgtcgcccaggctggagtgcagtggggcgatctccgctcactgcaggctccgcctcccgggttcaagccattctcctgcctcagcctcccgagtagctgggactacaggcgcccgccacctcgcccagctaattttttgtatttttagtagagacggggtttcaccgtgttagccaggatggtctcaatcgcctgacctcgtgatccgcccgcctcggcctcccaa

SEQ ID NO: 87398 - DNA, 1158 bp, Homo sapiens
ggcgattgagaccatcctggctaacacggtgaaaccccgtctctactaaaaatacaaaaaattagctgggcgaggtggcgggcgcctgtagtcccagctactcgggaggctgaggcaggagaatggcttgaacccgggaggcggagcctgcagtgagcggagatcgccccactgcactccagcctgggcgacagcgagactccatctcaaaacaaacaaataaacaacaacaacaacaacaaaaaaaaaacaaaaaaaactacctgtgatcacaagatgaaacaagtatgctgaagcttggacttttgcactgatttctacagaacagagtagttcagagccagaacgcctctgctgcctgctctacttccttgtttcccttgacaaattactgaaccaccctgccttaatttcctcatggggttgttaagtacaacacatgtgaaacagccctgaaaataatgcctggtacaaagcaaacaatcattatcaaaagttgtagtaatccactgtgcttcctggtacagggcacgccagagttcccgggagctaatcttgattgctggtgctccgtgtggttgttgtgtacaaagaaattaccatggagggaacatggagatgggaaagggctggtgcaatgggcagaatgaagaggtgtctgaagaaccaacaacctgaggctaggcaggaacatctggcagctctcagagaggtttagcagtccttactcaagtgcaactgactgtgaggtgcactaaagagtgaaaggcagagaaaggcctccctgccttagtcttggccttcatcttcttaactaatgaaaagaagctgggtgcttgctttggcagcacatacaccaaaattggaacaatatacagaagattagcatggcccctgcacaagaatgacactcaaatttgtgttctgtattaaaaaaaaaaaaaaaaaaaaaaaaggctgggcatggtggttcatgcttgtaatcccagcactttgggaggccgaggcgggtggatcacctgaggttaggagttcgagaccagcctggccaacatgatgaaaccccgtatctactgaaaaaaatacaaaaaattagccgagtgtggtggcatgcacctgtaatcccagctacttgagaggctgaggcaggagaatcgc

SEQ ID NO: 87399 - DNA, 1004 bp, Homo sapiens
tggctcacgcttgtaatcccagcacattgggagaccaagacgtgcagatcacctgaagtcaggagttcgagaccagcctgaccaacatggagaaaccccatctccactaaaaatacaaaattagccaggcatggtggcacatgcctgtaatcccagctacttgggaggctgaggcaggagaattgcttgaacctgggaggcagaggttgtggtgagccgagatcgtgccattgcaccgtagcctgggcaacaagagcgaaactctgtctcaaaaaaaataaaaataaaaaaatagctgggcaggttgaaactctactgtaggtccagctacttggggggttgagatgggaggatcatttgaaccccgggaggcagaggttgcagtgagccgagattgcgccactgcactccagcctgggcaacagagagagacgccatctaaaaaaaaaaaaaaaagaaagaaaatggcgaggaaggacccaaagaacccctgaaaagacagcaatgcccatccccaagccaggaatataaaggaggcaagtctgaggaagacagactattctgttttgaatatgtggaggggcgataatgaccaataggatggtggggcctgtaatattctctatcttaggcttcctaactcctaaactcctagtgaatatgccgttctttacaccacactgtaacttctgtcagtgaataagctggacttcttcagagaattctccagggtaacaggtccttaagccgtgttatgtggtggtgctgttaaagagatggcactgtgactggaccttaaggccacagtaaacttttaaaattcctctccccagtatcccgctggcttaaccaacggcccctccctttgagaactgagaggatggtagttcctggagagatcatctgtctttataaggagaaaagtttggcaatgtgatttcctgtatgtttctaccggagtccaagattccagcagtgctagcctagacagcagcggctgcatc

SEQ ID NO: 87400 - DNA, 1039 bp, Homo sapiens
accatgcgcatgctcactttcaaaacgaaaaacttactgagaacaaatgcgcatgttccataaacggagagttttgttgtgtatatattttttcctattcagaaagattaattacgcatgttcaatttcaatttacgaacttcagatatggtacgcatgctcactgtccaccgaacgctccagctgacaatgcgcatgctctagtcctccaagcgcgacttcggctggtgttttgcgcatgtttctgccagcgcctggatcctgccgatagttctgcgcatgtccactgcccactgtttggcttcacggaaccctgtacgcatgctcctacgctgaactttaggagccagtctaaggcctaggcgcagacgcactgagcctaagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggagggggtgaggcccggggtccccgggggcccgaggtgacagggccggggcggcggcgcgggctcaggaagcgcggtgtgtcctagagcgtggagacccaggggggctcctgaggagctgagggtcgcgcggcctgagacaggggagcgggcggggcggtcatggccctaggtgtgaggcctctgcggggctcgcaggtgcaggtcgcacccttagccccaggtcagcgcagccccgagcgatctgaagagggaaagagaacgggcgcgtggtcgattcctcgagctgttggacttgagtgtggcggggagcgggtggcgtgagcgtgtgttggggagacgggggctgctcttgctgggtgtcccgtaagtgcaggcgaagtgtggagggtttcccttcgagtctagaatttcaagtattgaatcttcagacctcccacaaccacctctcttctcggcctgtcgcttctc

SEQ ID NO: 87401 - DNA, 1036 bp, Homo sapiens
ttgaagatgtctgtatttttttcagaataattaatgtaattttgaggtggaaaaaaaaaccaaaaaccagttgacagccttgatttagcttgccagaaataagttgcctgaacagagacttgtgaatggtggtatgagggctttccttgctgtaatttagggtgctaaatttagaattgtatttcctaatgcatagcttggtttcaccctgctggcttagtggtttgttaatctttatggaataactttttttttccctagataaatttatcaaaaaatgacaaattgcacctgaagttcaaaaatgttgtcatactaaatcactgatcctggaccaaatgatcatcagttgataacctcttggtagtttagcatctaaattccaatgtctagttgaatacatgggttaatgacgtcagatgtttgctctaattacacaggggcttcctttcccttgcctcaccctcagtttttctcctctggcacctgccctactgttgacaaaagattgagatgatgtatataaagaattttgaacactttaagaaactaagtggcctaaaataatactgttcttcttgtttgtttcttttgttttgttttgagttgggtctcactctatcacccagactggagtgcaatggtgcgatctcagctcactgcaatctcagcctcctgggtttaagcgattgtcatggctcagcctcccaagtagctaggattacaggcatgcgccaccacatctggctaatttttgtatttttagtagagacagggtttcaccatattggccaggctgttctcggactcctgacctcaaatgatccaccagcctcggcctcccaaaatgctgggattataggcataaaccaccatacctgaccaatactgttcttttcataatcaaataagactaaatcaaaatcacacggtttagaaagtgggtattgagttgtgtgctttttcttttcttttcttttcttttctttctttctggtttttttgttttgttttgtttttgagacagtcttgctct

SEQ ID NO: 87402 - DNA, 1007 bp, Homo sapiens
ccaccacacctggctaatttttgttgggttttttttttttttttttttttttgagacaaagtctcgctcttgttcccaggctggagtgtgatggcatgatctcggcccactgcaacctctgcctcccaggttcaagtgattctcctgcctcagcctcctgagtagctgggattataggttcctgccaccacgcccagctaatttttgtatttttaatagagacggggtttcaccatgttggctaggctggaatttttgtatttttagtggagacagggttttaccatgttggccaggctggtcttgaactctcgacctcaagtgatccgcccacctcagcctcccaaagtgctgggattacaggcatgagccaccacgcccattggattctttaaatcaagctaataacttgaaaaaacagatacagagaagaagttttgtactatgatgtgaactaattgggtagttttggaaagatccctgattttctgctgacattgccaaatgaggttggataatacctaatttcatagatattttcaatgaagtaaatttgaataactgcaagactttttttctttgtcaacttaatgaactttttctaacttaccttagctttggggtgcttgatgcttatgaaaataaataattgtcttcttttactttgttgcactcctaagagcaagatgggtcaccagcagctgtattggagtcacccatgaaaattcaatcagggttcttgctcttgttgtgtctgctcaaactggcaaggtctgatccagaaatacggcctcaatatgtgcgccagtgtttctatcagtaaacgaaggatatagatttcattaagttggactaagtgatcttacttgaatggattatccaaggcatctacccaatgaaaaaccatagtacccctttatgcataaaataaacaattataaaaataagtaaataattgattgcccattctatgaacaaggaggcaaacgattatcaggccaccctcc

SEQ ID NO: 87403 - DNA, 1536 bp, Homo sapiens
tcattcctttgcccttaggcttgagtggaacgctcttcacaccagttgttcctaacagaaccattctcattgcggctttctttccttgaattggtaagctgcctgccttggctgtgggtgagtgtggtttcccagtgaacctttatgtgtggaacaatggaaattatcagaaatcatccctttttttttaggctttctatttctcaaggtacagtcttagggaggtgataaacctgggcatatcatctgtagattgattatgtagtcagggtgggatttaccctcctatttctaaacatgtcatctgcttcaaattaaaaatatgcacatccttttgtgaagcaacaatattgggtcacaataaatcagtttatcctacacattaatttaatagaaaacaacacttaaatgtttttttctaccttgattaccaaaactgcattccattgtttaatttcaggccttttctaacaaagaagctgcatttaagagccttagggatgaagtgcccttttttggaggaggctcactgagccgtgttggaggctgtgtttgtggtcgtgctggctgtgaaactgcctcagtcctctaggacacaccctctccatcctggagtaatctgcaggattgcaacattgttatgcagccagtattgcagtgccttgtgcttttcgaatccagacagggttgattcagccctttattcttttgaggtagataaatttgggtgtcacacagtttatagttgtgggctggctggcaggtgggagggcagatactgtgggcctcagctgtctataaatatgtagctgtattaagtaagggatgagtgggcttctaagggtcaggttataagataccttttgaaatcaagatgtgatctctgagaataacaaagttcctatttcctatgggattttaaagttgggtgtggatgggagaaatttgcttgaaatgaatggctattagcttaattcctacacagacagaacaaaacatgaccaatggcagtttagcatattctggacatctttgcaattttagcaatatattctaatggcaaaataaagcactttatagtttcactaaaatgagtgaaacataaatgtccccatgccttttggcagcatcctatgccatctctttttccaatacatccccctaccccactaatttggtctttggtgcatgtctgtttctttcaaggaattttgctccatacgtaaactgctttggatagattacactctttttaattttattaaatcacttttgtttccagcttttacttggcagaaatctccatggctttggggcatttacatcaaaaggggatcatctacagagacctgaagccggagaatatcatgcttaatcaccaaggtggagacataccgtaaacaattctatagtaaataatcatcttaaaatcctcccacataggtcgtggccattttcaaagccccaaattcatctctctattttgtatatttcctccctcagaattcatggcatcatagtacttgctgatatttt

SEQ ID NO: 87404 - DNA, 1232 bp, Homo sapiens
ggcctcccaaagtgctaagtgctgggattacagacccttaaacaatattaagtagtaattagtaaactatattttcttttcttttcttttcttttttttctgagatggagtcttgctctgtcgtccaggctggagtgcaatggcatgatcttggctctcactgcaacctccacctcccaggttcaagtgattctcctgcctcagtctccctagtagctgggattacaggtgttcaccaccacgccaggctaatttttgtatttttagtagagaaggggtttcaccatgttggccaacctcgaactcccaacctcaggtgatccacctgcctcagcctcccaaagtgctgggattacaggcatgagccactgtgcctggccaataaactatattttctcaagccaaagtagacaagcacagtctaaaaaggaaaaaaaaaaatcagtttgactaaggttctttatccaagctttttttcctctttaaagctgctgaaaagaaatgctgcttctcgtctgggagctggtcctggggacgctggagaagttcaagtagggattggcatctttggtgttttgtggggaagataatgctagttttatgtatttctgagggttatatgtagttgcttataagtttagcttattttgtgacttgtaacttcaaaaaggtgattaatttatcaatccagcaaagtctagtcccctcaacttttcttcctgctttttttttcctaggctcatccattctttagacacattaactgggaagaacttctggctcgaaaggtggagcccccctttaaacctctgttggtaagtatacatgaaagtgtataattgggtgcagtggctcacgcctgtaatccccaaactttaaagggccaaggtgggaggattgtttgaggccaggagttcaagaccagcatgggcaacataacaagactccatatctacaaaacatttaaaagttagctgggtgtggcggcttgtgcctgtaagtcccagctacttgcaaggctgaggcaggaggatcgcttgatatttttttagaataagaaaaatctcagagcagacagaaacattatttttattagcagttcaaagatctctggtctatcctctccagcatctttattttattttattttgagatggggtctcactctgtcacccaggatggagtgcagcagcacgatcacagttcaatgcagccttgacctccccaggctc

SEQ ID NO: 87405 - DNA, 1046 bp, Homo sapiens
tgttatccccatagtttcattgaccatgttcatctgttctctgaatttccaaaaactggtagttaaatttaggtggttgatctaattcagattaaactctcagtattgcatgctttgatcaggaggcataatgtgtagtttgtgtgtgtgtgtgtgtgtgtgtgtgtgtgtgtgtgtgtgtgtgtttaagtgatgttagtggtcactgatcattgcctatgtcagcatttcactaccagggtaatttggcaatgtctggagatacactgattgtcacaggttgggggagggaatgctataggtaccttcaggagtaagagtcagcacagcacagccccctacagctaagcgttaataggcctaaaatgtcagtagcactgaggttgagaaactctggcctacttttataatttcatcaggtgtttgtgaaatggtcttattctaactgttatttcttctttctttgttagctggaattctttcataaagagaaactctttgatcagttagttacccaaggtatagttcatacagtaaaggcaggatgtatgtttgattctttcctagttttcaaaataatgaattagttccctagcatcttccagaattgaccaatgaactttgtgtgtgtgtgtttttttcttttttagtatattatgaacttatatgttttaacacatttgtgtttcatttcatcgcagttatttttattttatttttatttattcatttattgttttgaggcagggtcttactctgtcacccaagctgtagtgcagtggtataatctctgtctactgcagccttgacttcccggcctccagcaatcctcccacctcaccctcttgagtagctgggaccacaggtacaccaccatgcccagctaatttttgtgtttctggtagagacggggttttgccgtgttcaccaggctggtcttcaactcctgagctcaaaagcaatccacctgcctctgcctcccaaagtgttgggatgataggcatgagccactgcacctagcagttatttttattgatgctcaattt

SEQ ID NO: 87406 - DNA, 1113 bp, Homo sapiens
tttttttttttttattgagacagactctcgcactgtcatctgggctggtgtgcagtggcacgatctctgcttgctgcaacctgtgcctcccgggttcaagcaattctcctgcctcatcctcctgagtagctaggattacaggcacacgccaccatgcctggctaattttttgtatttttagtagagatggggtttcactattttggccaggctggtctcaaactcctgacctcatgatccgcctgcctcagcctcccaaggtgctgggattacagacgtgagccaccatgcccagtcgatatattcacatttttaataggaataactgtatactaaaatctattttagtgcatgtttaagatttgaagatgtaatttgactcagtactttccacctacatttttttcttcattctgtgcctgctaagactattctaatactttattatagttaacccccgtgaaaagagctcccagagcttacagtgcatttgattgatgtaacatggactatttattattttctaaattattttgtttgtataaagcaatctgaagaggatgtaagtcagtttgattccaagtttacacgtcagacacctgtcgacagcccagatgactcaactctcagtgaaagtgccaatcaggtctttctggtaagtgaaagaatttccatgtagtcatgggaaattttagtgtgaggatgggctcttcaaagaaaattcagtttgcttgctttgcagttcatgtaggtaacctggcccacttttttttttttttttaaataagccatgcctttataacttattgatgcctacaaaatttattttcataatccaacattttattttagcaattagagtgggaatgtacaaatctttggaaagtatgattcccttttttttttaggccacagacttaaaatgatgtttggcttagcatctcaaccaaaaattagtcatagcagtcggggagaaaaacctcactgactacatgtattttattcctgaaacagctatagatttttggtactttttttttttttttttttgagacagggtctcaccttgtagcctaggctgggtgtagtgtagtggtgtgatcacagttcact

SEQ ID NO: 87407 - DNA, 1001 bp, Homo sapiens
gtagagacagggtttcaccatgttggccaggatggtctcgatttctttttttttttttttttgagaaggagtctcgctctgtcgcccaggttggagtgcagtggcgcaatctcagctcactgcaagctccacctcccgggttcacaccatcctcctgcctcagcctcctgagtagctgggactacaggtgcccgccaccacgccaggctaattttttgtatttgtagtagagacggggtttcatcgtgttagccaggatagttttgatctcctgacctcatgatccgcccgccttggcctcccaaagtgctgggattacaggcgtaagccaccacgcccagtcgatggtctcgatttcttgacctcgtgatccacccgccttggcctcccaaagtgttgggaatacaggcatgagccaccgtgccaggccaagtaggggatttttttaacattaattgtgaatatttgacatcaaaacatattggttcatatgtaatagtgaattctcattgtagaaatgtctgtatagatttatagcttgtctcctcagaaaagtaaaggtttttgatgttggccaacagaaatgatggatttatatcagaagaccatgaatgcatactattttgctcaaatagcacatatgcttgttgattttattactgtacttaatatgtcacatgaacatctatctcattttgtatcctttttttttcttttgtcatttgtttttggactactctagggagaatagaatatggggaaaataattgtttgggagtgttttttccctgtttttgagttcactggatttgtcactaacttaattcttaagcttttcttccccacattgctcactatgtaatacaagtagtgttgtatcttatgggatgggaaataagctctaaagttagcatggagttggggcatggtggcttatggctataaccttgaggtcaggagttcaagaccagcctggctaacatggtgaaaccccatctcta

SEQ ID NO: 87408 - DNA, 2955 bp, Homo sapiens
tgcagtggtgcgatctctgctcactgcaacctccacctaccaggttcaagtgatcctcctgcctcagcctcccgagtagctgggattacaggcgtgcaccaccatgcatggtggtgtatttttgtatttttagtagagacggtgtttcaccacattggccaggctggtctttaactcctgacctcaggtggtctgcccgccttggcctcccaaagtgctgggatgacaggcgtgagcccccgtgcctgggcgtatttaacatcttcatatggagcctgaattttcctgtttttttttctattcctgtcagtagggtagaattttgtttgctagcatatcaggctcaatggaattctgctttcttgaagtgtgtgcctcacgaaatggctggaaagaagttaacgggtctaaaaatgaggttgaggacgtgggagagtgtacacattggtggttttaggtgtgcatcattgtgtaggtatgtcagactgaacaaccccattctcttgagatacatgacaaaatgccattctgtagtccactgttactgtctttcagggttttacatatgtggctccatctgtacttgaaagtgtgaaagaaaagttttcctttgaaccaaaaatccgatcacctcgaagatttattggcagcccacgaacacctgtcaggtatttcacactcttattttcacttttttttgtttttaaacaacctacaagagtgtttgcttaagaagtttatgccaagttatataaatgaaagactgtcatactctctttggttgacataagcacagcatctatatcttacattgcaaaggactagtctgactaatctatgatgttatatggtttaccttccctcccaaaagtaagcagccatactggcaaatgtcctctttatccattcactcagcatttattgtgcaccaagagcaccagcactacatactgcatgttatgtgtgtgtatctatatagtactataatacaggaattgtccctgtcctgatgaagcttacaatttagtgggaaagtcacaatagacaaaggatatacaaaaatataattacaagtagtgcaaagtgctataatttaaaaggggaaaaaaagaatgtactggtagagagcagaggaaaaacaagggggcttctactcacagtgatcagagaaaggcctccctggtgtagtaacatctagcagtgaacggaaagagccagccctacaaaaataggaggtataagaatgttgcaggcagaagaacagcaaatgcaaaaaccctgagggaggagaaaagttgcccttttcctggaagtgaaagggaaatcagtgttcctggagtgtgtggtgagtgaggagaagggcagaggtttggaaaagtattttattttaaatgcaatagaaagctgttttgagcaggggagagtaaaatgatatatataatacgcatttaaatgtatatatatctcattgagggttttgggggtcaggtgtagaggtaaagagaccagttaggaaattctagcagttaatctaggtgggggagagatggttcaatttttgcctttgtgctaatccacgtgaaaataaaattaaatgaaaataaatgtcatgttaccccactccctttaaacgtaaaggaaatatgtcttgttgagatgacccttaagcaaatgaatgatagctcttccttgtcttaaagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtg

SEQ ID NO: 87409 - DNA, 2911 bp, Homo sapiens
ggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatttgtaatattttgcaaccctaggatttttttaaatagatgctgcttgctatgttttcaaacctttttgagccataggatccaagccataaaattctttatgcatgttgaattcagtcagaaaagagcaaggctttgctttttgaaattgcaactcaaatgagatgggatgaaatcctatgacagtaagcaaaaacagaaccatgaaaaatgattggacatacaccttttcaattgtggcaataattgaaagaatcgataaaagttcatctttggacagaaagcctttaaaaaaaaaatcactccctcttccccctcctcccttattgcagcagcctactgagaactttgactgttgctggtaaattagaagctacaataataattaagggcagaaattatacttaaaaagtgcagatccttgttctttgacaatttgtgatgtctgaaaaaacagaacccgaaaagctatggtgatatgtacaggcattatttcagactgtaaatggcttgtgatactcttgatacttgttttcaaatatgtttactaactgtagtgttgactgcctgaccaaattccagtgaaacttatacaccaaaatattcttcctaggtcctatttgctagtaacatgagcactgtgattggctggctataaccaccccagttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtttctcctatcccaagttcgctttgcatctatcagtaaataaaattcttcagctgccttattaggagtgctatgagggtaacacctgttctgcttttcatcttgtatttagttgactgtattatttgatttcggattgaatgaatgtaaatagaaattaaatgcaaatttgaatgaacataaatagaagtgatttatttttttattatcttaaagataggaaggaattagtatacgtatcaggtgtataaatggtttaaatttattttaacatgtcagatgtgttcaagttgtcatataaataaactatgtatgtaaggaatgggttaaaagctgttctgctgagaaactgaagctatttaagtatataacaagttttagtattgatttttaagttagatgttacacatctttgattttcaagttatgtcagatagtagatatgaattgtttacttaaaaaaatacatgtaacaatctacgtgaaagctagc

SEQ ID NO: 87410 - DNA, 1035 bp, Homo sapiens
ttgtgcatacatatcaaattatcaaatgtagctgaccaagtgtagctgaacagattgttgattgttagcacaagaaggtcttcctagagttttttatgaagctagctttcacgtagattgttacatgtatttttttaagtaaacaattcatatctactatctgacataacttgaaaatcaaagatgtgtaacatctaacttaaaaatcaatactaaaacttgttatatacttaaatagcttcagtttctcagcagaacagcttttaacccattccttacatacatagtttatttatatgacaacttgaacacatctgacatgttaaaataaatttaaaccatttatacacctgatacgtatactaattccttcctatctttaagataataaaaaaataaatcacttctatttatgttcattcaaatttgcatttaatttctatttacattcattcaatccgaaatcaaataatacagtcaactaaatacaagatgaaaagcagaacaggtgttaccctcatagcactcctaataaggcagctgaagaattttatttactgatagatgcaaagcgaacttgggataggagaaacaatagtttaaagagcaaacacaaacatagatgaacccatctttcagatgttattccggataatccactgagataatacttgtgctataatgttaagaatcacacaagaaaaagtactgtattaatcagcaacagaccacaggttatgtgtgacaaatacttttgtgatagtttgtccagcttgctagtgtctactcctatgaaaaaaggtagatgtttggacattgatgtttttgagaaattaaccattttcaaagccttaaaatctattcttcataaattcaacatttctcatgggaataatcttagatctagcccttgtaagctaggaaccatatgattaactgaatattcaaaataggtcctatattaaatatataatccaaggctcagtatattaatactatctaagatgcatcttgtttataatcattcattaccta

SEQ ID NO: 87411 - DNA, 1086 bp, Homo sapiens
attaattcaaacagtcctatttgctaaacccaaaaaccaaagctgaaatcccataacatcaaatcctcatattaacttaatgttcattatatgtcacatctaatcattttgtgctgagtattttattcaatttatagatttgagccatctcagcaagctgaagtacatttaaacacctagagtaacaatttgatcaagacaaatacaactatgtcaaagtcaaagcaattttatctgattcacctgtttttaacatttagattttaaagtttcataaagtgattattaggttgaggggtgcaggcatggagagaacaggacaagatactctactagtttaagaattatgtgtatgacaatgttactgttgaggatgggtatgttctattccacttgttttccctacttagataatccacgctatgtgaaggtcgactccccttccctccagtgaaacctgaggaccgctggattaagatagtctatttccgtttctccatttctaaacaaatatagaacctgctattacttcaaactagtgatatgaagataaactataaaactgttaaaagaggaaaacagtagtatgtatcagtaatcattaatgtgaatcatgcagtgacaagatttgtaatgttacctacttttaatatgaggtagagtaaagccagcagtatcccaagactccatctagttacgttaccaaactccccatagcttataaggtagcgaaaccaaactggtatgggaacaaaagttcggtagtattgacacaattcttctaaaagcatataccagtaaccctaaaaaataagaagaaaacaaatagagctacccaaactacttaactacatagcacaaacaatattagactgagaacactgagtatattatacaataatataaataactataaaattaatcttcataatgattatgactgaacctcaagctggttctcacatattacagtcactgagtggcctgctttgaaagaatttctaggttggacgcagtggctcccagcactttgggatgggcagatcacctgaggtcaggagttcgagaccagctggccaacatggt

SEQ ID NO: 87412 - DNA, 1050 bp, Homo sapiens
tgatcttggctcactgcaacctccgcctcctgggttcaggcagttctcctgcctcagcctcctgagtagctgggattacaggtgcccaccaccacacccagttaatttttgtatttttagtagagacggggtttcaccatgttggccagctggtctcgaactcctgacctcaggtgatctgcccatcccaaagtgctgggagccactgcgtccaacctagaaattctttcaaagcaggccactcagtgactgtaatatgtgagaaccagcttgaggttcagtcataatcattatgaagattaattttatagttatttatattattgtataatatactcagtgttctcagtctaatattgtttgtgctatgtagttaagtagtttgggtagctctatttgttttcttcttattttttagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaagtaggtaacattacaaatcttgtcactgcatgattcacattaatgattactgatacatactactgttttcctcttttaacagttttatagtttatcttcatatcactagtttgaagtaatagcaggttctatatttgtttagaaatggagaaacggaaatagactatcttaatccagcggtcctcaggtttcactggagggaaggggagtcgaccttcacatagcgtggattatctaagtagggaaaacaagtggaatagaacatacccatcctcaacagtaacattgtcatacacataattcttaaactagtagagtatcttgtcctgttctctccatgcctgcacccctcaacctaataatcactttatgaaactttaaaatctaaatgttaaaaacaggtgaatcagataaaattgctttgactttgacatagttgtatttgtcttgatcaaattgttactctaggtgtt

SEQ ID NO: 87413 - DNA, 1477 bp, Homo sapiens
cccatacttcatgactgttttgcggatgccttctgccattagagaactggaagcatttgcagctcaacttttttttttttggtgcaaatgttccctaaaagatcatttgtgtagggcagcagagccttggcattaagggagaagggaggagtccagtgataaataacctgaaaattcatctgttgtgattatttgctactcctttagtgaataaaggatacccagtgaggaatatactgctggtatttaactgcctgtttacttagaatatcttttatttgattttttaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggtaggacataataaaacattgacttgttttcattcctaaattcagttaattttctttcattattggtaatctacttaatgcatccagttacttattttctgtgagcttttattattgtatatgtttatttttaatttgtgtcattgttagcttatataatcctctttgatttttttttctttcaattaactggaacttattttctaacaggaatttctcttggaattgggctgctaacaacttttatgtatgcaaacaaaagcattgtaaatcaggtttttctaagagtaagtataacaagcaactaaaaaattattaactgtttctctccatagattttagagaaataattttgagagaaataggaaataacttgaaagaaataggaagtaataggatatattgtaacatccacgttatgttaaatttgttatctaaatcctggaataaattatctctcctaatgctgaattccttcaccttaccttctttgtaagaaaaaaaaattggttactgttaaagtagtaaaaaggattaaaagagttagaacacggtatctgatctgatttggcaagtcccttcatgttgtatcagttactttgaccatagtaagtaagaccatcatcatgaaaaacttttagtggctgggcatggtggctcacacctgtaatcccagcactttgggaggccgaggcgggcagatcatgaggtcaggagattgagaccatc

SEQ ID NO: 87414 - DNA, 1050 bp, Homo sapiens
tctctcctctcatctcgggttctgacaaggcctgatcctcacagcccaaattcacgattgtgaggaaaggtcagctcagaccaaacgtcaccgcccagacagacacaactaggtcaggcgtcaagctcgcggacatccgagcccggaaaccctaacactcctccaggggtaggttctccaagcctgaacatttttaacctcaaaacgcccaggatctcggaggcgtgtggtggatgccacataaatacataacacataacaacgacttattatttagcgccaggcctgaaggccgttctcaggcgcagctcgcttgttctcgctgccaaaacaccccggcagccgtgagctctccactcggcgcggtgcgggggcggggctaggaggtggagccggggcagggcgcgcgcgcgcgcgtgagaacgtccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggttaggcctgggggaagcgggcagaggaggaggcggcgaggggccgcggcgcagggggctctggggagaataggcactcgaggctcggacgtgggtggagaactctgccctcggagattccggaagagttgtgttgaattttcttcccttttttctcctctttcttgtctgtgcatgaaggaaagtgggagggttctatgttatttatagaaaagacactgaaagcctgctgtccaacgtcgctcttcagttttgacgaaataacacccgtggcgtcggggcctcggtgaaagcctttagtgaaaagcactgaaacccaaaccgccagacacggtgactgcaccactgttcagtcctgggagtgaaatagaatgacacagaacattccctgacgttaactctagcctcctcctagacaaacgggaaaagcacggcagtgtgggatagcctctgcgttttgtcagctggga

SEQ ID NO: 87415 - DNA, 1031 bp, Homo sapiens
tgtacttttaaaatgcatttaaaaaaatttcttaaagtagtatattcacaggctaaaaaaaatccagatagtacaaagcagcattcagtgtgaagcctttcttctaccctgacaccttagttcccctccccagaggtagctggttattcatgtgcacgtgtcctgctttttgtcacttcagcgtataagcaacatgtaaaatgtgtaagcattctattattgacttgttagaaatccttatttatgattacataattatcactgtgtgatgattaaccatttttctattactgaacatttgttttagtctttaggcttgtaggcttttatattcagggaatatttttgtgcatgaaatctgcattttgagatttttttttttttgagacattcctatgtggggaactattgggtcaaaagatatataatgtaagtttcttgatataatctaagcagatttgttaaactgttttcctaaacttttaggcttatactaattgaatatatttctatatgtatatatttaagtgtatttaccttttaacatgtgttgtctgctttgggtggaacagggaaacaccagacccaagtttccaggaagagttctctggtctcctgctcttgaaaatgttacgatcagctatagaagcatccaaggataaagacaaggtagactcacaacaaaacccagtatctcccaaacagatagttaatgtattgtagctgcagtgtggtagttcagtgtggcttgatgttcctcagactgtcccaccaaatgtactcctgttcaaaagagactgagggtgtgctcagggtataaatggcccattccacacgtgtatggtttctttactgtctcctgcctcctgaaaaatatcagtgcccattgtaatactacatgacatattcagattccttttaaaattaacttttttttattttccaaaaaaaaaaaattgacaagtcagaaagatgagtagctcttggctttgaatattacctgttaaactaataagtttaaaaagcacatg

SEQ ID NO: 87416 - DNA, 1936 bp, Homo sapiens
ttgatctatagattcagtgcagtctcaatcaaaattccagcaagttattttgcagatatcaatgaactgattctgaaatatatatggatatgcaaaagacctggaatagccaacacaatattgatagagaagaacaaaactgaaggactgacattccctgacctcaaaatctactataaaactacagtaattaagacagtgtgatactggccaaggaagagacaaacagatcaatggaacagaatagagagcccagaaatagacccacataaatatagtcaactgatctacaacaaaggagcagatacttttcaacaattggtgctggaacagctggacatcacatgcaaaaaaaaaaatgagtctagacacagaccttttagctttttaaaaatatttcttgttaaaatccggggttcattcaaggtacatgcattgcatttagttattatgtcactgtagtctttttaaatgtagagtccccccacccatcttttttatatcaaactgacttaggaaagaatccaacccaattgtcttatagaatgtgaactctaagctctgtcaccaaagataacaaaataaatcacattctcaatttgtcagattgtttctttatggtgttaacttactctcctgtcccatgtatttccaaactggaaatgaggtctagaagtttgattagattcaggttacacaaggaactactaatttttaattgcctgctgggataactaccatctttacagtagttgttgccatgatgataagttcttactgcttcctttgacagatgttaatgttcgtgtgtcaagtctcacactcttgggagctatagtgtccacccacgcacctttacctgaagtccaactacttctgcaacagccatgttcttctggactcggtaatagcaattcagcaacccctcacctcagccctcctgattggtggaagaaagcccctgcaggaccctctctggaagaaacgtcagttagctcacctaaggggtcttcagagccctgctggctcattcgactctgcatttccattgtcgtactgcccaaggaggattcctgttcaggtagcgatgctggctctgcagcaggaagcacctacgaaccatcccccatgcgactggaggccttacaggtaggagatttcatttcctcatctctgaaatggaagtaaccattcctccttcagagtgactgtgaggagcgagcaggtaaaaccaagccatatgtcaattgtgttcgtgggaattgtattttaggtatgggtggtgtattgttttgttgttgttttgttttggggaggtgttctttggttgtaaaatagcagattcattcctttttgttctttgattgcaaattattttagtcccttcaggtattatatgacaagtggatgtaatagattgtagaataattctgagtgaaattgtacagttaatttttgatttttgcaacttaaatgtttaattctctataagcttttccttggtcttgtacctgcttagagtaacaaaataattgttccttcaaaggaagaaaacaatcctagataaaagagtttactttttctatacaaatatgatctgagactaggcctggtcctgaggtctgctgctgattaactgggcagcatgaagcatgtcctttcatcttgtcaggcttaggttctttagttgtaaaattcagttaatacctactttaaagaatagttccaagacttaaatgagattctgttaatgaaaagcaatcatatactaaagcaccataaaactatgatacagtttattgatgttagtcacaaaataaagattatggttcttaatttcattcaacagatttcagcccctgttaaatgtaagcgatttctgaaatattgtaacacttttctggatattgcagccttgcactcaggtcttagaggg

SEQ ID NO: 87417 - DNA, 2642 bp, Homo sapiens
aattttttgactgaaaatgttaattatcatttttggatgagctggcctaagagagtacaatattattccgtattaatagtcctatgcttattacctatatcccatttttgtaaagttgggctttcttttcctttctaatactacaaaatcatctgagtaccaattgaaagtaatctttcaaccttataaagaaaatcttggtgccagtgacacctttcctaacaaatacagcagtccatgacaaagatgttctttttgtcctttccattcataagattgtacttaatggtattccttttttgaattgtcaaatactgtcactgcaggcagtgttatttcctgtacctaagactgtttctgaaagttggatcactaatgatgtctgccaagcagtatgtacacaaagttcctaaagtcctatttaagttaacattgaacacacatacttcagagtggaatatgaggcataatgttctcaggaactttaataggaaacagactctaggcacatgtgttttttctaccccatgggctgtttagttctaacttttcagttggcattctgcttgaataaaccaggcctctaattcttattctcatgcttaggatttcagatttttgtgctatggtgtagcttagatttatttcttactgtaaaacacctaacagcaatgggtttctagatttttttttagccaggtgtggtggcacacatgtagtcctagctacttgggaggctgacgtgggaggattgcttgagcccaggagtttgaggctgcagtgagttatgattgcgccactgcactgcagcctaggtgacagagcgagactgtgtctctaaaataaaaataaaataaagatttttttttaggtgtgggacgcaagtggcctagtttttaggaactaacagataatcccattgcctttattcttccaattaaaatgattgtaaatactttgaacattaaatatgtataggaagaagggaatctgactcctaattttcaactaatcaatgtgaatcatcccgaaatttcagacacgtgcctgtgctctgcaagttttatctgccatcttggaaggctcaaagcagtttctttctgttgctgaagataccagtgaccacagaagggcttttacccccttctccgtaatgatcgcttgcagcattagagagttgcacagatgtcttttgttagctttggtggcggagtcatcctcacagaccgttactcagataattaaggtaatgtaccaactgtgggttccagagcaggcttctctgttttaattttgtatactgttttacatagctcaaaagtaacttgacttaagaatataactaagtaatagttttattaaaaatacactatttggaagtctgtacctactcgtctgatcttatctataatctctgtatgtcccaataaatgatttgctaaaaatacttctttatctttagttgtaccaatgagaatacaagtgttattaaaaaaaaggggggctaatttttagttgtgtgaaaacttttcttttttaattaaatgctgcaaaatttgttctatgctgtggtttaatcaagccttttgatgagctactttttgtgttttacagtgccttgcaaatttagtatcaaatgcaccttatgatcgtctaaaactcagcctgctgaccaaagtctggaaccagataaagccttatattcgccacaaaggtttgtagtggcttaaaactgatggcttctttgtatcagtcagatgcagactattagtaaaaatatacagatatagatatatgtatatattcaaagcatttttacaactcttaagagatctctgcttattcttctcaacttttcaggggtataagctgttgcaagaattgacccctcaagtcccagtggaagtgagctagaggattaattgtaaagtttgcctgtttaatgctcagggcagtgaccagagtatccctttagaattaagattgagccaggtgcaagcagcccccctgaggagtatgattgtttatatcccttacacataggtagaggatggatggatggttagatagacagacagacggacagatagatattatctactttttggaaagaaaaactggaatacaaaatttaacttctttattgttatttcctatgaagttcagataaaaccccagaacttcaaatctttactaagtgcagtcttattatttcctcctacacataatgtatttgtgctataaacacttgccttttgtagatttgcctttcttttgtttgcaagctttcagatcggaccacattctgatgagttcagtttttcaggcagaattgtaacaaggaaggaatagtggatgttttctgtgacatagtgggaagagcatgggacctgaagtcaatccaagggtctggatcccactcccatttttgccatctcatggccatgaccctctctgaaccctaatttcttcctaacagcaagaattataactacatcataagatttttatgaggctcaaatgagataatgagatgtaactaagtccagttcactacttacactaatatgtaaaaaagggacccagaaagataagtcttaccctaaggtttcccatcacattcatggcagaaataagatgag

SEQ ID NO: 87418 - DNA, 1044 bp, Homo sapiens
atatcaaaatgttgccctcttgttctccagttgtgttttttaattgtcagccttaataacttgttatagagacaaattgtcttaacatgttttgattgtagtttgaaagaaaaatttttaataacacattgacatctttaggaattatttagaatgtttaatttttgaatgtatcatttgaattggtggaaataaataccatttcatgtttgcattttttttaaaaaaatgattttttaagtgttttttcttttttctcttggttatgaaaggtcttaccaagctaaagttcgccaaggagccttagtttgttttctttctactataaaatcgatagaaaaaaaagttctttatggctactggtcagcttttattcctgatacgcctgaacttggcagcccacagtcagtgtccttgatgactcttacattgaaagacccttctccaaaggtaagagaatttaaactctaagctttataataggaagaaaaaatttacagatccttattgttatctctgccttatcctgtctgatctgaatatagctcttagtaacactgacccaagttccgacttgaccactggacagacaggaaaataggaagtgggcttatgtgaataatacactgaggctgatcatgtaggatcgcttcctgccccagggcttgcttgaagcctgagcacactgaattctaactttggtgtctcccttgaactgcactgaagcagctgtgcttctcttccttttatgaaaatgttgattgctgtggtatttataataagaaaacatcagaaatggcttaaacaactcagtagaatatcatggtacataatggctatgaaggatgcataaggcttagaaaaatgcccaaaatgttctgtgaaaacacaggatatagaattatgtatacagtaggatcccaaacatgattttttcttgcaacttttctagttttcaaatcatgtgtaataaatatttacatattttaatgagaaaaacttatttttaaaaagaagaaaaaaatgattggcaggcatggatag

SEQ ID NO: 87419 - DNA, 1058 bp, Homo sapiens
agggtattaatgaagttacacttttttcttttctcttttcttctttctttaaactacatgttggggacatatttagtcactttaaaatgaagaagtaacgattcagtgaaaagccattctgaagtagttattatatatgtcttcatttgctcccacaatcagaataaaaagaaaaaatccaaagtaaaaccaaagaaaatccagcaaggagaggaggaggaaaaggaatccagtggtgaaatagaggcagccccagtcactggcacaggcagagtgaacctgcatgaagggaacacttggtgtccctcctccctgggtgtccagagtttgcctttagatggaagtggagctgcagaaaaagatggagtctcctcatccttcagttcttccagttggaaaagggtcagcagtagtgagtcagacttttctgatgctgaaggaggcatgcagagtaaaatgaggtagtagtattttgttacatttttataccttgtattctaagttgcatgtaagtttataacttaacctgaatgctgcatgtgatttaacttgaagagcctgatttctggggggcatggtgttattcagaacatgacttgttctctttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacttgttctcttgatctgccattgcacatgtcattcctctccttagaatattcttttttgccttttcgtcttgctaaccactactcatctttgatatgggctcagaaatcatattccccgggaagccttttctgccttggtgttattcgta

SEQ ID NO: 87420 - DNA, 1056 bp, Homo sapiens
gttcctccctgaaaagggactgatataaccacattgtggggttcttatgagaagtatatgaaataaagcattcaaagggcctactgttattgttgttgagttttacatttagcagagggttagcttcttttataatcattatcataatcatcaaaattgaagtttttaaaattttcccactatttcaaacaaggctacagttcacatcatcccaatgtcggaagtgtttcttaaggagagagttctagaaatgagattactgagtcaagaaatcaatcttggtcagaattgccctccagaaaccaagtttctataatttatcagcagttcccacatacatccccttgcttttaagagggctgggtttgccatattacagagctttcccaattctgatctgtgctatcttttttatcccttgtcacatttttcttgctaaacatcttctctcttttttcttgctcaccatttgtacatagtggtttataaacatgtacaataagaccacttcattattcttttcttctagaaaagaattcatggtagtttattaggtctccttagatcttcatttctgctttgtgtgtgtatatgtgtgtctataataaagttttttttcatcatctagagactgtctctcttccatcctaagtggtgctagtaagttgattcctggacaaccagattttattctgccttctaactgggtctcccttttccccctagttattgcaaaatgcattaaaaggtatacagtcacttctaaatggtgggagaatgaaactaacacagactgatgaacttggagcacttttagctgtgctaaaggtaaggcaagtcttcatatgatcattgtctttcctgtttcaacccatggtacaaggaccactttacatccttattctaaggctaactttgaggtattaaaagttcttacatatattttgagagagtagacaaaaatgttcatattcaaagacacttaatattaagaacagaaaataaatctccatttaataaatgcatcaaaattttaaaattatttatgaatcttag

SEQ ID NO: 87421 - DNA, 2117 bp, Homo sapiens
tgcctttctgtttggttcagtaaaccaatatcattcaggccccccaaccttataatttcttttttttttttttttttgagacagagtttcacactgttgcccaggctggagtgtggcgcgatctcagctcacagcaagctccgcctcccgagtttacaccattcttctgcctcagcctcccaagtagctgggactacaggcacccgccaccacgtccggctaatttataatttcttatggaagatatatttgaacaaaatatatctaagaataaattgaaataatcccctgcctctttcccaccaatatttttcccctttcctgaagctaccatttttatggtctacttttgatgcttctaaaatataagaagtagcttggggccaaggggacagcaggataaaaagaccccagttatttatttaagactgttaccacatgagtatgtgaatatatttaagagcacaaaacatatcaactagcattatgtgaattaggatgcttttggctgcaataagcagaaaagccatcccagagtcactaaacaatttttaaaaaaataaaaaggaatcactccatgtcccaagtcccaagggacgcatctgtagccccttaataataagaggctcatctttcccttcaccgtcctcagcatgtgggttatcctcagctagcatgtctcacagtcataagatggctgtgccaattctggacatcccatgccaaagaaatgattactgttcagcagaagctaattaactttattttatgttgtgtctcttgtacttaacagtaaggaaacgtgtcccatgaactctctagtagactccccaatatcttgctggagagacttaggtcatataaatacctctctaaaccagtctttaagcaggaggatggtcttattgtgaatggctccagctagtagtttcaaccttcactacacattagaatcacttggaggaggacttaagctcccttgatgcttacaatgtgcagccacagttagcctacatcagggtttctcaacctcagcactattgatattttggctcagatcattgttttaggggctgtcttgcacattgtggaatgtttagcagcatccttggcctctacccactagacgccagtagcacctctccaattgtgacagtcaaaaatgtatacaggcattgccaaatgttccttgggggttaaggttgccccaggttgccccactctcttaaactaattagcgtttacccttaggtctcacatgggagaggtggacatccaattaaattagtactctgccagcagggaaggaagaaatggatgctagtaggtaaccaacagtgtctgctgcatggagtaaggctgttttcagtttagaatctttgaaactaacatgaggtagcttctgtatgtttactattctcaggtgtatcatctttgtaacactggcaattggagatgttcctgatcacctgtggcacctataaccctttaccagctttccagcacttggtgacagtttgtctcaattgtccataaattgacacttggattagcctggtctgtcccaacaagattatcagctccttgacagcagggatatgccctctcttcatggtgtattcctcatgtcatgttagagatgcagtaggtatttagcagttatattggttcactgtgtattcattgagtgtttattatgtataaggcagtttaattaaatttcagtgcgttgaaatactcatatctgtgtattcacagctgccaatgtctggttagttcaaggaaaagttacaaggacttcatcaagttctactttactaaagaggaagaagtgagcaagaccttggggtggggagaaggcccctacgttgatcaaactttcaggccctttagaggtgatccttttgacacataaacgacagacacacactctctcttttatacagcttgattcaggtgagcatacatgtccataaaagcataatattttttaaaagttagatcagaatatatcttttcctgtcctgttaggtaattgttgatgaacagcacttggatttcctgttggcatatactatttcggctattcatcagtgtagttcctggacacacaggga

SEQ ID NO: 87422 - DNA, 1934 bp, Homo sapiens
gatggtggcttcccaggcagatatcagttcccagcatacacacacacacacacacacacacactctctctctctctctcacacacacacacacacagatatacaaacacacacactcacacagaaacacacacacaacacacacacaagcacacactcaaacactcacactcacacatgcacacacacactcacactcacacaaacccacactcactcacacacacaaacacacactcacactctcctgtcctggtgctcagggaccagggagcatagagtgacctgagtcttcactggcacctgctgtcatcgagagggcatgttccctgtggaataaatcggtagcagcattaaaggaagaaaggcgttttgctgtttcccataataaaacggggagttgtttctatcccagtgacaccccttgcagggtgcctgagtgatggtcctttacgcttttatttgaatgctgaccaattcgaatgcaaaccctgcagtctgctgtgttttggtgactgagcagtgctgcccgctcctgaccctggcccacctggtgttggggtcaccagggttcggggaaccagctcctccagggttactcctctccctcccattcctcagatgatgctcagcgcccttcatcagcagcccccccgggggtcccactccacagtttccaaagccctctccatccacctcctttaaactctctgacatcccagggaagcggattatctctgcagttcccattttacatttgggaaacccagggcttggagaggccatgtgcaccacctcatgaagttgtccctaccccggagctcacagtcaacagttggcaaccctgttcccaccctgttccacactggggctagactccccagccttgcatgtatgtttctgtggaggaggaggaggagggcccagggagggcgagagtggagttcggagctgagcatccctgcagcacagccttcaggccaccccaaagcgtttctgtgtgggaactgagtgggtgggcctgacttcagtggggtggtgggggctacaccttggtgccaggcacccgactctcagcccaccttctctccctgctcagtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcaggtgggctggatggaggccccaggcaggcctgggcacccgagttccccaaggactgagaggatggggctcctcccaggagggtgtgccagacccaggcccatctgtgctgtgaggtggctgaaaatcccatgggggaggacagcttccaggaggagagagcactctagtatgttttcgttacttttgtcagaccagtctgggatgtgggggcaggaaacgttccaggaagaaggacatgtgcaaaggcgcggaggcatggaacagctcggcgtgttcagaggactgccaggagctctgtgtggaggaaggacagacagtgaagccaggcagagcccaagcaaggcccaggggcagctgggctggggcccaagggcagatcacccaggcctgaggagtttggacattaccccgaggacaccagggcaccacagaggaggtggacgcagaggaggcaccaggacagagctgcagtttggggcagtggagggtgcaggagagggggaggcaggcagggagaccaaggaggaggccagggaaaggtccggggctgtcccaccctgtcccaccccgcgccacccctgcaggccagaaccagagctcatgaaggttgggaggcaggagacaatgtcccatctgggtgaagctgggatgaagagctagaggaggctgagggaggctgg

SEQ ID NO: 87423 - DNA, 1050 bp, Homo sapiens
ccatggaggtgagggccccttcccgactgggaccttgtctgggctctgggcgcgcacctgccttgggcaaggagggtagtccaggcccttcataggtccccttttcacccctccaccccgaccagatgcacatagtacatgagaaagagaaggggacatcgaggaatgtgaaagaggcccaggaccctgaagacgaaattgcggtgctggcctttctggtggaggtgggactcccatcccccacttcccggggaacccggggctgagagcttcttcttaggattcagagacctgggactccagcgaggcaggagggggcggggagactccaacttccgcctctgtttctggggttgcatgtccccgggccaggtggggagcccagagcctcaatcccagaagctgcctggccttccgcccccagatcgggagaatgaactggccaccaccactggctccctgcagactttctcaagacccttccctccctttccaggctggaacccaggtgaacgagggcttccagccactggtggaggcactgtctaatatccccaaacctggtgagtcaggatgggggagaagggcttggggtgaggggggggattcctcccacaaaggaaggggtgggtgtgcggggagctgggctctcagagtgcaggggaagaggggctccttctcccaccctcactgacagtgtcctctgcccctatctcagagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacaggtgcacagggcctggggcagggcatgggctcccactgcctggctccccagaaattatccctctgtctgccctcagaggtccctcaggatacaggtggggagcccaggtaactgaagtccgttgttaatcatcgacattcactgaagacaggcaagaaaagcctgagct

SEQ ID NO: 87424 - DNA, 1203 bp, Homo sapiens
ttgcactgctttcattccaaaacagtggttctcaaagtgcggcccctggaccagtggagtcaacatcatcactgggggaatttgttagaaatgctaatcctcagagctactgaatcaggaactctgggggtggagcccaggcatctggggcccaacaagcccgccccccagctgatgctaacgcatgctcaagtttgagagccacagtcctgtagtaagagtgacaagagaagcaggcattgcgggccccctggggtgtgagtgaaaggaagccaatgggcacttagccttcacccatgccacgcacctcatttacatcccctattcttatcatcttcacgaccaccttgagagccaggggttcagagcccctctttcctaatgagggctcccaggacaggatgaggtgcctgcctgaggtcacacggcagggagtgcagctccccctgccccgacctgctgagccccatcacttccgcagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatttttggagaaacctttctcaagtgtgtttttagccttccacaactaccccaccctgtccccctccacccacccctgttcctcctgttccagggcgggggctttaaggccaggagatttctcccaagcaggtaccaccaggtgtccccactcccgttctatgtgaattccgtgtctataccccactcccttctaccaggacctggaccttggagagatgctgaaggcatcttggagcttcatcacagcggaagctagaggagttccaatctgatctcttcatcatatagagggggaaactgaggctgagaaagacaaggttggggccgggcatagtgattcacgcctgtaatcctggcacgttgcgaggcagaggcacgtgaatcacttgagccctggagttcaagaccagcctagg

SEQ ID NO: 87425 - DNA, 1128 bp, Homo sapiens
atttttggtctttgtttattcatttagaccctgcaagttgattctcattaattgtcagattccactaccctttcttcctcatagatagtaattaccaatgtaactaagtatttgtgttctgatatctgaggccagtaactattaatatctagttctcagagcatttggaaaggttatcttaaatggctacctaaattgaaatccttttcagaaaaaatataattgcaagtaggtaggactggcctaaattgtctaatgtaataaagtcagacaaaatgcatactttatagtttcaagattttcagtatataaaatctgtccattcccattaaaaagtggaagattttaaataatttctttacagatgttttatttaagcaggtagctcaatctactaatgttgtttgatctgtgtttgttatactggttgtaattaatttttttaattcatgaactagcagaaaatttattaaattaactattaactacattcaccttgtaaattactgtataaaacttgttgacaatgcactgactttagaaagatgttaatgtacataaatagagtgtaaataaaatagtgttgatgtaccgaaatatgaactgtataaaaagtattggtaattgtatatggggtgtacctgtttatctgtaactagtatacaaacaaattaaatactgtggatgcctccatgtgccgtttttcctcatacaagtaaacacagaaagacaaattcttcagcctccctctctgtgatcctgttttaattctcctacttgaataatttctttctgacttacagaggggatgcttcatctctgaggttggaaactctgtagagcaggattcccaaactcctgggctacagaccagtaccatctgtggcctgttaggaactgggctgcacagcaggaggtgagcggcaagctgtatttagagccgctcccccttgctcccattaccacctgagctctgcctctgttagatcagcagcggcatgccattctcacaggagaacgaaccctattgtgaactgtgcctgctagcaatctaggttgtgtgctccttatgagaatctaatgcctgatgatttgaggtggagcagttttatcctgaaaccactcccc

SEQ ID NO: 87426 - DNA, 1073 bp, Homo sapiens
acacccagcttactggcatattttctggagaaagaaagagccttaattgtttaaaagcccttagctatgaagctattactagtttttacatgtgagtcagtgtatgtgagaaatgtttatcagagaaaactggtttgaatatattaattgctgaaacccaaatttgatagaataggcaacaactctaaaactggcaatacctcagcccctttaatgactccactgtaaccgttctctttgtgtcaataaagatggttttataaatacagagaagaatgtgatagtgactgatttgaaatggtgatagtgcctgtcattggcaggcatttagaagaactaaagggaggaatcagaggcctgtcttctgaactctctattctcttgtttgtacatacagatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattggtgagttcaggggatccatctaaacctgtggtttccaaactctagaaaaataatctatatgaattctacatgactgataggacccagcctatgtcaagttaatcactcttggaagaaccactcagacagcatacaattcaaccatttggtttgatatttggagtaggagagatgatacagcttccttttgccaaacattctagtgtcaaataatccttccattctctaatcttttacctggattcatcctgctaatgcttcaagtaatatcctgtcttctgtgttgcaaaagtagagagtatgaattcaccaggaaatttgtataatctcagtcctctgaaattcagaatgagagtgactgcatacgtgaactctgaaaagtctcatgatacaaaaaataattctgttggattatttccataccatgtcattcttttttctttttcccttaccatgtcattttaacgtgaagtaatttcataaatctagat

SEQ ID NO: 87427 - DNA, 1037 bp, Homo sapiens
tgcgccacagcactccagcctgggtgataaagtgagactttgtctcaaaaaaaaaaaaaaaaaaaagtatctcctaagccaggcatgtttaggaggatccctttaggacaggattttgaagctataatatgctatgatgctcacacctgtaaataaccactccactccaacctgggcaataagtgagaccttgtctctaaaaaaattagaaaaaaacaaaaaccaacacacacaaaatttatgtttcctgtgtgtttgtgtaggtatgtatatcttcactgccacgtaaatgcggatggcttcggaaaagttttttgttttggggttggtttttttgttttgttttgttttttttcttagaggatacaagaatgttcttgaggaaaatcaagttgtgcgtaattcctctcttgacagtctaatatataactattgcattaaaggttgactctttggtaaaaaagaaaaaggaaggtttgaaaactggtcagtggataattgttaaagaggtagtcttcgggtatagtggcaacttggtagagtagaaagggcactgaactaggaatttagcaacctatgttttagttctaattctgccactagatagctgattgagctctttggactttagtgtcttaattttataaagtaaaggaaaggccgggcacagtggctcatgcctgtaatcccagcactttgggaggccgaagcgggtggatcgtgaggtcaggagttcgagaccagcctggccaagatggtgaaaccccgtctctattaaaaatacaacaatcagccaggcatggtggcacacgccggtagtcctagctactcaggaggctgaggcaggagaatcgcttgaacctgggaggcggaggttgcagtgagccgagatcgtgccattgcactccagcctgggcgacaagagcaaaactccgtcttaaataaataaataaataaaataaaggaaagcaaggcttctagatcaagtaaattgattgtatagcagcaacaagagaaaacgaaattgtaaaaaaggt

SEQ ID NO: 87428 - DNA, 1047 bp, Homo sapiens
catgttgcctaggctggtcactagctcctgggttcaagggatctgctacctcagcctcccaaagtgctaggattacaaatgtgagctgcctcatccagcctaatttaaattttaaatgcaacatctgggtagaggttactgtattggacagtgtcttcaaaggcaaagagaaggaaaagaaaacaagtggtagaactgtttgtgtgctacaacatggtgctgatacaggtttctgcaaaaattctgcttaatagtttccagcagttactctttccttttcatttggccaaaagtgtgagttagggaagtaaaactggaaaattaaaatcttccaataaatctagaattatttatactgtgatttctccctgccctgtgttaagagactacactgtctctggtcctcaggatacttgagaaaagagcaaagatgaaaataccacaagcttatgatactgtacttatctttgaatttgtagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatggttagttaaatgttaggcaactcactgccagtcttgctagtgtcatttgtgaaatagtcattttctgtctttgcaacatcattgaatgtattttcttctcttcttttctttaattttttaaaatttaataattttacaaattttatttttttacttttttatcctgtcctcaaaatctgttgctgtgaatgcattttcaatgtattatatatgctaatataagtgatcagagccaggatttagtattactcatggtggctaatgtatgaaatgacattccttatccgtatattaagaggcaacaggatagtcagtgcatctgagtactactttctttagaaatttgtgtctcctgg

SEQ ID NO: 87429 - DNA, 1008 bp, Homo sapiens
aagaaattaagagtaaagacaaattgacaccaatcatgtctttctacataccagctggggaaacaaataatctaataaatatattgcctactctaaattaagctcctgcaactggtattatttatattcatctttgggatttctgaacacactctcacctcactgacagtttcttaatatgaaatgcaaaaatggagtctctgagggttggaatttagatccctgaaacggacaaaactgaagtcagtcgtatataacacacttcttcctgtgaaaagagataatagttcgaaaattgaggttagttttccgttatttttatcaagcattcatcctttatgtagttgaaaaattattcaatcatctcgttggttttacggatgaaagcgcctaagacattcttttgaaatatgttagagagagaacttttccattttatctgaaacatctcccccttctcatcttgcttctgtttctgtagaactttcctcaggacaaccaaaaagtacgactctcagtgagtggatttttgtgtgcatttgaaattcctgtccctgtgtctccaatttcagcttctagtccaacacagacaggtaagatagaactagaactccttctcatgattgctcctttaaatatttgtctaagagttgtcatcttttttatatttgttcatgctgaggatattatagcagaagaattttggaacccaagggaaaccttactgattattccatattttttcgacgagaaacctaaaatttagagaacccaagtgacttcagttagataggtagtcgttagctaatatacccttggaattcagatctctttgaacttgtatctaatataacatggcaacagctagtatgagaggaacatactaccagaaaatataaacaatagatatagctagaaagaaatccaatattatatgtaatttaatgtggtcactcactgagtccttttagccactagtatgctttgtctattctttatattacttac

SEQ ID NO: 87430 - DNA, 1045 bp, Homo sapiens
tttgccactaccaatggacagttatatgcacttagaaataacaggtaggtcagaaagttctgaaaaattacttgactccattaaatttactttatttaaatagcctgaatttgtaagcatagttatttgtttacaaataaagaccggtagtcagcatattataattgagcaacctaattttaggcatgacttgaggtttgaaagatgtagactggggcatgtttttttggtttcaaatatgccagcaactctctttaaaaccctgcaaagccactgatacttttatgtcagatgaacaccaaaaaaatactgatttcacttaatattatccctaagtaccatctgttttagtgtttacacataaaataaaaattctaggctgaaatatttgctattatatttacaggtcagatatatctgtacacagcatttaagactttcaatgaaacctgcattttaccaataaaagatcttttctctttactagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaaggtaatattaactactctaagaaacttttgattctatcctccaaagatgacatttttctcaattattatgatcaattgttaggttatgtgaccaagagagatactaaaacataacgaaaactgaacaacaacaacaaaaaatgccaagttttccaacccagaaacttaagagttttctaccagaataaagggataatactgatggtggtatttttgaagaagggaaatacgtaaggctgcctatatggagtgttctagctgtgtcactatagtataggtttccaccaaagactgctgctgttaccaaagactgctgctattacccttgacaactcttctgtattaccgctgttactagaattcttcctaggttaaagtattttatgtatttatgaatgtgtgttttt

SEQ ID NO: 87431 - DNA, 1022 bp, Homo sapiens
aaaatatacatattttatatgcatataaaaatgtaaaacgttatagaacaggatgtctttcaatgtgagcaaacgctgttttaatgtttctgtcttaaataacatctgtgtgcctgaagaacagtttgcttacataatactgaactgaggacacagtattgcacagtattggccaaaatacttctctttttttggggggggtcatttgacattaagattcaaaagatttcatgattatccaaaatatatttgttgaaatagaggcagactaagtactatactatttattttcttacaatggctctgattggattataggacatgttcattccaaattttatgggtaggaaataatgactgtgacttctcttatatttatagtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggtttgtcagttttgagtttctaatgtaagcaatagacaaaatgttctggccacaaatacatgtagcacaacttaaatgcaaactcaactattctgagatcagaactttactgcaaaaatgaatgaatttctatttctgtgcttaattcttatgcaataatgccaaaacaaaaatacgtttaatgaaaatagaaaactgttgccatttcatattgtaaactttatgggactggatgtaggaataattatccagtggaatttaaagagtccccgtaattgctaaagtaatggatacagtgacctataggcatgctttatacttgttaatggacaaataactttaatatttaccattgttaccttgataagaacaaatgaaaaataggattttccatctcaatttaatattttatgttaaatgaagagtaaggattatattctttacatttaaatccaatatatttaact

SEQ ID NO: 87432 - DNA, 2074 bp, Homo sapiens
tactatctttcaaagattattgttacatataaagattacatgttacaaagattatatgttacattataaactaatggtgtggccgagcacagtggctcacgcctgtaatcccatcactttgggaggccgaggtggctggagcaccagaggtcaggagtttgagaccagcctggccaacgtggtgaaaccctgtctctactaaaaatacaaaaattagctgggcatggcggtgggagcctgtagtcccagctactcagaaggctgaggcaggagaattgcttgaacccagaggcagaggttgcagtgagccaagatagtgccactatactccagcctgggcaacagagccagactccatctttaaaaaaaaaaaaaacaaaaaacaaaacgtattcatgtaaccaaacaccacctgttccccaaaaacctattgaaattttaaaaaagagaaagataacgcttatgaagtacacattgtctttctgtcatactgccacctaagttataaatatttatgaacaactatagtaggccagatatttgtgatatgttatataactacaaagaagttgtttttttaattgttactcatttttatctctgtatttgtttcaagtttactaaccaaataacaaaaacatttcctcctccttacacagaactaccttactcttctggatgatgaggatcataaattggaatatttgaaaatccaggatgaacaacacctggtaattgaaggtacaagatggaagcatgcatctatattaaattttcaaggggaagaatttaaagagttactaataacccattttataattttctccaaaacaactattatttgattattatgtttttatgataaagaaaccctttggaaaaaaaagaaaaagaaaaccctttgaactcttatgtaatcctaccatacaatttagattgctttaaagggaaaatattctgtttttagtcattgactgacaaagaatgggaatggtagataaaaaacaagtgaattcagtttacacatttatagttccttaaaattttcaagttgctgctttgagtttgagtaaaaagaacaactttcttgcatagttagtagcacaggctttcattagtcaccaacattggctactcactgacagagctatttgtatattcatagatttacacactggcatgcacatgccattaaaaactttttaagtgtatcttttcccatcaagttttgtggcaacattgttagctgcctttgtattaaaatgaataggccgggcgcagtggctcacgcctgtaatcccagcactttgggaggctgagatgggtggatcacttgaggtcaggagttccagaccagcctggacaacatggtgaaatctgtctctgctaaaaatacaaaaattagctgggtgtggtggcacgtgcctgtagtcccagctactcaggaagctgaggcacgagaatcagtcaagcccaggaggcggaggttgcagtgactcaagatcacatcactgcactccaacctggggggacaaagccagactgtctcaaaaaaaaaaaaaggaataaattactctgacagttgttacaatttaagaaagaattgtaatttctaatgttttaagtataagaaattccattgtttctgaactttaattacttctgtagatggttgagtataattttacttcaagtaggtaattgagggataagattattcaaaccaagtgactttaaagtcctcaatatgaagagtaggaatggttttagagccaattacaggcatgtgctgcaaaaagatgtttgtcaacaaaagacctgtatacagcagtggtcccataagattataatactgtatttttagttgtgccttttctatgttctaacatgtttagatacacaaatacttaccattgtgttacacttgcctacagtattcaatgcagtaacatactgtacaggtttgtagccaaggagcgacagcctataccatacatagcctaggtttgtgtaggtacactctgtgatgttcacacaaagacaaaatcacctaatgatgcatttctcagaatat

SEQ ID NO: 87433 - DNA, 1027 bp, Homo sapiens
aaataatattaataatcatgagcaaccatttacacaaattctcagactatgttaacaataccagcatgttattataatttaaataacttagtatgcaagaactacctctaaaccctgaccaaaagaagtacttgctctcctttgaaattgaacaaagttagttttgtatcttcattaaaggttatattcatttaatatatgaagattcttttattttttattttttatttttttcgagatggagtcttgctctgtcgcccaggctgaagtggagtggcacgatctcggctcactgcaagctccgcctcccaggttcacaccattctcctgcctcagcctcctgagtagctgggactacaggcgcccaccaccacacctggctcattttttgcatttttaatagagacggggtttcaccatgttagccaggatggtctctatctcctgacctcgtgatccatccacctcggcctgtttggtaagaattctttcagtagtgtttcgtagtaattatagcaaagcattggcccctgtctaccaaactttgtctttggggaaaacagcaaaatcaaagaacagtgaggctgggcatggtggctgatgcctgtaatcccaacagtttgggagactggggaggaagatcatttgaagccaggagtttgagaccagcctgggcaacatagtaagatcctgtctctacaaaaaattgtttaaattagctgggcaaagtggtgtgccctgtagtctcagctactcaagaggctgaggtgggaagatctcttaagcccaggagttcaaggttgtggtgagctatgattgtgccaccatactccagcctgggtaacagagcaagagcttgtctcttaaaaaaaaataaaaagtgaaggaaaccattttttaaaaaaggaacagtgagatagaacctttatgaaacattcttgatttaattttccattagaaggattagccttgcttccatggcacccattacaactttttcaattctctttgaaagataacatgaggc

SEQ ID NO: 87434 - DNA, 1095 bp, Homo sapiens
acatgtcagataatttgatcttagagcttcatctgcctacctaagagagtacttagctttaattttttctcttcataaaatgacatatttacttacgaatattactaattgtgagggtagtatgtttcaaatactggcaagactaaatggaaagatcagagaccaagggatcaggaaaaatgagccatcctttcttagaagtggctaaccccagatttgctgattcactggagcatgaataatttgattgtgtctctgctcatggaatcttaccagtctttccccgctttaatgtgtcaagctttattcttctatgtgtaatctcctaaaaaaatgtaaatggggaagaatggtgaaatcttttctatcattattacattacataatgtgtatcttcctttttgagaactatgaaggagcagctattactattcacatgcagattttcctatttagttatcacgtaactttagagctagaagatactttaaatcacctttcgtgcctctctcccatgggctttggggggtccctgttctccttagccaaggctggaggccaagagcagccctcgaggatcgtcgtcaggactgccacgagtggggcagccttgttttcctgcctcagacatgtgtagttgagtgggaaataaaaggaatgaaacacctctcttctctgaatttacaaatgaagcctctgaggtccttaggttttataattgcccaaagctgtatcagacaattattttattactttatctagcactctagagctcagtgtcctgagtcctgccttagtacctaatctgttgctccatgctgccctctatttttccaaagctagcatttcagtcactagtgaaatatgaaattgacataactgttaattgattcttgtaacatacctatgtacagggcataaaaagtagtagtatcatcaatagagaaaaaggtgaatcttgacccatattttagaacacataaactatttatacaactcacagggaatcctaaaatctcaaaataaaattctcttatattaaaataagtacctagtccttttgtgaattgttgactcagaaaatgaggacatttc

SEQ ID NO: 87435 - DNA, 1515 bp, Homo sapiens
gctgagggtggtaataggaattgaccaaaaatggctacagcagtctttttggattaattgaaatgttttaaatgttctcaaactgattgtggtgttggttgcacatatctgtaaagttatcaaaatcactgagttgtacacttaaaataggtaagttttatatatatgtaaattattcctcaataaggctgttttgaagaacatcattggttacatgaacattctgcaaaaaatgtaattaattaattaattggaaacaccagttgtttttctaattttttttaatttttaagtttttcccagaatcttttcctgaagtaattattcttgatactgccctatgactcttgaaattggtttatcaatagaaacagtgttgttttactaattgggttttggcagtctctcctaattacatctaaatgtttcgcggttttccttataaaacttctaatgataatttttgtgcgttgccacctatttcacactttgtttgatgtatttaatttcttttgtacatacagaggatggttagaacgagagagcaggtatggtctgcaagcaggacacaactggtttatcatctccatgcagtggtggcaacagtggaaagaatatgtcaaatacgtgagttagattcctgtctatttacatttttcacaggattttcagctgcgtgagacttccagccaataataaaatgctatgactaccagccaataataaaatgctccaacttaaataaagattcgaagggaaaggaaatgagtgtttatatgatacttgctatggtctaggctttgtgattacacttccacatacatttctttccttgcaacaaccctaaaaaaagataatattgggtacgggggtacctgcatatgtcacatacatcacatctcatttatttctcgcaccacccttgtgaggaagataatattatacccattttacctgtggggaacctggtgctgaaagaaaaagtaacctgaatgtcatgatcagggtggaagatctgggatcaaaccgaaggactgactttaaagcttatattctctcaactacatcatttacattgtcctttattttaccttttccattaaaatggaatttttttcagaactagaaaattgaaaagagtaatgccaagaatcaagtatttgccttcttggagagccaactgatatatacactcattgccaaatgatcactaacgaaaattctaatcatttgattcctatttgcctgtatttcctctgtcactgcttattatcagaatattggtagttacatactttttacattatctatctcatcattctttctcatcctttttccattttgcagagtttattaatgtgttttcacatgtaaaatatattaattgggaaacacggactttggtgtctctgaaggaataaaaagtaggcaaatgacttcctggaccttgtaggtagataatgatggtatgtgtaggtagaaaaatgagaatattggggtacagcatcagtcatt

SEQ ID NO: 87436 - DNA, 1050 bp, Homo sapiens
gtacacatgtagtcctagctacttgggaggctgaggtgggaagatggcttgagcccaggaatttgaggctgtagggaactatgatcgtgtcactgcactccagcttgggagtgacagagcaaaaccctgtctcttaaaaaaaaaaaaagaagaaaaaaaatcagtacaggtaaaagtggtgtgggaaacccaaaagaaatagcttaatttttattttaaatgttggatttaacagcctacttaaatggggaattgtagatttcttttttctgttttaaagcttcattttgtttattttggtttaattttcctaccattttggatataataaatttcagttttgtttttggtcgtgattattttttagcaattgaattgtgaaactaaaatatatctgtggaagatatattatcaggatgaactgaactcctgagaagagaattctgaggttttataatcttttttgatttgacccttagtggaggaatcagacatcattgatcttgagaaacgctattggttattgaaggctcaatcccggactggacgatttgatttagagacatttggcccattggtttcaccacctattcgtccatctctaagtgaaggtagggatcattccattttctacatatgttcactggtaaacatacctgagcccatctcatatttgtaaccaatacattttaactctaagaaaccatcttctcatatgtttgcaggtttaatggagtggggaaaaacaaatgggaattattattatagtcttgagcctgatattctacctgttataaccttgcataaatcagtttagctctctgcacccgagcatgctcatgtataaaatgtgtttgaccaaggcagtggttgtgatactgtgttccagtaaggtgcattagtagctagtgcctggagtcatgtggtggccactgaatgggcagagctccatgtttccacacatgacctcgtctcttcctccagtagggtgcctctactttttttcttttacataagaagattccattgctgtattctcccctccaaaaa

SEQ ID NO: 87437 - DNA, 1034 bp, Homo sapiens
ctgaggcaggagaatggcgtgaacccgggaggcagagcttgcagtgagccgagatcgcgccactgcactccagcctgggcgacaaagtgagactccgtctcaaacaaacaaacaaaaacaaaaaacaaaatgcagtttactggttttgggatatacttagcaaacaaaatctggcttattggcagtgtactgctttactgaattgatgaaataatttgtagttaacatacagattttatgcaagtagaagttatgaagcacaagtatttttgaaaagtttgatttccaaatatgtatatacaccctgcagtgttattagataatccttcctttgtagacagcagaaaggtaattgccaactaattgcaaatttcaggttgtgcaggttccaagtaagataccttaaaatttgactaaacttatgttttcttgttttaattttagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacattgtaagtaatgacatttcattgttttctgtttgcctttttttatatatataattggctggtaatatgagaatatgcttataaaggagaaatttatttaaattctgtcccaggctggagtgcagtggcaccatcgtggcttacggcagtctcaacttcctgggctcaagcagtcctctcacctcatcctcccaagcagctgggactacaggcactcgccaccatgcctggctaatttttttatcttttgtagagactgcaggggtctatattgcctatgctggtcttgaactcttgggctcaagtaatcctcccacctcagtttcccaaagtcctgagtcttgagtcacgattacagttgtgagtcactgtgcccagccaagactttttttttttttttttttttttttttgagacgaagtctccctctgtt

SEQ ID NO: 87438 - DNA, 1057 bp, Homo sapiens
aaatatttagagcagttcttaggacattgtaaacatttggtattagctctgtatgaaggtggtagaagggtctacctggagatagcatcagatcccacagcttgagggattagttccacaaaactgacccctagacatcttcgctagcgatcatgattgattaaatcattgaccattggtaatcagctcaactttaagccctctcccctccctccctagaggttaatcattgtggttttctttttttttttcccagtggccagcccccatcctgaggctatctagcagccccccacccagctgtggggtccattcattagcatgcagagtcatttatcactttggagattacaagaattttaggagttgcatgccagaaaaagagatgaagaccaaatatatatttaacaatatcgcaaccactaagaaattacaattaaaggatgctattgattttaagacttatcccaatgtcagagatgttaatgtgtgtaaaaatgtgcatcagcttgtagaatttatactaagcttctttctagactaaacatgggatacagaaagaatatgggtaggaactctcatctctaaacatgttggcagtgtactcatatgtccctgcaacatgtctgaatgtcattgtcaatgtcaaaataaaaatgtatagggcatacatgaagactgggtgatcttcaatatgtccaaagaacaaagagaaggttgggagttttctaaaaatgggagtgttacatatggtcctgagagaaagttcattggtattagtaaagctttagggagctggcaaacttcagttggtgggcgatggtggtgggcaaaattagttgcagcaagtcatctcagcagctggacttacagagaattacatttcgagagcaatgtatcgtgaatgctttctaccccgggcctgttgactctgatttagttatgacaagaatgacccaatttgtatgatccactttcacaccatattcttccattcagaaaaacaagactgtcaatgtcttgattgcttggattgcagtcacgttaaatgttctga

SEQ ID NO: 87439 - DNA, 1051 bp, Homo sapiens
ggtgttttttgtttttttttttcctctcctgagggaaagaaggatacttggaaacattttttaatatagttgaactaatgagtaccacatttttgatagcttcagaagtttgtgaaccaggagaatgataaattgtgtatttgattcgagaaactgctggaagcaaatgaataaactagaacatttgtcatcaacatatgttaaatagtcattttgttatattatggaaacgaaaaaaactaatgaatacttaaggacattctctccatgatatgtttaagactctcctgcagcgtttaagtatacaacagatttcctgtgacaataaactaagtgatgtctttctaaatttatgttctgttcttgtgggcagttttcaaagacacattcctcctcagaaattaatttaaattgttaattttatagtggcatattttacatgtttcagaatgggagcattcattcttagtagaggaaaacccatccaacttgcgtatttctccatttgtcctctaaagtttataaattgttactggttgattcatggacaaagagctttgttgtacaacatacagatttcattctatatttttcttcacatttttatgcttgttaatacgaactttctgttagaaaagagcagaattttctcagactacgattttttttaatgtgatgtattcaagctcagggatgctgggggaacagaagtagtggcagatggggcaacctgatgctttgcaaagatggggtggttcattttgattacagacactggcagtctgtgaagtaaagatatggagccaccatccattctacagtctgtactaaccatgtgtattgtggtaaagccaagaacaactttgtatggacatagtagaagggaagagtggatccacttttagtttccaggcacatacccacatatagtaatactgttaacactatatctttgtgttaacattgagcattgaggccaaatggcatatatatatatacatgtatctttctctctccacactgttttctactttgaattacagatggtctg

SEQ ID NO: 87440 - DNA, 1068 bp, Homo sapiens
ctcacccctgtaatccgagcactttgggaggctgagacaggcagatcacctgaggtcaagagtttgagaccaccctggccaacatggtgaaacctcgtctctactaaaaatacaataaaaattagctgggcatggtggcatgcacctgtagtcccagctacttggggagactgaggcaggagactcacttgaacccaggaggcggaggttgcagtgagccaagatcgtgccactgcactccagcctgagcgacagagcgagactccatcacaaaaacaaacaaacaaacaacaacaaaacaccagaaaaaggaaaaatagtgttaagagataatttagtatgtattgtttgtacacttcatgggtgtgcatatatgacgtgtttggttttatagtgaaaattctaacattctgctgtatggtttatggtgcattgtagacgttcctttaagtactcaatgataaagatgaaaattactaagatagagagtaaatctatattatatgtagtcatttctcagtttgcatagtagtatgggactgtaaaaatgaccatgcaagctgagactattcaaagggatcatagtaatcagtggaaaagattatgattgttctgtgtgacctttaaaattttttgtcaaaacattaaaaactctctcacagttggttatagatatatagggtaagaagaagcgtggtatccacagagaaggagggagcttcataaacaaagacaaacaggaatatcaactaccagccaccaacagcacttttgtaaaacttatttaaatattacaaaaaacaatatacaagattactaagagattggaagataaagggagaaaatttcactaatgatctcatcaccaaacacagctaattatttgctgttactcttttttcaaattagtgtttagtattgttttaatcataatgtacataaaattttgtatcttgctttttctgagatgtctgtttctgtccatgttatacatacctatacagtcatgtgctgcatgatgatgttttggttaacgatggactgcatacacaactgtgatcccataag

SEQ ID NO: 87441 - DNA, 1042 bp, Homo sapiens
tgtatgggtgtctctgatggcctagaagtgctgctagcactgtgctcattttatagtatatgctcaataattgagtgttaaaggatttaatttcctagtcacttataggtagttgtgtttgctagtggaataattaagcatgtaacagttgataattcagtacttttcattttgcttatccaccaaatctaagatgctttaaaacattgactcccaactaagattttgttcaccaatttctcagtattaatcttaaaatttcgttagatttatactacctatgatgtgatgttagttcgtttagcataatgtatcattctatacacggaaattgaatttcacagtcagtaccttctgggatgcgtatttatctcccttattaaagcacttatttgccttcctatgaatttttaaaattcaccagtgaactttctagcattagtttggaattgttggtttcggttaagccttttaaaagtataccagatcttactatttgtaaaggagaaaaatggggcagtttttaagtagtctgcttatatgtagtcacctgagtgattacaaaggtgctgttttcactaatctcactgtttcactaatttcactgttttcacctcactaatctttagttcgtaggtttggtgtgtctctgacaagaggagataaatatattgatgaactctggattttgggggatgagcaaaatgaggggacatcacttgctggttagtgagctccccatttaccaaactggacagctcttgtttgtttttccttgttcattgtctctctttgtgcttagtgagactttacagtgacagcactcagggttgccttccagaaagatgtgtaaggaagttagagttgggattgtgatgcccaacccatagccagatattttctcaggacgagaaaaggaagatttttggcactggattacatgcttggatcattggaaaagttagagaagtgattattatttttgttgtcactagagaaaaatctgtttttgcagcaccagagtaatgctgagagtttgaat

SEQ ID NO: 87442 - DNA, 1052 bp, Homo sapiens
tcgttcctaacagccttagctggaaggggacgaggaggcggctgcaaagcgctcctctctgctactggaagccccttcgtatctggggagtccctgccttttcccagagcctatgcctgtctcttgagggctgtggccatccgcttctgccacccttcaccgtttgagcggctgactttgataagaacgatctgaaatgaagttgtgtttgaggtgagatgagactggacagctggcgttggcaccagaccttgtcttaggtttcatctcctccgacgttgaccaaagcctttgactgcacttgatgcccagttctcgctccatccctctccatgaaatggcattgggaagtccagcattcagatattgtgttaaatctccctttagagactggcctggctgccagtcccggcctgctgcttattggctctgaggcacagtatattgttggcagccccaaccccctaccactcactctgataccgctgtccatgatcactaaagcacacactaactggaagtgtcttgttgcacagtttatggccggaatgtcttaatttttcatgactgggatttcagtgtgtgtagatctgtgtatgcttgtatttcttttagacatttaatggatattcttggtaagaagtgaaaaaacattaagaagattaggagctaggcattattgttaacaggtttccaagtcaagaaatcagccatgctccaggtggttttagtagctaaggatataaaatggtaattagattaaaagacgggtattcaaaatgaggcttgagaagtgaactcttgttcgtatataggaagaagaggggtaagtgggtaagttcagttgaccatcacctgacagtaagatacagaattgagatgtattggtggtggtggatttaccagaataacacagatatgccttttatgtctttctttctttttcccttgtggaacagtataataattgtttttatggacaatctcatttgaactttttttgtctgccccaatatgagaaatattccaaattcttgatgtgtttccagccc

SEQ ID NO: 87443 - DNA, 1800 bp, Homo sapiens
tgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcagacggagtttcgctcttgttgcccaggctgggagggcaatggcaccgtcttggctcactgcaacctccgcctcccgggttccagcgattctcctgcctcagccttccgagtagctgggattacaggctcctgccaccacgcctggctaggaaattttttgttgttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgcattcatagtgtatctgtttccaatttggttttgattgcttttggttgggattaagctttgcagactgtttttattagagaacagtgtgagagaaactgttggaactagaacaaaagtgctcttgttcaagaaaattaagatgtgtggcagaggaggcgcatggtaacatctggagattgtgctgatgaaaagcacttggaaaaagacaaagcactgcattaatgcaaagggattttttagtctttacaaaagtataccattcttttaagaatcctctcactctaaaggctgaagatgaatgatgagacctggtaaagttctgctggaatagtgaagaaaagcctagattggagtttcagttccagctgtctctgaactggaagattctgagttacgtcattccagccctctttgtgttttatttcctcacatgaataagggggtaaaatcaggtctttaaaaaacttcaccatgaaacagcataaatctgaaggactcagaaaccagttgtaggaaacgaagccatatttttaaagattaggaagaaaatattgtagacaaaatcccaccatcacttggaatatagtcagcaccagcttcactgcctgc

SEQ ID NO: 87444 - DNA, 2012 bp, Homo sapiens
tgcaccaccacgcccagctaatttttgtatttttagtagagacgggtattcaccatgttggccaggctttcaccatgttggccaggctagtcccaaactcttgacctcaggtgatccacccaccttggcctcccaaagtgctgggattacaggtgtgagccaccatgactggcctgtgcatgtgtatttttctgttgttggagatgctgccattcttctttgagatctctttaaacagttctttcaaaccatgaatttttataattctattctaatgaggccaacttctttagacgagaaaattttttttaagtcttagtgatagctcatggttgggactgatttaggggatgctgatacaagaattatatctattcctttcaggggaataaacctaagccaccctgtttaaagaattgaacttgtgttcatgttatagaaattgcttgttatctcattatttgtgcttttttttttttcctttttcttttttgttacagggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttacttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgta

SEQ ID NO: 87445 - DNA, 1587 bp, Homo sapiens
aatgttgcaaggctcttgcaaaatacccctatcttccatttcttattttaacttttcttctgattaccaccaaggctttttcacgtaatgcatttattttgctaacatgattgggtcacctatgtgttatttccgtgcatgttggatatgttctaccttaattctggaactgagttttttctccctctaggtttgtattttttaagttgcacaagtaatacatgatgttagatagaaaagagaaaaataaattgccttaaaatcccaccaatcctcagtcaacattttggtgaatattattttagacttttcttacttcaaataagataactaaatgaatgatttaattttataatctgattttttcacttaatatattacattttttcatgtctctacatatatccttttttctaatgtatttaaccttacctttattatttgactcttataattatttttaaccttttctttttaaaaaatgctacagtgaagtaaatctctttttcttacctttgtgtacatagacagttttccaataaatcaaattatctggtaaaataatatgtatattcttaagactttagatagaatttgaaagtcttgaatggagctttgaaattgaaatgtcttgcctgatttggttggtcagatgagtaggaggaaatcagttcttttagccgtgtttggttaaaggttatgttttataaagtgtgttttcaaaattttcagaagtgcttaggtactccttgacacagtttcatgactttaaaaaacttgccttgtgcttccgtttaatttgaaaaacaaatttcacatcagcaaagtatagcagtctattaaaatagaagctaattctgcaaaatcgtttataccattgtttttcttaaatttgaatatatatactgtgcaaaatagaatgaccaccaaaaagtgtacttttttgttaaaagtggaattctttcatcttgaccagttccaaaccataatcacatataaatatattcagtaaacatttatattatttaagtttaaattagatgttcttactagctttggtagatggttttgaagtacactaatttattgccttcttttttagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggtagaaacatgtttttactatatttttctctcttaagtaatgaaatagaacctgaaataataaattttaagtaagctcaaataaattatacacttattgcacaaaggaattgagaagatagtgagtataaaacaacataggccaagcacagtggctcattcctataatcctggcactctgggaggctgaaatgggagggtcctttgagaccaggagtttcagaccagcctggacaacatagggagaccctgtctctacaaaaattaggcaggtgtggtggcacatgcctgtctt

SEQ ID NO: 87446 - DNA, 1062 bp, Homo sapiens
acttttcctgaatgttgtaggatcactcagttatccactgagtgaagagattaggctaaattttgaattatggccttgtaattgataaggcaaaatgctttttatcttattccgtcctggaaaataatggtgctattatttaaaagagaagcagttagcactttctaaaaggagaaaaataaattaactctataaaataatctttttcttttcttacagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtaagtaatggtggaacagaagtattttgtcctgtgatggactcagaattaaatctgctaacaaagaattcttccagggctttcccaaagtctacgtaagaaggttatgagaagaacatcagaaccacttaaccccatgccaaagcattatactatacatttaaatagtatctttctaaatcctcatgacattccaacgaagtgatggtattaatagcattttacaaatgaggaaacagactcagaaaagttgagtaactggctcaagtcacatagctagtagtagagctaagtttagattcctgtgtctatgtgattccataatatgtgtttttctaccatgtcatgctgccaccagcctctttgacctgcttactgtaggctgtggcagagaacttcatcctttcggagcctcagttttcccatctctaaaatgagggttattctgtatttcctcatgtggatgttatgaggatagtgaaaagaaatgtaaaagcaacatagtgagaccttaaaaatatgtgatagagctgggcatggtgactcatgcctgtagttcctagcactttgggttactgaggtgggtggatcactgtcagtagttcgagaccagcctggccagcatggcgaaatcctgtctctagtaaaaatacaaaaaattagccgagtgtggtgacgcatgccagtaatc

SEQ ID NO: 87447 - DNA, 2114 bp, Homo sapiens
ggagaagcaccccatctccctatgccctgtctcttaagctttggggccttgaagtaatcttggggagtcttgctccctgttggtgttcccttctacacagtggccctcttgggtaggccttttgcgtggacttactctatcgcgcccctgtcccacctagtcctttccttctagcccgtatcttcaggatattttccatcctctccttccaattaagtgtcagcatcagctggacttttttccgtgctcctccccccacccattcctactttctcatctcgccgccttccttccccgagtgttttggtgtttttgcttcgtgttccttcgtttctcctttcttttcccaattgggaaggagttagggattattggaaataatctgtgtgttttatttgcatattctttaaagctttgatttttttgtgggagaggaggggctctatacttgaattagggattttgtgaaaatgggagtgctgatcaactgtttgaagaggacagggagagatctttactgaaagaaaaaaacactttagattatgttcctgtgtttgaaagttgcaatcttgcagcattcttaaatcactccccctcaaaaatctgaacagcaagtctcccaagccactctccaaggagtttcaagggtaagtgtccttagatgtggactatttttgcagtgttttcagagtgtggagaactttatggactcagagcctgcccttttctctcccccacatttgaatgtgaacactggatttattattcagtcttccttgtcttgaatccgcgtcgataactcctagtgtccagtagccacccatgcaaaatgtgactaaaagtagaatgtaatttattttttagaccttaaatacttcctcttgatctgtaagttggctggaacagtgtaaactgatattttaacagatgtttatgttcttacgtatgtacagtgttttgtggcagttgttttattgggaagattgcctgctttctccacccctagatttttttttttttttttttttttttttcagaattagcagttgatgggctgcgttctactaaatccagctgctttgcaccaattctaacaattaaagtggggtttcccccctaaatatttggagaagattcatttaggtcatgcgtattattattttggatttcgagaaaaagctcccttttttcctaatccctttgatacattgatttacttttgtgtattctaaggaaattttgttcatttaagatacattcctccccaggaaggacaaattagatttgtctttctcagcctgggaaactgcagctttgtgtgtgctctctgtccattttattaaatcatgtgtaatcttgtacctcatatgtaatctctcagaggaaatcattgggaatgtaatccaagtgtatttactagttgaattcgttcaaaatacttgaatatcttttagtaactttcacttctaattgaagcttttcatttgaagattattagtatgaatagatggtgcttttgttagaatttctgtttcacatagttcacacagttttaatattgctcctttttggtacacttttacttcttaatagttgtatgcttattgggagtatggcactgtgctaagatgagggaagtgttaaacatgtgcctgtaactatgttgtgcttttatgtgttattttgtttaatcttcagaattaaactgtgaagtagagtacagtataaccttgctttattggtgagaaagttaagtaatttaattaaggtctcaaacctgatatttagttcctgagttccttgctcttttacttagatatctatcttaagatagtagattattttaatgaaagatattataacactaatttttttattagcttctatggaagtggagtgaaagtcagtcccaggactctattctaatctttaatggagatgtaagaagaaattattctttttattaaaatttaaaaaaaatagagatggggtctcgctgttttgcccaagctggtcttgaactcctgggctcaagctatcctcctgcctcagcctactgagtagctgagactacaggcatatgccaccgcacctgacttttcttccttttaaac

SEQ ID NO: 87448 - DNA, 1053 bp, Homo sapiens
aggaaaaactgtagtgtttccttagagaatctgtcataattctgctcctgaaagtcttatccctctcggttgcctcctaccggtggtgtcagttctccagattgacccgggattgctggggttggttgctggagtaaagcgtaagctaatttagaagggctgaaacgtaaccatccggcaacttaaagttttggaaggaattccgttgtaatgatggtgagatgtttttaggatcataaacctgtactgcttatgaaaactaaaaacgcggaacgtgttgttacctcttaaaaactggccccgtgttaagggtgtgcgttagattctgcttgggttttctttttggaaattgccttagctgattgctttcagatagttcccaaccggttgttcctagtttaaaaagtacttataaattgtaactgcccatcaaaataagaaaaggcaaggaattactgtatgctagaaggaaataaaggtcttaaatgtctaaaaatttcggtgtagttgtagtttcatctaagtttttttaaatgtttgtaaagcaggcaggatttctgtgcccaacatttacagaatcatcttacagcattataattgcttatctattgcagtgaataaatggcatgcatctttgttagagcaaagaagacaatacttccagtggtgggaaaaaaccttgtttatggcagcataataacgttgctttattttcagcagagggatagagacatagagaaaagagttagatttagcaaatacagaacatttttagaaaggtattgtcatagagttgtagattagccggtttcaaagtctgttttccatttgcttggctttctgccaagagttagttgattgactcaaaaaccagccactaggcttgttggaggcgtttcccatccatcccaggggcccctctttatggatttattttgtttttgtgtaggcaccgtagagctgaaagcactgtagtgtattgtagaaatatgtgatatcattgactgcagggcaacgagaagtcgacagcagcacaagagaggaagactaggc

SEQ ID NO: 87449 - DNA, 1079 bp, Homo sapiens
caggttcagtggctcatgcctgtaatcccagcactttgggaggccgaggcggcagattactgaaggtcaagagttcgagaccagcctggcgaacatggtgaaatcccgtctctactaaaaatacaaaaatattagcctggtgtggtggcacatacctataatcccagctactcgggaggctgagacaggagaatctcttgaacccaggaggcagaggttgcagtgagccaagatcacgcctctgcactccggcctgggtgacagagtgagactgtctcaaaaaaagaaaaagaattgagggatacttaaactaccaattattaaaaagtactataaatagattagtaggatgagtttagaaatagatctaaggcaaaatgtagcatataataaaggtgacatttcagatgaatagggaaagtatgaattagtcatttttaggtcattgcaaaatatctctttgttcatgttaggcttttgaccaaaagtgtgatttaaataatattgcatctaaggatatttatttttagctcgttttttcacttgccattttgttttaggtgatttttgtgaatggctgaattatttgtatactgtaggtaaattttgttttgttttctttcttttactctttaggagactgagtcttgctctgtcgcccaggctggagtgcagtggcacgattatagctcactgcagccttgaactcctgagctcaagtgatcctcctgcctcctcctctgaagaagttagaactaacagatgcatgccactaaacctggttaattaaaaaaaaaaattttttttttttttttgtagagacagaatgtggctgtgttccccaagctggtctcctggcctcaagtggtcctcctgccttggcctcccaaagcactgtgaatgtaggcatgagccactgtaccctgccaaattttgtgttttgaatgtgctgtagaacttctgagagttcgcctcatttattcattcacatttattgtagtagaagttttttttttgtttgtttgttttttaatttacttcagtttgtttaaaaagaaagaggatagccaggcacagta

SEQ ID NO: 87450 - DNA, 1047 bp, Homo sapiens
ctgcttgtgagattcttgtgtgctttatgtagtattgtccattttcatgttgaacaacttgggctgttgcccatttgtagcccttattattgttttagagacagggtcttgctgtatttcccaggctgtaaactcctgggctcaagcgatccccctgcctcacagcctcctgagcagctggtactacaggcacatactaccatggttgactcatgtatttgttgtgtatgtatgttaatttgtggtatatacctaggaggtagtcaaagagtatacatatctttacctttaataagtaatgcctaaatgttacctgcaatgtaccagtttacactttcacagtagttgatgatagtacatgttgctccattttcttgaccacagttcggttgctattgtcgaactttaatttgtgcggtcttgtagttatgcagcactatctcattgtggttttaaattagtatttctctgataattaaagaagctgaatacctttgcatattttgtggctgtttggatttcctattttgtaaaaggcttgtttaagctttttgtccattctcccatttgggtagtctgtctcattgatttgatttgtaggaaaattttatatattctggatgcttttcctttggcgcgtaggtgtgtgtattctgttctctgtgttgtttttattctaataatggtatcttctgaagaatagatttttttagttgcttttaaaaaagatgtgcaatgtgatagatgattttatgtatgtatacattgtgaaatgattaccacagtcaagttaattaacacatccatcacctcacatagttacctttttttggtggtgagaacactcaagatttattttcagcaaatttcaagtatacaaaacagtattattaactatactctctgtgttgtacattagatactaagaacttactcataatgggaagtttgtgctgtttgaccaacatctccccacttctcctaacccctaatccctggcaaccgtccttctactctttccttctgtgactttttctttagattcca

SEQ ID NO: 87451 - DNA, 1029 bp, Homo sapiens
aacagatgctaagtggctggctaaatgataccacaactcttgaatcaaaactgattcagattaaaaaaacctcttaacacattctttcctatcaatgtagttaggactaagagtcatgtagcagtagtaaacctgtcctgtaatatatttctcttaggattggtttgatagttgtatcataattgcattatttataacattaatttattaatgtattcattaattaacctaagtcctttagtagttttcagaatatttttcttaaattgtttcctgtgctaattcgaatgttaacatgctaattcagagtttgttgccatttgtatcctgacagtgtattaatgtttatacttgcaagagtgaaatattttatttcttattacagcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggaggtaacattctgtcgttttctctttcctcttttggttctatttagtccttttatgctttactaatgaaattgacctactactgtcccttttactgaagttactttcttagtattacaggttttttagtttgtctgatgtaatactcatgtatgtatgttcatatttttctcattactatgaattgacttttatttctgataatgactctaataggaaataatatttcagtgagccccaaggaaacaattcaaggttttactgaaaacctttcagatgactttcagaatctagacggagcagctcttggagttccagagtagaacactttgaatctggctgggggaaaaagattaagttagaattaaccttcagcttttttcattgatttcagatttactgcaaacctttccagtta

SEQ ID NO: 87452 - DNA, 1040 bp, Homo sapiens
tattagaagagaagcaatgatacaaggcatagttttcttatttctacattttaaagggaatacttttaacattttacctttaagatgattattacagaattctggtggatatactttatcaggttaagggagttcccttttattcttagtttgctaggaaatcttatcatgagaggagtttgaatgttatcaaatgcttttctgcgtctattgagatgaactgtgtagattttctcttttaatctgttgctgttgtactattagcttccaactaatacttcttgctttttctgctcccttcccccaggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatggtgagatgtgattgaataacttgatattgttgtctaaacattgttttggtacttctgtcagaatcttgaatatgaactaaggacattgaccttgggtagatttttgcatttgccttgatctgctagtgggtaaaacataggctttgtagctcctaatcattagaggaatgagacaagaaatatataaccgaagtctaataacaaaacacacaaccactgacttcagtataaattggcctgtgaaacgttgctaattccttatttttttaaatgacatataatttccataccataaaatttatcgttttttttttttttttgagacggagtcttgctctgtcacccaggctggagtgcagtggcacaatctcggctcactgcaagctccgcctcctgagttcacgccgttctcctgcctcagcctcctgagtagctgggactacaggcgcctgccatcacacgcggctaatttttgtatttttagtagaggtggggtttcaccttgttagccaggatggtctcgatctgacctcgtgatccgc

SEQ ID NO: 87453 - DNA, 1081 bp, Homo sapiens
ccacagcgaacaccaaatatttaatttgatatagatacagatgtagtggcagctaaatctgagttactttccttctccttgttcttttgaatacagggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaaggtatatagttccatagtttttaagttatgttttaatagacaccagttctttggttagcgtcacctggaaacaatttttaaattcttacaggattttggatttgaactcgattcaagaaagtgatgtaacttattatcagagagccatctttacatcaatactaatctgaatgccagccatgtgtacagcactaataaaaaggtgattgtgggcccttaagaatattattgtttgccatctaatgctatgaacattatttttaaagcatttagaagtttgtgaagcacttaaatatattttatttgaatctcgtagcccagaagtagagctaatgttattatttcattttatcagtaataagcctgagagattaaactgtctaaacaaggtcatagagaatcaaaattgagctggacctgaggatagcagacgttacaactggttgtctgttaactcgtataagaaactttattcctatttcttatccatgttaatattgattgagtttaagatatgctttgaaataagcaaattttaagtagatatcatacttttttgatttactaagaactcaaatacttggttgtgttttcatcctaatttttcccaccaaaaattagcagtattgattgataattgctttaatacatagcatggctaacctggctttctgagaatgtgttttcagtagactgaccattaaaatgggaaatgtagggaaatctaatgtcacctattcagg

SEQ ID NO: 87454 - DNA, 1065 bp, Homo sapiens
agcaggagtcttccttacattgttttgtggttctgagacctggtcctattaaaaaacaaaacaggatgggcgcggtggctcaagcctataatcccagcactttgggaggctaaggcggatggattgcttgagctcaggagttcgagaccagccttggcaacatggtgaaaccccgtcgctacaaaaaaatataaaatttagctcggcatggtggcgctcgcctgtaatcccagctactcaggaggctgaggcaggagaattgcttgagcctgggaggcggagattgccatgagcagagatcgtgccactgaactccagcctgggcgacagagcgagactctatctcaaaaataataataaccccccaaacccctcattataatttgaaaaaaattaaaaacctacttcctccttttttccctttctggtgtaacaggaatttctgggaaagtttcctacatttgaggcatttttgacaagggatctctagtgagtaatcataaatcttcctccctacccccaacaacgatccatgtttttctgttttttgtttgtttgtttgttctggaaacaggttttatgaatgaagctatggctacagattccccaagaagacccagtcgttgtactggtggagttgtggttcgcccccaggctgtcacgtaagcacatttcagataaacccaatagctgaagaaaagattactcagaatactaacatttaggttttctttatgaacagtggttacttttgtaaaaatcttttaactgttggctttatgggatgaataataataattgccaagaccaaatgaagaattggagagttaagttgacgtattcagcacatttacagagtacgtgaagagcactatgctaaatcctgaagagcagtgttttcaaactccaggtttaacaaattagtggattgttaaatcagtttagtgggtcaggagttgtagtagaaaatgaaatagaggccgggcgcagtggctcatgcctgtaatcccagcactttgggaggcccaggcaggcggatcacgagatcaggagatcgagaccatc

SEQ ID NO: 87455 - DNA, 1041 bp, Homo sapiens
aactgaaggaacatgtgagttcaaacggcttttgtttgatcttcctttagaaaatcaggctgaaggggaaaggttaaagttgccttaaaacactcctttctatgtgtgcaaaaatctggaagtatgaaaatatgattacaagttccattcattatttgtgttctgtggttttcgtattgttcttgaaatttacttcctgcctgcctgaagttttgtattatgaatttagtgtcaagaccaaaatacagaccgggttgctgttttctttatgtggtcagcaaatatctgttctataagttgttactcctcacaaatatgcattttaggcgatttttatggcttgcattttttttcttgatggtatacacagtaggttacagagatactgacactctgatattaactgaatcatttgtggttaggcaggcaaaaaacaaaacaaaacaaaaaacttgttcccctcttcctcctaattttaggagctttcaaaaggactgctctttactattaggaaaactttcctcaaagtatgctatcttaagtttttaaaattgtggaggcagagctgtaaaaaataaaataatacactaacagtgacttgttagagaaaaaaaggcctgagtttaagaactattttgaatatagtgtatttataggagattctgatgcctctttgggctggttatttttggcagcctttttctttgtttccttatctataaaatgaaaatatattatcaaattggcttacagggtgttttgagggagagactgtcagctttcagtagagctggctctgtagttactgtggccactcatgtagctaggtgagttctttttgttgcttcttaaccgaattccttagtataagatgatacctgccatgcctcccacattctcctttacgtttttacaatttctccctaattaaaagtaaattgttattaatttttaagttaaaaaaactataatgaataaatcttctttttaaggaacttcattccttccagttgtatctgtatgattagtacatgtgaagta

SEQ ID NO: 87456 - DNA, 1034 bp, Homo sapiens
ttttactttttacaatttttaatttttacattttacaatgtcttgtccacattgaacctctagaaatttgtcaatcacagtttaggtgttcctaccttggtactgagtcctgaggttctcgcttgtggatttctgccctggtaaattgtgattctctgtatctgcctgtttgtctctccaatttttggggcagcagtttgctctatgacgtcatttttctgacggatgtaagaagagctgttcagctttttacctgtggtcagatctaagtgaagtcttctgagctgcatgtgttggcctggaaactgaaagtctgaatgttcacaaatcagtgtatttcagcttcgaaggacattgtgttgctagaacctaatcattgcaccttagtttgagggaaggattggtcattattgtatttggaattaagatatgaatttcattatgtacaaaaaaactctacttattccaagagctgcttaatcgagtccttgaatctcattaatatcctgtactatcatacctatctgtggtccttcaggacaaaagtcttacatcatctgccctcatggagggccattataataaagactaattatttatatatttactttgaggcagcattacatatccattggagactgatttatgcatttcagttaccatgcatctattgatttaaatccataatttttggacacctaccagaatggctgacactaaatattggctaggatgtggagcagatagaactcttgtacgttgctggtggaagtgtaaattggtacaatcacattggaaaattaaatctacaaaagatacacatgtgcctgccctaatatacagaagtagttactctactagatatatatccaagagaaatacatatacatgtttactaaaagacatttgtgagaatgtttacatcaatattctttattatgttgttttcaaaatggtaaaacagtgatctcatacaactatataagggacagatatcctgcattttttttaactcattgattagggatttggga

SEQ ID NO: 87457 - DNA, 1534 bp, Homo sapiens
tggtatgtttaagtcttatcagttatttagatgtagtcacatttatctctgtggaaaatataaaatacaataatttgtatattgtaaagtaatgtcatttttaattttttgattagtctttttcactttcttgaaaaattcagaagaaaacattctgaatgcatctgtttgtcagttttgtccgtgcacctttctcagacaaaaaaataaaatgtacgtttatgatgatgaaaacagctgcagtgcatacttctgagagtcatttgtcaaacgaagcagcaatagaggaaaaatgataatacaccactgcactattaagtataaaactgctgcaattggtgccgttttaaattattaaacactgtaaatgccataaagttaattagaagaggaacaaactctacaaagataaatgtgttttcagtatgattgttaggggagggtacagtagaaaccagtgaatagagaggaaatttatttctggcaggactctacacatggaactgtggctgaactttttaccctaattacctcctgctaatgcctgcagcgggctggaatcaaagtggtgcttcaggccctggaaattctctgatgtggcaaacgtttgttgtgtgaggagggtttcttaagaaaaagcagaatattgtgacaggatttaaaaaaaatttctcagttaccacccacctcacttgttgcctacaaaaatagagtaattgtttgcatctgtgtgtgcttttttatcccctaagaaataactgttataaatcaatgtgacatagatccagtgaactgaggcttgcctgaggtaggatttttttttgttttttaaagtttctcctttaattgaaaatttagattccaaatgtaaagaggttattttttataattgagaagaaacattctatgcatttttaaggagaatttggatcttaaagtgtgcttttcaaaatgaattctaaaaacttttgtagtatcaaactgataactattaaattgcttaatcctggaaaaagtgggaatttccagtttccattattagttctccatctgagactagaacctaaaagacatttctctaatctttgtgaaagttaatatcattccacttatgtgtcacaaaaggtttggccatgtatgcatttttgaaataaaaagaattagttctctaaaagcacctgcttttcaacttctgcctttaaaggcagtgtttctatacaatgtaaaatacaagtaccatgacaagtcattttatataatctatttttaaaaaatagagataggggtctcactgtattgcccaggctggtctcaaactcctgagctcaagcgatcctcccacctcagactgccaaacagctgggattacaggtgcgagccactgtacctggcccattttatatattctaaaagaatccaattttcaaatagtctgcccttgtgcatctgtgctgtcttgtgtctccagctccagcccttatctaatcttcttgaaataccttttagataattcttgaaaagcactaatagcact

SEQ ID NO: 87458 - DNA, 1059 bp, Homo sapiens
atgtaatataataacatttatgtaaaatgaatgtaaatattcttactagttttcaaacaaaacattttatggtacaagaggaataattttgttgtacttcaataatatgtcagatttcttagaagtattaatttagaacaggatattttattgtcttcttaataaagataagcaaaagcttagatttttctgctatcattttaagaattgacaaggaaaataattgactataaatttttacacatatccttctctaaaatgtttcctgttctgtcttgatataacaggttgttccttgattttgagaattagactttaagcataatctattaattttggctttacttcatttctcagcatgtctcaaatgctgtgatgaactttggttactttgaaatgtttagtgaagtggtttctattgatttcatatgtgtactcaaactaatctacattggtagattatcaagttttaagatgatactagagtaataaaactgggcatactctttcacagtatagtagtatatttggcctcactgtgcttgcttggcagaagatggtataattaacatctttttatgagttgagctagactttagtatcctcatttcaagtaccccatgtttttttgttagctatggttgtgtgtatctgttaatatgaaaaatgactctgtatttttttgtttatcataactgataaggagttttaagttatattgcttttagggaaataaatcccggcaacatcttgctttttgtggttgttagtgcttctactataaccaacttataaattttccctagtatattcttttagttttcaaaagttccttataatagtatgactcaaaactaactgtacatgatttttagggaactttatgatgtatttctttatcattaactaaaattttaatgtttaatttttaactggtctgttttgcctctctattcttctgtattcctctgccagcagtttctgcacttttgttatctatcagaagaaagcgataaaataggaaagtacaatagaatcttctaatggacattaaattca

SEQ ID NO: 87459 - DNA, 1052 bp, Homo sapiens
atgtgtaagtcctttgattacgtttttaaaatttatttgtggaaaggccaccagaccccaatcctaccatttcagagtttatggattcttaaagaccattcttcttgtaatgaaaaccgtagttgagcatgaaactgcctgagtggcaccagtagattataaaaaggggtagaagtgtctcggcaaagcttttagctgtttgtctgaaatacactcatgcaaacattcccacccatcaccatcactgttcacggaaaataagctctatcctgatagcctgtagagttaaacagattaatagaaatgacgttctgcttctctctctctctttttctcagttgattcgatgtcatcagtcccgtggtggagcctgtggagacaacattcagtcttatactgccacagtcattagtgctgctaaagtgagtacctccgaaatcttggagagttgtggttatgtgtagtaattgttcagatttctctcctgaattatattttctattgtaatgattgtagtgcttgtacttatccaattttaaagattttaagtctgttaactagcttcaagactgttacctaattaataccacatttggaagaagctttccatgttttaaacagtgacttctggattctctgtgatttgcatcgttctgcctacactgacatccctttgcatctttgaacatttcagagtcttcttctcatgaaaagaatattattccctatgaaaacttgagtcagtccctcgtcacattcaaagattcttttatatcaaggggctgccccttcatgtttgtcaagtgagctctttttttcatgtgtgtgagggttaattttgatgatgtctggtaaactttatgctgattataaggtattcttgtaaccactatcctttagaattgtgaagtatacaacaaaacaattctaataataggaatgacagagtgaatctaaaagacaacatataatagaaagcacaaccattcagaaaagaacaacagtttaaagcaaaccacagagtgggaatcaaaggtcacactgttttatgt

SEQ ID NO: 87460 - DNA, 1025 bp, Homo sapiens
tattggatgatttctctatacacctgtttatttatgtttaacaaattatgttgtttcccccccattcttatatttcaataaggggcaaaaaattgtgatttcccagcagatcgcataacacagtaagacctgtatttcctgtccttggataaagcgctaagtgattacattttgtaaagaattgaaaatagttgattgtatcattttttttcctctgaacctatacttgaagaagtaattgtttctgtcatctacagtcaagtcagctgactctttttagagtttatatgactgatgtgcgtgggggcatgttatatctcttcctcaattctaaagtggaattctctccttatattggcaagaataatctgctagagtggaaacatgttatttggtcagtggtttgtgatgtgccttcttataggcttcaagctcggttatcagtgagaaaatatttacctccatttgtctttatttctttgtgaaggtgcttgtgagtgaggattctgacagtgatggcattgtggcccacttccctgcccatgagaagccagtgtgctgcatggcttttaatacaagtggtaagttcgctctctgtcttttttttttttttttttgtagaccatttatataatgggttttccagccaaatatggaatatggaatctgacttttcttcatgtatcagtatatatcagaaaagttattaagtcattatattgaataaaggaatttataataaaaatttagtacccctctaaaatccctctaaaattggttttgttctcgataaagtagctattaaatagcagccatttaaacaatgctgttgagttacatgaatttctgtttataattactccaagaacttcagtattccaaactagaatattaatggatatgagcagtattttttttttgtaacttgaagttttgtgtaactaacttacaacactttgtaagctaatttaattttctcggttttttttttagtggtgctctttttctttttcttcttaaggttt

SEQ ID NO: 87461 - DNA, 1054 bp, Homo sapiens
tcgtcatttagcattaggtatatctcctaatgctatccctcccccctccccccaccccacaacagtccccagagtgtgatgttccccttcctgtgtccatgtgttctcattgttcaattcccacctgtgagtgagaacatgcggtgtttggttttttgtccttgcaatagtttactgagaatgatgatttccaatttcatctatgtccctacaaaggacatgaactcatcattttttatggctgcatagtattccatggtgtatatgtgccacattttcttaatccagtctatcattgttggacatttgggttggttccaagtctgtgctattgtgaatagtgctgcaatagacatatgtgtgcatgtgtctttaaagatatgtaatttcaataggccttaacacagtagttacaatttttaatttaaattggctttttccaaaatataactaatagatcctccaatgacatactccagtccttctttacccatacatgtaaccatatatgttttaaaatttatattaggaagttttaaccctctaataattatctaatttggttaaaggtattttcatggggtatgtaatatggctaataaaaacagtattgcttgttagaatactttttactagtttagggaagtttatgtaaaacaaacaaaacatgccaaaaagttgattgcatgatttttgtttttaaagctgatcttactcaaaccagtttacctgtgtttgtcactgttacacttaagaatataaataaattccttttagtcttcattcattcattcattttttgagacggagtcttgctctgttgcccaggctggagtgcagtagtgtgatctcggctcaccacaatctccgcctccaggttcaagcaattctcctgccccagccttctgagtagctgggattacaggtgtgcgccactgcacccagctaatttttgtatttttttagtagagacggggttttgccatgttggctaggctggtcttgaactcctgacctcaggtaatccgcctgcctcagcctcccaaagtgttgg

SEQ ID NO: 87462 - DNA, 1136 bp, Homo sapiens
tttcatcttagctgagccatcagtcaatcaggcccaggtatttaaaggaagctctgtgaatccagtgcctcttgagccagtggcatgcttctgacagtggaataaaagataaagtggctgtaatacccaaggttctgctcaaccagactggctgtactctggaatataccatttccatttgaatagcggtccctgttggttgggctcttcccaccttgttcattttcaaattttagttgacccatccccaagtaggtctagaaagtcacaaggcctccatgggtcagttgttcaattacaattagaactttgtagctggttaatagcagccttctaaaaaagggagtgtacttggtggctgcatcaggcaggtggcgatgttgtactgagataacacctctgagtacttcagcagccattaagtctttacctaaacattttactcttggaatcctacgttgtttctggcatataatatgggaaggaactggaagtctagtaggtggtctgttgtgcagttgtcccactatcaccttggtgtacatgttcgatgatatcctctggcacaagcatttaagtacagtcatgtaagccattaataccagttatatattcaccaacataagtcaaaatgatagtacattgaatcggactaaagggtcccaccattttatatcccattccagtgtatttttcctccatgaaaagcatggactagcgtttttaatgtgcacatgccagttgctccagtgacaattgcccttcagtaatgttatcccctgtgcatggcaggggaagctaccctttgcataaggtgggacagctaggatgttgggcttttatctcacttggccttttttttttttttttttttttgagacagggtcttgctctgtcacgtaggctagagtgtagtagtgcaatcattgctcactgcagccttgaactcctgggctcaagagatcctccacctcagcctcccaagtagctgggactacatacagttgcataccaccatgcccagctaatttttataaaaattttttagagaggctgttgctatgttgcccaggctggtcttgaatccatggcctcaagagatcctcccactttggcctcccaaagctctgagattg

SEQ ID NO: 87463 - DNA, 1045 bp, Homo sapiens
aggttgcaaagtgccagtcaatgaaggatttcatcatttgtgaaaggacagtagttaaagagcaatactactagatttccaagtcaaaatatattgttttctctcagctttattgctttcatgtctctctgcatgtttttttcagaaatctcaaagaggagaatccacactgttcgactatgctgctgtacttaagattttcttttgaaagcaaggaatttcaggcagcctattcctcctgatagataacacgtgttaaaattttatttccagaatttccgtctattactctgtgtagtttttctcatttttgaagcatggactttagagtgatggtcatttttcttcatgtttttttgtatcttacatgtcataacaaaatgggcattgttggttagttctaaaaatgatgtatttacagtttgtgtgggtaaacagtctgatgctggtcaaaaacaatgtaaaccattgaacagggagggattcatcttgaaaatgaatcatgttttggcggtattaccgttgtttgtctgtgctctttttagccaagtaaaggaaactgttaaataacagttgatataggggtatttcctttttactctttggacccaatccagtttaggttaggattattttatctatttgccaatttttttaactttccagaggatgtttatttatttgaaatatattctttataaatatctcttccatttcctatcttgttgcctgaacatccacttagtctacttgaggacttcttgtgatccatgaacaggataggaaaaaaatttacatctttatattcactatcctttaaccaaaagtaagcatttcctttttgttatgaacatggaaaatacatgacaaaaacattaacagtgcttgtgacactgttaccaatagaaaatgcagaattactcatatcactttatatatgaaatatatatcttgaagtatcttgcattattgaatatattttaaaatattgtttttactcatcactactttgaaattatgattatataatattttagtattaatt

SEQ ID NO: 87464 - DNA, 1030 bp, Homo sapiens
cagacttcctggtggtagaatctatcttccatgatttcctaactctgtaatcttagacaaattatttattctatctgtacctcacttttctttctgtaaaattggaataataatattaccaatcttatagagtaactatgagaatcagagccctttaaatagtgtttggcacatatcaaatattcagtagaggattactgtagtttctatcattagtatcattattgatactgctgttaatgtgagagtctatagaactgattcatttttcgtattttggtacagtacctgttatccagaaaacagaataaatgagtaattcactaaataatgagtaaattaaatataataattgtgaacttattctttaaaggcttttagaacaatactaggctcaatgttgataagctcagttgctacattgctacaccaatgcaaaaccaaaagtgatggtagtattatcattttaattggtttttgctcattttaattgtatacatcaggaaatatggttttataaatcagtacacctattcttgagcctttgccatttcttaattttgcaaattagttttccattttaggttcaaaaatatagagttcactgtgtcatgggacttagaaggaatttgttttcttcctgcaatttccattgagttaacaaacagatcttggattcacttctgcagttctctagagttcctgcaagtgtctcctttcctattaacttgttcgtcctcagaggggtcatctttgagtcacagcttttggcatctgaattctagattctgctttttctaaatggaagtagttgatgagactcggagacctttgtacaaagcctctcatttcttggacttggagcctccatatttcagtaaagtgcttttacaaaactggaagtatcacttttctttttagcatctgtatgaggcattccttttaccactcaaagactctgtttatagctttcatttgatggtttattgtaattttaacttacgttgatcagtagttttcttgatacaga

SEQ ID NO: 87465 - DNA, 1056 bp, Homo sapiens
tggggggaaataaaattgccagtgggatatattttaaaggaaacctgatattatattgcctctaaattatactttaaaatttagtgctatgaaaattaatttaaaaatattttaaacctaaataaactctatgtagatattttatatttttgtgtatttcattttggatataacacatttcttttctctgtaagttttgcctttaaataaatgccagatgatgtagttatcccttgaaactaatccagaatttcttctttgctttttactgcttgtggaaatattttttcttttctatgtattttttacatgggcaaatcataaactccagatttcaaaatagttttatttttaaatggttaatgagacatgcctctagagggcaatattttctcattgtaatcaaggcaaccctggcatgaacctgaggtactagggatgttaatgtcttatcagatcttaaatagcctttcttcctttttattatgttttctgtgatttattcttcaacgtcttcttagagaattcaactttggaaatatattactatcaattaatatcctttctgagtactacatgcagatccagttcctctgagtgaataccattgaatgaatagaggcaaattttttagttatatcatttgagtatgtggggtcattatgctaaatgtttttttattctctatgtgttgctattcagggacttgttatctgtatactttataatatcagagtgattaaacttcatttttgaggcattgaggcattataagggctaatagttatctactcttttctattaacattgattggacacttactgttgttgtttaccctttaaatataatttttattttttatcaaagaaatacatgcatttattataaaagtcaaaaatataattttatagtgaaaggaggcactttttggcctatcctccccactctcgggtgtcattccccagaggcctcttcttttaactcttctgtttttttctcagttggttttttttgggccctttcctggaaatcctattacttgaataatgtatctt

SEQ ID NO: 87466 - DNA, 1049 bp, Homo sapiens
ttattcagctaatcaacaaatcaatactaaggaactgattggaagctttttgaatgtgggaagggcataccgccttataggtatcagtggtctatcaggtaggaatgccattttattatcatacctcaaatagtcactatccgtaggtcttttcatgtacgctggtcagttttcccacaaagaaattcttctatcctctgttcagggtggggttggggtaataaagagtttctggcaataaacttagaagttagttttcaaggagttgaaggagttaacattatttttgtctagtgattagaataacaaaaagaggatttggagaacctgtttgcatttgattattgtcttacttccctagttaggaggacagttaagtaagaaattctggtctggttccactgaaataaaaatatttctatggaaatctggagatggaatttttagttgctgaagtgaatgaatgtaaaaactacttattcagataaagaagtgcaaatgggtagaacaacaaattttgggaaaagaagtgaatgttcatttccttatgtacttatcaaaaggaagatctgaaatgttttttttttttaatttggagaaaaattggagagggagaagagagtgagtaggcttcttaggatttgtagtagccagagtttgaatgattgacccatatgaacagatttagaaattatcagacttgagaataacagacatgaatagtcttgaggttgaaatctgagcaggaactagaaatctgctagttgatagttgtaaactacaaaaggacaacaagacagggatcagggctataccaggattatgcacagaagtagaaattttgatggttcttaccatgatgaggtaaatgatattttgaatttggaggaggatgagaaaaggaaaaggatttaaggttcattgaaagagttattaacattggatgatgtgtttttgcaggtgagaatattgaagctagaatgaggcacaagagggaaattactatttcagaatggaccaaggtggaattaacatgggcactgttgttg

SEQ ID NO: 87467 - DNA, 1039 bp, Homo sapiens
cccctccccatctttatatttactcatttcatttcttctcttttcttttgagacagagtcttgctctgtcacccaggctggagtgcagtggtgtgtgatctccacccactgcaacctctgctcttgggctcaggtgattctcttgcctcagcctcccgagtagctgggactacaagtgggtgtgtgccaccatgcctgtctaagttttgtattttttgtagagattgggtttctctatgttgcccaagctggtcttgaactcctggtctcaagtgatccaactgccttagcctcccaaagtgctgggattataggcatgagcaaccgcacccggccatgtttattcatttctttgtgaagatttaggtggttattaggaagcttcagatgcaccctgtagaagtaggttaagtaatgtagtggaaaaaatatggaattgggagtctgaggccctggcttcttctcatctgggttctgcacctatttgccagtgtgtcctaggtaaatttcttcacctgaaaaaaaaaagtttatatatatggattataatcttttaatccttatcatgtatgagtttctaccagttctttggtcccatttctaagcctcaggactgttgagcagccgtaagccagtgctgatgggctcaggccccacttagaaagcatagatgcttttaaatgatattaaatggaagcattaaatagcatttattcagacacatccagttgatatttgtagaccaaatctaccatcagacttggctatgtgagtaaatgatattggcatatagtaggccttgcagaaggtctattccttattttaattcaattaggtacaccttggctcagttacacagtttggcctgagccttaaactttataggcaaagttcggagaattaaattggaaatatttggagaaagacccactagatacagatataatagcttgggtaattccccacctcatgtttctgccttatgtaagtaccagttcttcatagctaagcaatggatgtttggttctagatattaaat

SEQ ID NO: 87468 - DNA, 1079 bp, Homo sapiens
agagagctatccttgcttggcattggcattggcatcatctctaaagttttgttttattttttatctatcctatttttccttctacctcactttcttctagttatctcttgcgtgtctctgttcctttctttgtatataatgcgcttcaagcctcaaaattgtactcactatcgtgaaaacatttttctcaagttttgctttgtggtcaaatatactcagtttactgggaaaaaaattaaggctaatcagcaggatttttattttttaattctagaaccaattttgaagaaggaaatacccacattttaccaatgtgcttttctcctccatttgttatgatttccaaatgtcagatgttacagtaccatttggtttggatatcattaaatcactcagttttctttatgtgcagatgtgcatggcatatcttaaatgctaggaacagaattttgagaagaaatatgtataacattgaagtcccagtttcccagttgtatttaaaacaagtgattgtagctttagtttgctgcgtactaacctaatctagtgcagaccaggtaaaggaagctaacctcttagaccactattaagagatatcctaatttcctggattatggccaaaaatagagaaaaattatactagttgtacttagtgttttttcctttgaccaacaatatacaattcaacttacgacaaataagcagcttgaaaaatatgtgcctctttctgtggttctgagactggaaccagtgaaaagcagacaattcatatcaaattttttatccagtcatcgttagctaattttaaccattttgtgtcacatagctacacatttgttgctattgatctcactcttctccatctggttattccatttaacttataccttgttttaaagggcttcagcagtgaattttattttattttaacttagaaatactacaggggtgctccagaaaagggggagaaatagaaaattttgaatctctaactctgaaaattaagggccttgttactacacatcattctgtttattggttatatcagacagtatgtacagcagaattgtaaatgatta

SEQ ID NO: 87469 - DNA, 1004 bp, Homo sapiens
acctttctatttcttatttccttatgtattaaatgtacctatgtaatggactcactatgagtattaaataagctgatacatatctcagtatgtgttagtatataacagtgcctggcacatagtaaatgtgcagtaaatgttagctgctaccactgtttcttttcctgtttcagggaaaaataccgtgtttcaaaagaagcttatttaaattagattatgtttttcacttttaaggatatgttaaccagtgcgaagttttgagaaatgtaagctatattaattttattaatttagtcagaatactgaaaagagttctgcacatatgtgtagttctcataactgctaaatggggattgttcatactgttctattacactagaaaaaaacattccaacgttttttcctcttggacagaaagaagcttaaatagttctttaaggttaattattatttgacacaaacttatttcaatgtttatatgccataggaagatctgaaaattttgttattgcttaataataggtgacataaaacaaatcaacataaaattttcctccttgaaaattataattagacacagtttgcaaaactattctaaacaaattcaggatatacaagaatataaatctcatgaaagttgatctttattcattttgttaaccagatgtcttctaaaaacaaataagatacacagatcttacttatgagccttccagtgatcagtgaattttaaatgccacattcaacatatgacaaaatttctttgtaaacttagaattaaattccattttaggataaattcttcttctaagtacaaagcaaagagttgtagtatgttaataaagattgaagttttgcatagaagtaaaagatggaataacaactgttgtatgttaagtaagtaaagttcattccttcaacagcttacgtgctcctcacatttaagcaaaagcacttgtcaaccagaaatgatttgaggttgaaacaagattaaaagagccaga

SEQ ID NO: 87470 - DNA, 1137 bp, Homo sapiens
aaatgatccctgtccttttgacattttaaaatattcttgtattgatttttggaggctccagcattctttactactactttactatgctggattgatctgatcaatatctgatttatcaagcttatttaggagtgggcagatctaattaaagttactacactatcattgttgaaatagtaacttatttcagaactcagatgctaatttgatctataataagtcatccatttacacagctgtgttttattaaccatttttacctacttcattttattttaaaatatacacatattttaagaatagagaggtcagaaattacataaattagaactagttagttgtaacatttgaattttacacctgtttaatcttctgaatgtcttgcctatcctgttggagggtcttctgctgttaagcttatattgactgcatgttatttgtatgaaagactgccacctttttattttttctaagcagatggccttgtgtttcaggtttcatcacattcattttaatgattacaagttcattttaatgatcacaaaagtagtgtgagtttaagtcactgttcataagtgatgacagtcatggtgatttacatcccatctattaagcttaaatattaatattcttctcctgtttccttagaacccctcaatggaatgaattgcagccaccgtttaatgcaaaccaccctctgctcctcgctgcagatgcagtacagtattatcagttcctgcttgctggccgtaagtagttcagattttttttttcctttcgtatggtctattcagatttcatcttaaaatgctagctttgaaagcaaacattaccactggtccataggccatgggccttaaagaatcagtttgaggcaaataagatatttaatatgaatataaactgtaagccttagtatacattatgtctctgactgcttatattctttacctatgaaatatatttctgtaataaaagttaagttgatagggaatatctggagggctcaaaaattcaaacaaacataaaaaccaccacctgaaaatgctaggatataataaaaagtttcataaagcttggaatctgtttctaacatggaaaaaaaaaaaccccaaaacttagcacagttaaaagtgc

SEQ ID NO: 87471 - DNA, 1050 bp, Homo sapiens
tatagtaacatttcctacctatattaattgaatggaatgaccaaaattaatgaatttttatttttattgaagaattttgctgtatcacaaattgataccccaaattgaggaattttggtgtattgtaaattagatcatactagaatgttccatacagaggtcactgtagaggcacagatgacttctctgttattaggtggaacgatatgaaattggcatttttaataagttttttaaaagtctgatatttcagcagtttcacagattaatttatatatgccaactaaatatatagatggtaatctaatttttctgtttaactcagtaaaagtaaaagtcaagaatttataatccaaaagatgtttttgccttggtcaaagaaattttgggaatagtttataaaaagatgacagcagaggtcattagtgatttctgtgttagcactgtatttactccctttaaaataaaaattacatactatattgccttccaacacaggcattatatttcagtgtattcctttgccaaaaacaaagataaaccatagaacatatcagtaaataccaaccagctttgaatatgatcccaaaatagacaataactttttcttcagtctgctgtagagcttccaatttgtaaattaaaaacagagcttactgagttgccttaggaaagccttatttaagggaaaaataatgtttcctcctttctttcaggtaatttggcagcaacagtgtttttaagttgctgacattaactagctttgtggcagagtgggtttcagagtttggacttctttctaaatcaggctgtgatgtgtgaaaagttcctctgtaaacttactgagttttatttgtaatagaaatatacattcattcaatagaaatatagcttagatatacaatagaaaggtgactggggtccatagtacttccctgtgtattattgggtgtatacttggtttcttctaactttaaaaggaatatgagaaagatggagaaaatattttatatgtttcaatttgatctcaaattttggggagatttagtg

SEQ ID NO: 87472 - DNA, 1155 bp, Homo sapiens
acacaactttcatacaaagaaatcagtaagtctcttgattttagtcagtctacatatagtattgaaaagctttgtgacaagtaattctttctaatgttaccaggctgcctgtgtaaatacagaaggccagcctaggagacaggataaattatctgtgggaagggcccataatcaatagccaacattctagtttaaaattcattctcaaatgctttgggcacaaaaaggtaaaaataaactaagtttttgctctttttatatagcatatattttcttagtttgtactaatacattcttatattacaaaggcaatttcatggaagaatcttccttttgatattgaatcatctgaaattacacaaatagaactatacattcaaaaaaattctcatgtgaataacaaaaaagacaagttaaacaacaacaaaaaagcttcctttctattttttttaaatggtgaaaagatatatatatatatatatatatatatatatatattcagaattaggcagctggactcagtttagatgatcccaattttgttggcaacatccaaagcatcgtaaccaggagccagtcgaacatatgccttcttctctccatcaggccaaatcagggtgttgaccttggccacatcaatgtcatagagcttcttcacagcctgtttaatctggtgcttgttggctttaacatccacaaggaacacaagtgtgttgttgtcttctgtcttcttcatggcagactcagtggtcagcggaaacttgatgatagcatagtggtcaagcttgtttctcctgggagcgctcttccgaggatatttgggctgtctccagagtcgcagtgtcttcggctgccggaaggtgggtgacgtgcggatcttcttctttttgtggctgtggacacctttcaacactgccttcttggcctttaaagccttcgctttggcttcggctttaggaggggcaggagcttccttcttcgctttcggcgccatcttgtgaaaagggtctttttttttttttttttttttacacagggtctcactctgttacccaggctggagtgcagtggcatgatctcggctcactgcagcctccaccttgtgttcaagcgatcctcccacctcagcctcctgagtagctgggattacaggcg

SEQ ID NO: 87473 - DNA, 1069 bp, Homo sapiens
ttggggtaatattagggcagtataataaatattataatattttattgtggaaataaagtggctttgggcattaaaattatttcagacctttacttttccttggatggttcaagaacaacttcacgtttgtcataagcttgatcctcagtgaaggaattgcttttaatctgtggattaataggtgtagtattcagtgcatgcccacaacatggtaagtactgtctagaatgaatgaaaaggtagaccctacggagctgacactagttatatgaggcaagcaactggtccttttactttcatgtgatttttgtcttgtatatgtgtgtgaggtgtgcatgtgtgtctgtgtatgtatatgtacacaaaatgtatttttggcttatgttgatgaaaagcagtagagggatattttgaatgtctacatcagctgtgattatcatcaccttttaattatgggtgtcctatccctttgccactttaacatgggcttcttgaagaatgtgggtgttaagaggaagaatgggggattgtgaagtctctcaaatcaggatcacaaaccatttaaatcatcattgctactccattccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggtaggaaatgagaattagggagtgatttgaacaaaaggattaatatgttcgtgtgaaatgagcatcatatgtaatatttaggtttccccttttggcacagtatcatgttgcagactacatgtactgttgcacgtaattccctgtcattacttgagatggtatatagggtctcgtgggatcacattacgtgcaataaatacttgcttttcagattatattctccctaaatctaatagtcactgcacttttcaagcaattccactttttgatgctttgcttatat

SEQ ID NO: 87474 - DNA, 1005 bp, Homo sapiens
gaaggggtccagagtgtagagaatatttgtagtgttttatccttgtgcagcaattagggactgcagctcccctgtttgtcttgttttagaatggatggttctttaatggattgtgctactccagcattcctgatttaaggtcatttgtagcaagtgacagttttgatgccagtaacatatgtgaattaaattaaattgcattgcaggatccagccagtccgctctgaccccgtcagcatgccagggtcatcccgtccagtctctgatcgaaggggagtttccacagtgattgatgctgcctcaggtagaaaaccacctctgaaatatttattgggcagtcctgtgcatttttaactaattttctcgcacaatgtagaggatgacatttatttgctttcctctctgtttttttgttttgtggtgtgtgtgcattttaatacagtactgtgcctatatttcttgctgaacaatgccatgcttttaagcattcctaaggttggtgaatgatgcagtggagttggcacttgattaaatgtaatgaacatagtattgaaggctacagggttgatgactgttttgcctttgatcactgaaatgtggagaagcaaccttgacagagaacgtaaatacaatctatggattcaatttactcaacctgttgagtatcaaagtgcctaatctgtgggagtagagaggagacagtccaaatgctatagcttgaatgattttattatcaaaagcatcaagtttaaaaattcattaacttaaccctggtctatctatcacagttattaatttcctatccttggaaacaagctatgaatatgtatcattagtacagagaaggagatctttgcctttataggtgatcgttgctccattagtattataaaacttttcagccaggcctactaaatggtagaattgtctgtagtgatatattttctcgtctctaagtcaagtgataaaataaggacagtgatgccttgctttatagtgcagctg

SEQ ID NO: 87475 - DNA, 1048 bp, Homo sapiens
tttcctaagcattttgagagggaattgatgcaatacttctcactgttgatatagtagggttccacatatttacatgggactttttgaccaaagacccaacttttcacttttgtacatttactgtgcctctcatacagggctggactgtttatgtagtctgttgcatcacactatggtggcagggggacagagttgggggcactattagaatttgtttaagtctgaaccgggaattccatttgtcttagtgacatgagtgtcaaaactgttagtgcaacactattttaaactgtctgcaagagcctgagaggcttatgcttataggtgccatctataaacttagaaacaaacaaagagcccctctccattgaatagtaagcccagtgggcaattaaagaacagcttgggaccccacttggtcaactagtcagaaccagagcttctgatattccctctggatattgttgagaactgtcacagaaaggctaaagtaaataatcaaaatgaaaatagttgttccagagaaaagtcttgttctggaagcttggtgttaaggaaagaataatgaccactaatttgtggatctttgttagttctagtctcagcggagtccctttcagcttgaaacatggatgaacctgtgttttcaagcacctctgaagatgtttttaaaattagggtataatttgggtatagcaaaaatgcatgttttaatcatacagcttgatgaatttttatactcagccaccactcacataaaaacatagaatatttccgtcaacccagaaagtttcttatgccccttccagttaatactaccagtgacctagaggtaaccatttttatcatcacagattacctttacctgtattaaacttcatatgattggaatcatcttgtgtctgtgcttttgtatctaacctcttttgctcaacttaatttgtttgagattcatccaggtattacatgaatcactagttcatttttaatattgcagtgtagtgttccattcttcaaatataccacactttatatatccaatattctg

SEQ ID NO: 87476 - DNA, 3268 bp, Homo sapiens
gtctattaagtcaaaattatttttatactagtatcaagttattatttgcctttgttttttctactgtggtgaaatttagtatagatggtgcagaagcaattgtgggtaaaactggtggcctgttatcatagtaaaggcaatggcacctaactattgctagtagcctctgctacctacttaagagttcttttttaagctgtattcacctaagaatatctttaaagcagtaaaaatcatcaactttaattttattaagttttgatccttgtgtaacatcttaatattctgtatatcaagtgggaatgaatgcacagtagttgtcttgagggaaagccattgtgatttgtaaactgaactagcaactgttttcatggaatcccattttatctgaataaaacaaactatgtttattcagacatgggcatttggcagaaattttctcaaaaataagcaaaccctgtcacttcgaagaaaacaactaacaatatttattaccaataataacattctagctttcaattgaaaattagaaatttgaaaaccttgtatccaccactgtctgtttaacagagtcccaatatttaaagacatttctcggccggacacgatggcacacgcgtataatcccagtactttgggaggccaaggcgggtggatcacctgaggttagttcaagaccagcctgaccaacatggtgaaaccctgtctctactaaatacaaaaaattagctgggtgtggtggtgcatgcttgtaagcccagctacttgggaggctaaggcaggagaatcgcttgaacccgggaggcagaggttgcagtgagccaagatcgtgccattgcactccagcctgggcaacaagagtgaaactctgtcttaaaaaaaaaatttctcattaaataagtagtgatattaactaatatgattttttgcataatagatattaaaatatatcagcatttggaacatctgcaacattttccgaatgaccagtttcatgttgctacaaaatcatgcaagagtaaaggactcattccaaatgcaagataggacaaaggattttaatgtaatagaatatgaaagttaattgatatagtttcagattccacattgcaactaatttgttaaggatcatatcaaggaagaatatccccagaacctgaaaatgctattaatatactttatcttttagcagttacgtatttgagttagaccaacttttcttcgtgtacgtcaaccaaaacagcatatcagaacagatagaatgcaatagcagatatgagaatctagctgttgtctattagaggattttctcttaaaaatgttacttttctcacttctttctgtttagaaaatatttttatatagaatgtaattgatatttctacatagaggctttatcattgtttttaaattagctgatacataattgtattaaatgttgatagatatagtacatataaaccaaagatctttggggtcctgggttttttgttgttgttgtcgtttgtttgtttttttgagacaacctcactttgtcatccaggttggagtgtggtggtgcaatctcggttcattgcaacctctgcctccaggttcaagtgcttctcctgcctcagcctcccgagtagctgggactccaggcatgcaccaccatgcccggctaatttttgtatttttagtagagacaaggtttcaccatgttggccaggctggtcttgaacttctgagctcaagtgatctgcccaccttggcttcccaaagtgctgggattacaggtattagccaccgcacctgactggggtcctgagtttttttaagcacactgggatcctgaattttaaaatgtttgaaaaccactggtatgcatattctcgtacacacacacacacacacacacacacacattaaattactagtttgtttgtttatttctacagaaattcagatgagattggattgggatttcattgaatctgtatatcaaatttggaagtattgacatcttaaaaatactaaatctttcaaaacaagcttttttaattttttgagatggagtcttactctgttgtccaggctggagtgcagtggtgtgatatcggttcactgcaacctccacctccagggttcaagcgattcttgtgcctcagcctctgagtagctgagattacaggcaaaacataaacttttataactattcacttatttaagccttctttaatttctccttgataagtttcaatgtagaagtcttacacatcttatataaaagttttttctttctattattacattttgatgataactatagcacgtttttatttcacttgtcagttttctttacagcatatagagtaaaatacttttctgtataataaacttgtatcccagcctgggcaatatagtcagacctcgtctctacaaaaaaaaaaatttttaaattagctgagtatggtggtatgcacctgtagtcttagctacctgggaggctgaggtgggaggattgcttgagcccaggaggttgaggctacagtgagccaaggctgcatcactgcactctagcctgggtgacagaggggaaaccctgtctcaaaacaaaaaatgaacttgtttccagcaacttttccaaattcgtttattcattctaatagtagaatctcttggattttctactatgtaatcatgtcatctgcaaataaagatggttttatttctttttaatctttatctttctcccatattacacttgtttaaacctccactacgatgttgaatagaaatgatgatattgaatattcttgttttcttctcaaccctaggaggaagggtttattatttcactatgaagtataatgacaataagcaaaaatttatcaaaactgaagcagagagagaaaaatactgaaataaaatagaactcactgtgagcggtatatcaaactatagcagtatcaaactgtctaacatctgtgtaattatttcacatatgtggaagaaaagaagaggatatggcaaaagaaatgcatgaagggttgagaattttccaaagttaatgaaagacataagtcaaagttttaagaaactcagtgtatgctgagtgagatattaataaacacaaagaaaaccatacgtagacatattataatcaaactgttcagatctaaacataaggaaggaattttaagaagcctactctgtttctttatttgtttttttcttttttcttttttgagactgagtctcgctctgtcacccaggctggagtgcagtg

SEQ ID NO: 87477 - DNA, 1067 bp, Homo sapiens
cagagggggaaaaatgatggcttataataaaggactgtttgagaacaagggctgtctttgtatctccctttgcctggtattggtaccttccacagagcagataatcaatatttcttgatatctgattaataatgatagtcagtgatgattaataatgatagtcagtgataatcaacaatgataaccattgttgatttcttataaaacataaggctttaaatatcataacatgattacaagttggtaatgctgagtctttatcttcgttacctgacttaaacctggtcctcagttaggtttgcccttatgttatgatcactattcctttgtatgggcctatggtcaattgtgtaatcaagtgaaatattttacaaagcatttcaaattatcttttatgttatgcttttaaagcagcattatgtttaaacagaatatttctttgatacaagctttcgttctattaggcttagcatggaaatttttgttttaaggttatctttataaagcattaactctagcgaagtcttgctttctggaatctatggtcaggactggtaaacatctgttgaaaagaatggacaggcttttgctttctgctcttactaggctaactttcagacataattttagggatattttgggctgcctttgaagctagcccattttgggcataggacattggcatatggagaactgaccctaagttccattaagccaaaacattttgttgaagaatttccaaaattttagtggtgtcattacagtttagttacttgtacttatgctctagacagctacaagaaacatggtagaattgacttctgttgtatgaagtggcgtcttgagtcttaaacctattttactttggtgttctacaatatttggaaaggcaacagttattatataaatgttcaatgttaagactgtagagaacactaagttacacttgacacttagttgaactccccagtcagttatcccttctttagatgagtttatgtagttctcaaatgaatgcttgtaagactgggaacagaacccatttactcttctgtttctctctacct

SEQ ID NO: 87478 - DNA, 1042 bp, Homo sapiens
atttctcttgaaacatgttcttaatctttctctttattccaactcacccccttgattaaattaattactttctcatgtgttcttaaacttttactgttatgtgtaccatctgatattaaaattagttgggtattgtttttcattctagactatgagctcatctttgtactccccgtagctccctgaatggttttgacacataataggcactcagcaaatgttaatgaattcaatatttcatcatggaacattgaaaccaagttcttgcatttgcctggaacagtaattacctcctcaaagagaaactgtgtggctagggagcagaagtgacaaggagaccatctttccactagagtcctttacaacacggccctgcattatccatgcaaacataaattaaactctgtttttaacaacatactttttagattttttgttttcaacagttgaagatgctgaggttaagagatttaaataacttgtctactgtcacagagctagtagatggtagagcaaaggtgtgaatctgtgaaaccttcattttttcccggaccttgaacagcatctcagccaaccttgatttcattcatataatcatcagggcatgtatgtgacctaagaactatttatatttattctttttatcatatactgttgtatcatagaggacacaaaatacatcacctccactctggaatggcacctctattttaaaagaccattggcaaaacctctccgatgagattttgatgatggaagaatgttatattcaagactcacctaactatacctgcatctcacagatacttatcctttaagcagtaaacagttattttcagctaggaaagccactctcaatcaggtagtggtttcttaagctgaaaaaggctttccacttaagaatcgtgataggccaaggtcattacctttccgtctacttatgggaaaattcaaactaaaggaataccagtgtttgaaactcacaattcactctatagtggggagtgggggagtgcaaggcaagcaaagtgattatatttcc

SEQ ID NO: 87479 - DNA, 2208 bp, Homo sapiens
ttgaggttgtgatcatgaaaattaacgtaagctgatataattttgaattgtatgcatctgttttcatgaaagaaacctatttggagaggtttattcttgaaaaattatggaattaaaagttaaataggattcttaacatctgtttttaaatcttgaattatatgcagctcatagagtttctctcctgtatgcatattaaatgatatataatgaactatcagtggttttaggtaacatttggttactgaatacactatgctaagcatttcacgtgcattatcacctgtattcacaaaatattatgaggtaaaagcactgttacaatttccatttttttcagaagaaggtgtgatttagagaaattaagtactgtatactacctcccaactttggcagtgtcatctgaatttttttgtcatgaacatgttttacatagcttgttgttaaagtccatttttgataaattttttgaatagacgtgtgtaatgcaagtgcatgagctttgtggttaggtgtagatttcattcccatttctgtagctgactgggtacatgaccttgagtttctttgtccataagaagagtataggaacatctgtctctgatgttgtaaaaattaatagataataaaaatcttctggccatagttcaggtacataacaaggactcattaaatgtcagttgtcaccaccttaccttctttccgtaaaatatttcctttctgtctgtcccaaagttttagttttgctcttcacgtgtatcataatgtattatgagcatcctaagaagataggttatactattgtccccattttacagttgagaaaacagactgaaatgttgtagattcctggttgaatccctatagcagtctgattccagagcctgtgtttttagctataatgtgctttggtatgaagatatattccaataacagattatattctgatatttcagacaagaatctaaatcccagaaattattctcttgtacccgcatccctaccattcagttcttcccttcttagattatgctggtataacagtgtatctccttattactcttgtaataaatttgtatattaaatgctcaaacacccttctgattctaaaatctgtgatcctctgtcatttggatacatttgcagtagtctgaggcagctctgagaatcgtttaagggaaaagtattcatcactgtggctttagtaaggaatatgttgacatttttactctaactccaggaactcctactgacctgaaattaaccagttcatggaggtttttggtggggactaaggaatgaaattaactccctaagtctcctcttcttaaaaaagaacctcaaaatactgctgcccaaatggatttaactttagttatatttgtttttacatgcaaatacattttactcagcctaaaaaggcaaagaaatgaagctatttggtttgcagaggaacagatcactctcctgagcatgtcagactgtttatgtgtgtttttcactccatcttactctgtctttgtctttcatgttcttttttctgtctctgtttcagtttgtcctgtttctattgctccctcacagcaactatcttcctattttgataatcctgtttcatctctataaggaaaaggctctctcaaggatgcagaaaatgttactatttttataacagtccctaaatacacaaaagattttaacttggctataaaactttgttcttggcataaatttggcagatagtctttcgcctgggtgagacttttcattgggatcctggaagtgttgggatgtcactattctccactcttgcttctccaagtatgacattagtggttttagctcttgttgacccatctttaaaccaaagctttatagcctattagaagcacagtgtggatttttcttatgatacgttggaataaaagaaaaaacttttctaaagttacaaatggtttcatttaccaaaatgactatttcacttggaaagttttgtcttttctgtaaaaattccaggagttgggtgggcttgatgtcctctctcccattccacctccccacccacagactcatgtcagcaaagatgctgagagttttattccagtcttttaggaggcgagaccttgaccaaggagtagctaagacatatttttctgcttttattttttaaaaactttttaaaaaaagtttttcatataactttttcat

SEQ ID NO: 87480 - DNA, 1010 bp, Homo sapiens
catatatttagcatctgttgtcaatacagcaatgtaagctgatggctattggaattcacatacagtttgcatttactttgatttatgtttaaatggcttatctcagaaaacttgacccaagagataaagactgtgaaagattccacattatgggtaagtcttttttttttttttttgagatggagttttgcttttgttgcccaggctggagtgcaatggtgcgatcttggctcactgcaacctcctcctccctggtttaagtgattctcctgcttcagcctcccaagtagctgggactacaggcgcccaccaccatgtccaactgattttttgtacttttggtagagacggggtttcactgtgttggctaggctggtctccaactcctgaccttaggtgacccacccaccttggcctcccaaggtgctaggattacaggcatgatccaccacacccagccactgggtaagtcttctttaatttctctctacactacatttccttaggtgcagcatatatgtgacctggtgccccacacctccactgcttccctgccaatatcgctgttcccccagatggacacacctctcaatagttttgtagtatttgatataactcggacatattcagtataaaaacaaccagggaacccctgtgaagctaagaaaggattttcaaaaataataatgataatatatactatagacaaagaccctatctgttttttatcacccttgagcaaacccagccctatttggtatggggccttacatggagtgggcagtcattaaatgttgactaaccctttttctaagtcttttttttttcctattttaatttttattgggggggagtgggggtactcagtcccagaagacctaagtcttttaattctctacttgtagtgcctctgtaaagtgatccgtaatctgcccagtattaatagtttggctcctttttctctgcaaacatattattaaaagttgaataaagaaataaatcctgtgcat

SEQ ID NO: 87481 - DNA, 1797 bp, Homo sapiens
cagttctaatcaaatcagttcttttatgtgcttatactacatggttttcagctatcaaatgttatttcaaacttgtatctaggagagagatatatatatatacatatatatgtttttattatttaacatttggagggaagtcagatatctttgatctcatttcttttactcattttgtgtttgtttatttaacaccaatggtttcctattggcttctttagctggaaaaattatttctacaggacaataaaacctgggattctcctccacaaaatgaaacatgaagtgataataccattaatctattaacaaataattgcccttgggttcttttcctggtatctcgagccaccaagatatagcttttacttgatctgaatttgtcagtctataaaagtagggattataatataacaatgcatctttttatttagtttgttaactacattctattgtagaactgttcttatttttaagatcgtagagatccatagaagtattggcattcttgtaccagttattcatatttcactgcatgttagtattttggcatcatttcttacataccctgttattgtttaggggaaaaatgtggaagcatttcttgatattttttcactatttttccctagtgagttatgtagttaatcatattaaactgtttttcagttttgaaatatgagagatttgtcagccctttgaaaaaatggttatagttcattttccatatattactcagcattatgggtctgcctgccaagtgatcccaggtgtgggattgcagcaggtaatttcctgagctgtatggtacagatgattttctgtgttagaagatgctatcggctcacctggcctcttagtgacagagaaatcctttgtttattcatttagtaggcagattaaccctaatgaatattggcttcctggaaatagatacaggtgacaatggcaaagtgaggagtggggagatgtaagacaaattcccttttctttcttcacttataaataatggtggctttcataggagagtgttttaaatcagaaaggaatgcaaaatatttgaactaaaaagatagatttaaataatcaacctttaatttttagttttgaatgtctaggtatgtgtatatttttcagaagaactagagattttctaattttggcaaatacttaaaagttttatgttgccattatagctaaacgaaaatatttaattaaatacttcatactggtttgggcagagctactcacttgaacacgaaaatgctttcctaatatgtccttgtattcagataaattttgtgaattagagaagtgtaacattcatcagcctctctcagcctgtgaaagaaaatgtgcattattctgtgtcctttcttatagtgtggtcatattgcttcaatgacatatttgttttctcagagcaaggatgaaggactaatctaggcatcagaaaattattcatagagttatgctataaactataaaaagttcctagaaataagctattttaaattcattgctttgttatggcttttagaatattgacaaaaaaaatttttatcaatataattttatggatatttgattgtgtaattatcaataatctatgatgaaaatgaaatgtttgtgattgcaactcttaagttttgctcaccaacagagtactttacaacatttttctgtgaatggttttggacatacactattcccaagatgggaatgtatagatacagatgtggaaatctcttaatgttcaaccagacttttccagatcttacagctatgatttatact

SEQ ID NO: 87482 - DNA, 1073 bp, Homo sapiens
tttaattcattagaattgtgtgtgcgttgtggcatgtgggtacatcagaagtatatttgcaaattctgaatttacatatcaccttgagaaaatgtgaggcaatcctttactgaattgtcagtgatacttattttcagagacattagaaaaaaagagcagtgtatatgtgtcatgttatcgcacgtgaaccactgcctatgttaaataggtttttctttccttttagtgaaaaaccgaaggacaatagtcattatatgattttgtattttaagtattttcataatccaacataaattggcccacccaaggattatgtctgttttataaagatgtgtttatatagtcattgggtgaaagattgcagaagttgaaccactagttttgaaagttgagccagaccaggaaaaatcaggatacaatttggcacttatggagacgaaatgatttcctttttagctgctgatttctactgggaaatgtatccttggactgaaaattgcatccggaaaaatgtttatgtagtgtttttcaaatgactgattattcttgtaacctttaacatgaactgtgtctaattttggtctctcttaactctttcacgactaggggatttttctttgtgggaaaaatattacaaccgtatcattactactttgaatacaggaatgtcttacatggtaacaagaatacaaaatgtgttaagatttctttctgggttatttttccaagcgggtagtagaacgcccaaggttatacacccttcgtcacaggcacttaagttttagattgcatttaaattaggatacatctcgaaacataaacaaaagaaaaaagagagaaaaaaaaggatacatctcagcagctgcatctcttccacttcactaccagctacacacatgcagtaggagcttcttgacattttcatgggtaatatttggtcttcgcaagtatcagtacttctctattttctttcttgtacatttagtgacttttctggctaaattattgctgaatattgtccgtcgcagattgaggggtctctattccatgttatctccattcaaggagccagg

SEQ ID NO: 87483 - DNA, 3557 bp, Homo sapiens
gccacattatcatattagacagtacaaggtttagaacatttttatcatcgtagaaagttctgttgcagactaccaggctagaactttaagaggatggggaagtacagctatcttgtatgcccagaggtgggaaagaaggaaatattaccaaacttcaataatgtctgtcatcattggtaaactgtatgcttgaaaattactcctcagatcctctatatcctgtttttctgtttttgggggagtggaatagggaggaagggggctacaaagttagttgggtgatataaaaaaaaataatacatatacacacgaatgcatacatactgcttctgtgtgaaaaaagaaaacttaaggagtacatacttgaaattaacattctgccaagcaggagtcattctgttggatgccttcctctgaaggaagactgtattgcatttgtgtggctttggggaagacattcagcaaagaacaccacaattcccattgagctcagaaaatgtgattaaggagtttgaatgtaattacccaaagtttggcttttcttttaaagaacccattcattttagagattccttgatactgtaaacctgacaactcaatctggttttcttttaggaagccttccaccaggaatagtgtgagtcaaggatgagtacatgaagatgaagcccatgcaatgaggacagcctaggccgtgttaggctttgacttaaatcagatttcatctacggctgagatgcagaggagagacttagtgaaatatgcagagctccattccagttcctttcttatttgtttgatgtacaggcttatttaagtgaaaggtgggacaccagtagatatacattcagacaaatcaccctgcagttattgctcaacagagtaataataatagatttggagaatgttctgtgttttcaaagacagaggttaacaagcaatggacaaaccttccgttcttctctatcccaaatcgtttgaatcgtttgactgctatacacaatccccagcacttataaaataaaaaaagtatggagagagagaaagcaagtaacccagcagagtttgtgacagaaactgttagccctcttttgtattgtttctgcatcgtcctgtcaaacatctggaaaccagcatattggcagtcgtctcacaacatgattttgcatttacatcatcgtgctagctggtagaattttttcccccaggaaaaaaaaatcggcaacttttggtctgtcacaaggtcaagtgatgattagtgatgtagtctctcctaaacacatggttagcacagaaaatttaaatcagttccccaaaatttggtaaccattaaattacttcctaagtcacttccggatgtcaggcctaaggtggagagggggacagggctatattgagttctccgcagttttctaacagagagatttagtttggcagctgatccagccaaggaaacgctcacgcaagggcagagctagacaggaaacacttttgaaagtgctgttttgatagaggatcaggagatcaggcaaagagctgtgaactttatgtgtagcctaggccatgtagcactaggctagccacctgagggtatggagtaagaaaggaaattaaaggagaagggccagagatcttacaggcaattttcttttctcaaaagagcagtgctaaaaattatgaatttctttgaagtagaggaacataattaatgaatttctttgttgttgttgttgtttgtttgtaaaacattctgccatcattattcacctttacatttttaacatgattgttagcttagactacgagagctaacctcacccattctaaccacctttttatagctctcagaagagctgtcttctaaggaaaacactgcactgagcaaaggttgtacttttgtaagatggacgttttataatgataagttttgacaacttgctctggttgccatgtgtctcccagtcctgctggtgggtgggtatttgtcaggaatgagaatacgtctgagatggtctgctttacagcagccagtcttgattttcaacttccagggccttcggcatccttttggctctgtaaacatagaaggctttgctgcccttggctgtgctgttggagaaaaggagagcatcctgtttagggaggtgccgatcttcagtttcagaaccattgtttgacacctttagttcctcccgtggacttcatgtccttccttgtccatagtttggaacttacaatctgagtattccttctattgagctactcttcaaggtctacagaagccatttttgtttataaagctgtaatttctcacagcagatcatttcattatttctgtcttaattacagaatttcaaagaaaaataaaatccttatctgtacttaacaaagactgccaacacttttccatagaccaccaatgattcttgttttgtagctttttgtttataaaggcaatgttgtattccacagcatcattacacactgcttctgtgactcagacagctggcaggtccaagatagagcatatggatgatgctctaatgacatctgtccagttgttgtaatcacatatttggtggacagctaaaagacccactttcaccttaactgagtttatgtgactaattttaaatttactgtaaacacttttttatacgtctcatgcttattaatacttaataataattccacaagtatttctctcaattctaaatcccagagcaccatagaaactggcaaaatatcttcccaattaattatgagaaattcatctgtacaattttcttattaattctcgtatccaaaagaaccacaatacaacccaagaccccaatcattagaataaccacaaaaccgattcttaattacctcttgcctgggacactgcagaagtaaccaaatcggtcccacaaacataagcctctctaaccctgccacctcccccagtttatgttacgtaatatggtgagaatcttcttcctcaaatactttttatcctgtcatccctgttctcaagaatcttcagttgtatcccattttacaccaggaagttcaaatgtttgaatggagatttaaaaagtctagctatgcttcttgtacatcccctctaggagcacacccactctaatcaaactgacctttttagtttagctgggctccaaccagttctgttctagctcctgaagtcagcgtcaagaaatattggtcttggccaggagcggtgcctcacacctgtaatcccagcactttgggaggccaaggcgggctgatcacttgaggtcgggagttcgagacaagcctggccaacatgcaaaaccccgtctctgctaaagatataaaaattagcctggcctggtggcgggcacccgtaattccagctacttgggaggctgaggtgggagaatcacttgaacctgggaggcggaggttgcagtgagccgagattgcgccactgcactccagtctggcagacaaagcaagactctgtctcaaaaagggggaaaaaaaaagatgttggagacctaggttctagagtaaactctgccactacctag

SEQ ID NO: 87484 - DNA, 1048 bp, Homo sapiens
atttatcctctgttcctctgccttgggcttattaagttttgaattaggtatgaaaattattaagccaggggtataaattacaattcgttaaataaattcataatatattttatacgcttaaaatgaaattatattccaaactcataattaagtatgaacaatttgcatttgagattttaaaataaagcctaaacatcggtcccttccttcttcattaatttatttctccataaaggcctttcttccttgaggtctgtgagcctccaggcctttgcagcctgtagtggtctgcacttctctgtttttctttccctgagagtgctgattagtgacttgcggtgtggattctgatttatcgcagaccagagctgccccttaggggctgagcagaaacactcatgaaggagccctgattaaaaagagtggtaatgaagacaaatgtttcagagggagttgagagaaaaccagtccttggcattccccatagctcctctgagcttttgaaaaggaggtagtggtagccaaaggaaatatttcttctttgttgtttatttctcatggcactggaaacatttttcttttcctcttgggtgttctaattctcacttgttaactgcttttcatgcagggttgcaattaacccctggcagatacctcaccgtgttctccttatagccactctgtccccaaagaagtttttaatgctttgacctataaccattttaaaattcttcagacttgacacttgcctaatttctcagatcattaaatcacacttctggttttttccagtgatttttactaaatttgatgttaggtacctataattaccttcccttcttcttatttttacaagacagaatgccagcagaaaaaaacaaattcctgttcacttggtaattttaaacacaaccaggtcaaaagtttcaaatctagtgttaagtccgtaactgaaggcaccattccaaaactacttgagtataggtgagaacttgacagataattatggttgcttgacctgggtcttggggcatctaccaaatcttaa

SEQ ID NO: 87485 - DNA, 1023 bp, Homo sapiens
catctccaaatcacagaactagaattattcatgaagagtcagccacatcaaagatccaaaacacgggttttaagatttcaaatggttaatactctacttttctcttagattgttgttttgtttttttttgaaataaaacatttgtacaagtcagtaaaagtgatatacagtatttcttcaaaactggaatgttattagagttcttgcttgaaaatagttccaaattaaacatatgaggtttccagtagtttgaagactttagaatccgacttgagatcaaatcggaactgagacagtgaggtcacctaaactgcgacgtgtgaagtgccctgtttcatgcttcttataatgacatgataaggccattagtattatctttattataacagatgattataaatggtacagacttggtttcttattatctggtactttttgtcacttagccctaattttcttaattcaaagacatattctgttagtactagggagcaagtttaagactgactttgccacactaatcaaattacatcagtgtcaagtgctcactaattaacacaaaatttatatctgcattaggtaaatgtcatttcaccacagtggcctgaaataagctttttattcctttgaattagcataccatttcattgtaagtattacaaacaagctaatgacaaaatttaggcccatgtgcatttgttatttagctggaaatagccagaagacagtcagtacttccaaagatctgtaggaaaatgccctgcttcattttttaactgatcagctagctgacttgtcaccttgaggtcctgtgtgtacatcatagaagggcttagcagactactgccaccccctgtctatatgcagcccacgggctagaacagttctcacatttttaaatgggaggaaaaacatcaaaagaagattttatgaaacctgaaaatcacatgaaattcacatgtcaggctcataaataagttttaatgcaacagagtcatgtctgttcacttatgtattatctat

SEQ ID NO: 87486 - DNA, 1030 bp, Homo sapiens
atggaaaaaatgccgtttgagctagaatttgaggaatacgtggaattttggcaggagaagattgaggaaagggatacctactgtcaagacacaaagtgatatgaccgggcacagtggctcacgcctgtaatcccagcactttgggaggccgaggtggatagatcacttgaggtcaggagttcgaggtcagactggccaatatagtgaaaccccatctctactaaaaatacaaaaaattagctgggcgtggtggtgcattcctgtaaacccagctactcaggaggctgaggcaggagaatcactggaacccagaaggcggaggttgcagtgagtcaggatcacaccactgcactccagcctgggtgacagagcaagactccatctcaaaaaaaaggaacagagtcaccaagacatacacatactggaccaatttgggaaagtacggaagtttgctttgaatatatagcaaaggatatgtgagggatagctgtggaagatccaactgtcaaggaaggttaggaccagactctgaaagtagagtgctggtgggagatgtggaacaggggacaagagatggaaggttttgagttggggaaaagtattctggcagcaggattgaaacattaaagaaaagtaaccctgttaagtggttatcacaatcaaacatttaccaagtaatcactgcaagtggattcaatttgtaaagtcacataaaagttgcttatctctccactttttttttttttctggagaaacagcactctggcatttggccatcttagtatggcctttatataactttggaatgcaaaagaaaagagaaaactctctttgtaaagtcaattaaaagctaattgtttgtgattttttaagttaataaatatatatttacatagtttatagttgttacataaaactttcatgttcttttccttatgaaatgactctatgactttgggcacattacagattgtaatgtagtggattgatggtacatgatttaagggaaatcttgtactaatctgcaagt

SEQ ID NO: 87487 - DNA, 2897 bp, Homo sapiens
attattaaggtacttggctatgtactgtatataccttatctcattaatcttgttgacaatctgctaggtaattgttattatttccattttagagacgaggagacaaagacttaaaaaggttatttgcccggttagtaattggcagagccaaatttaaacccagatctgtacaattgaagctgatgtcttaactactatagtacagcggctttcttgatgctagatgatgtggccccagttttggtaatggaggaatactgatccaatccaaagtggatgtttgcatggaggagtcagagaattttaagaatgaaagggtacatggaagccatcagccctcatgtaaaacaaaagtcctgtgtatctgataaatgttctctgtttaactagatttgtatagtgccctgggagtactagttagcattagtaacaacattctggggcaggggagggtgggggaacgtatcatcagaaaaaatggatttggggatatagaggtgaaggcaggaagaggcagtcatatagaatgatgtgcttggaagatctctgccttttcatgtactgcatctgacaaaaatggatttgatgacatctgggatttgcttcaaaataatagaggaggagggaagtggatttggatgtggatgggacgggattggcctggtttgatggttgttggggttgtatgatggatgcatgggttttattatgtttttctattttgatgtatgttcaaaattctccataataaaatgtttttaaaagttatttgaaagtactgtttccatgattttatagtggtcagattatgtatatgttttcttatccaaaattcccttggtttttctcagaagctttttcttctagcatttgttcccttttagaatctccctcacctctctttctgattatttattaaaagaactcaattttttcagtgctgaaggagaagttaactatcaaatgcccatatagctacagtattgggataatttatctaatttttcttatgagtaagttctctttgactttatttttgaactcaacttgcttgcattgttcttgttagtaaaaaacattgctaggatgtacttagtaattggagtcagctgcacttaagactgttcagccagactgttattttagccttcactagtagggtttttaacaccagtttgaccttactttgaaacattctcaaaataccatactttaatatcaatttatatactttcatattaaggcagggccgggtccctggggaaaaaaataatgaaatttttacttcccacaaatgtagaataaaggtagatattctgattttgttttttaaagaaaaatagaggtaaagactttaaaatttttctttggtcaggacataatgcttgcaaatacattctaaaatataagtgggccaggcatggtggctcacgcctgtaatcccagcactttgggaggctgaggcgggtggatcacctgaggtcaggagttcgagaccagctggccaatatggcgagaccccgcctctactaaaagtacaaaaattagcccggcatggtggcgtgtgcatgtaatcccaggtactagggaggctgaggcaggagaatcactgaaacctgggaggcagaggctgtagtgagccaagattgtgccactgcactctagcctgggcgacagagcaagactctgtctcaaaaaaataaaataaaataaataaagtataagtcacagaaagataggacacctacaaattaggggtgctggtttcattggccagtgtgtcctaccattgctttgggatagagactgaatcctcagtgtgaagcaccaagtagatggtgattattcatgaaatcagaaagaattttttttctgaaatactaaattcccataacctatgcaaattacattttaggcaagtaatgctcaaattttctataagtgttctgaaaataagttataagtttttgttcatttcataggaggacagttgactcctttctactcttttttttgccgttgtccctattttttgccactggtaaactcctgcctagaggaatgccagaggcagaataaattttggagcatggattttttttttaaggagggttatagtatcctgaagacttcatttctttctctgaagacacaactatcagcaaatccatataaggcaagtgactccctaccatctcctccgagtcttctacgtgtatgtctagatactatgacagatccagtgcctgtgaagacctggaacatttcagacaatcacacagatgttttcttatgctatatataggaattaagcaagtgtttcataatgaagtgtccctccaagcattctctatcttctggtaatgcaaaagtgttagacatccagtaagcagccctttttaggcctaaaatgttgactactttatctctgttacctttctgaaatgtttggcctaatattttttataacatctctgtgaaagtttgaaaatttatgattgttgatcctcaatagtcaaaaaagtagtcatttaacaatacaatatttctctcgtgttcttgagcatgtatttaagttagctttagttaaccctttattttctggacttcttcaagtcagctctcagaattgtttttacgggttgctgaggaagctaaaggtcaaagatattttcttagtcagttgatttacctcaaagaattacttcatgtagattaactgaaataatgatgctgctaagattcgcagattaagatcattatagcatttgagtaggccctcagtgacaaattgctctaaacctgtttggctcaccaccataaggtttaaaacataaaaatataaaagtgcttaaaattttctttctgtttccttatcagaaatattcatttagacc

SEQ ID NO: 87488 - DNA, 1963 bp, Homo sapiens
caagatctcttaattcacaaaagcatttgctctagttcctgttctctgctgcaggggctacggagagggagtgggggctgggggaggaccattgggagaatgttctgaggagaagagaggctctcttcacactctactgagtacacagactttggagatgaaaaacagacggagagaggcatttccaaccatcttgctgatctgtgcaggagttcattgaactgtacagcacagcaccagacccttgtgtcatttaatgttactttaaaaaattattcttaaatgttcagcacaaatatccctcccctttttacttaagctgaaaaagaatataaaaattaaagagaaattgaaaatctaagtcttgcagtgagaatgaccagaaatcgtttccctctctggggggttcctgtttaatatgaaagtcctcttaacaagcgtggacagaggaagttttaggtttgatttgaacttcatgtacaagacatatttcatttttttttcttccctcacaaatttcaacccaggccacttgtttgcagagactgccaaaccttccattgccgcttccaagatactcctggaatctgagattaccttttatcctcttgatggaccatgttgttatttttgtcattttccctgcagctcttctgctttgctggggaggactcatccccctatgcatcatctaccccccgatagctgacacagtactgttcacaaggttacttactggttttttgtttttttttttttgagacagtttcacgctgtggcccaggctggaatgtagggatgtgatcacggctcactgcaacctccacctcctgggctgaagtgatcctcccacgtcagtctcctgagtagctgggattacaggtgtaagccactacacccagctgatttttttttttttttggtgttttttgtagagacagggttttgccatgttgcccaggctggtctcgaactcctgggttcagggatccatccccctcggcctcctaaagtgctcggattacaggtgtgagccactgtaagcgactatccagccaaggtcgcttacttgtgtaccagtttgggtcactctgaaaattgctttgaaatacttactgtttaaaatgactgagctcttaggagtgtttctgccctctccccacaaccctcaaatatctaaaacaacctaatcaaattggtagttttcatggctttcaaaatggaactaaaattaaagtaaaaatgatagaatcttgagctagagtggcagatttgaattctaggctttgctggtccactgatgatgttcattttctttccttgtgactctcataatcagagtaaaaagatgagattgtaagtgataacacaatccattcagaatgtatgactttgctgaattgaggttgatctttaagtgtgagtaaaatgttatgcaaattggtagtttaaataatatttcagaggggaacatgcacttgctagagaaaatgaaaatatttcaaacccacttagtttttttaatggcagatgtttcctttttttaatttaaaaaaaatttttttaagacagggtcttgctctattgcccaggctggagtgcagtggcgtgatcatggcttactgcagcctcgacctcccaggctcaagcaaccctcccgcctcatcctcccgagtagttgggactataggcacacaccaccatgcctggctaatttttttttttgagacagagtctcactctgctgcccaagctggagtgcagtggtgtgatctcggctcactgcaacctccacctctcaggttcaagcgattctcgtgccttagcctcctgaggacctgggactacaggtacgcaccaccacacctagctaattttttgtatttttagtagagacggggtttctccatgttggtcaggctggtctcaaactcctgacctcaggtaatccgcccgcctcagc

SEQ ID NO: 87489 - DNA, 3010 bp, Homo sapiens
tgttaaaccacttcatggaacattcaaaaactcagaggctacactggctggatttaagtggtgggggttatacagcaaattacctacatttaaggttgctgctgccgtttcattccatgttgccaactgcagaaatgtgggctccgtgttcccagactttccatttagtcaaaagagacaggaaattcacatttttatggatatttcctgattttttaaacactacaggctaactgaaacagtttgtgacttttgcattgtatgttccactccattttatcctcataacatccctacaagataggtataattatttgtatttgcgcactctcaacacagctaatacagagcaaaagtagaaatctactgcaggtctgtctccctccaaaaactatgttgttattgcgcttcctcatctggttccctaaactcatgaaggtggtactgttggcaaaaaaatgtactgtttggttaaagccaggcccttaacaaaattatcaaacagcatggtactgtaccacagagtgccattttccagaaaacagttatttatggctttgggagaattgattgtaacatgaagataatgataactgcaaatatcaaacaaaagctctgttgactttgctccagattttttatttcaaccccatggtacttctagaaaaggcacacaaatactctaaattgttaacagagttcttcaagtttctcaaagagtggcaaaaatattagtggcaattttacaaagcctgaccttgccagaaagagatatcagtagttctcggtgtctactaaatatttaatcacttttattaaaattctaaatgaacttagacgccttgaggagttaatgcacctccacaaacctgctttccgctggtaagatcaggcccattattattattatgtacagctgtaaaaagctggttccatagcataaattgcgaaatacttaggcaagaagattattcgagaagaattgtattgcttgttcagttatatattttgatctttatagctagtagttttttttctcatgagagttggagattaaccttgcttttaatgtaaaaagtatatcagtgagggtaaaaatagaaaatgaaaatagatttttaatggcaactttggttcttagcattaattttacatgcatttttcattctgaacttttaaacagttttgagaaacatatgagagatttgtgaacaggggcaagggagggtcaaatgtatcaaatccttggattccagcaaatgtaggatttgtggaagagctgagaagcacacatgtgttgggaatgtaaattaaaataaaaccccactttgtgaaggctttgaaaagagagtgcaccctgttatggcaaatgtctgaggcgtttgtcttcttaataaattaaccaaatattaaaataaacattacttttatcagcctgcatttttcctctctggatgaaagtgtttcaggaaaaatcataaaagaatctatggtagctcagagaggttaaactcaacagttgttttctttgaagtctctggccatgaggttaattgccaaaactgcttgtggaaaaggtggtaacaatttaacaagactgtacaactgcagagacttagatgaatatcaggtgtttgcagatgttttttcctaacaggaaagggggtggggaggagaggcggaacagaatgagaaacaggggaagagagaggcctgaataaagtcccaactaaacagccaataattctttgtttgcttagccaatcatcctgtaattggccaggaggttaataggagtctattgattggtcaggaagattgcttactgtggctgtttttacagtatgctcccagacagaagactgcaattactggagctctcattcccactctttagggccatggctgctctgatttatgaaacccgatcaggttgctgttggcagtttatgttttaagtgttgccttctgggtctttgctgcttatgggtcactgtgctatttctcatcatttattgtggtcatttgaataggtaagcttatttatgacttactgaagtaggaatacattaaaagtaataaccaccacccacgtgcactgaaaagtgggaacaatcgtacaagatgtgtgacagagctctgcttgttctagaaatagagattctgctaccagtatagagtttacaaaagaccaggaaataaaataatacagcccttcctttctctgtcttcaacagacatgtttctcaactctcctcattaattcctgctaattgattacacttagatttgctttcgtataacttctcataattagatttggttgctggtatgttagagttaggaaactgaggccaagttgtaaatgtctttaacccccagactgcttttggaacttgtgacagggctcttctaacttaacccatcctgacctggtcttgaccttagcattactaataaggtacttacctcatcatttcgtttctcacttactgaacgtgactataaatcctcctgttactcaagatcttggttttccacacttttgcaaaccttcttttgtagttccctgggagcccagttgaaggggagtaaatctttaattctgataaggccctggagccacagacttctgtgtagccacatctagacaactgaatttcacttacacttccaacttctcatttaaagctacaatgaccacaactactgcaatgactgttactgctactactactgctattacaggttgaccatcccaaatccaaacatctgaaatctgggatgctccaaaattcaaaacttttttgagtgagtgccaatattacactctaaggcaatgttcattggaggattttcgatcttcagattagggattctcaaccagtaagtatataatgcaaatattctaagatctgaaaaaattcaaaattcaaagcactcctggtcccaagcatttcggataggggataatcaacctataccactacctcctcctcctgttttttcc

SEQ ID NO: 87490 - DNA, 1060 bp, Homo sapiens
atgttgtaggacagtgctaatccgacttgtccttcagtgtggtaattatgggccaagtaaagtaaaatgttagttgctaagtctccagtggggtactccaccaccagttctactggactttgagaatatcattcctgcctttcttcttggttcacgtctaggcaagattacctctttttctctgttttcttactattttaataattgtttttactatgaatatcagagggaaagagatgactttgcccttaaaagatgctagccacataatctctgcaacctcaccaaacccccagtgtaaggtagcatctcctatttaatttggaattcataagagaagttagcttgttacttttaaatggactacagtttctttatcatctgctttaccataatccaaaaatttcagaaccccagaggaaggtccttaagattaattatctctaccattgtatgccgttagaatccttgtatcatgtatcattttttttcttgttttttcgtttgtttggctaaactttgctgtttacctcattatcaacttttatatcagaactcaacagcagtcatattaggattctttagtaacacagcgatgtgtgcacttttatcttcccatttgggggtgaaatctgccactgttttccaaacgaattaacaaccaaccaacaaccacacacaaaaaaggaataattcatgttctgacactagccagcttaaaagtctcattgttttggtatcctttcactgttgctaaagaaattaagaggatggagaaaacaacaatccattggtttagtgaagggaagcaaggttgagggagtaaatgtgatgttcatccccccactgccactttgttctcctgaaggacctttcctttagatatttgtcgcactgccttccttcagtttgttttcttttcccttgttttgttttgaaccaatgtgtcctttgaggaaggaaggaagggagggaaggaagaaggaaaggaggagagaagaaaactcatgtaatacagccaagattgtgaactgagagttggggcaaatgcaatatttgg

SEQ ID NO: 87491 - DNA, 1547 bp, Homo sapiens
cttaagcgaccctccccacatgggtctcctgaagtactgggattacaggcatgagccaccgcgcccagcctcagagggattttgttcttgagaactaaaacgtgacttctgttaatcatcagaatatttatttaatgtgtttaatgtaaaaaaggaattacatttattgtaaatgaaggcactaaatatatttttactcttaaattacaatgttgaagtatccttttgatcaaatgcaactggttttttttttttggtggggggtgtttggcttgcaaaagataaatcatttcagaaatgtttttctatttgcattttttcttgaaattttcttttgagtatggaaaagtgatcaacaaacaatacagagaatttttaatgagacatgtcaggcatcgtggaaggctcttgcctgggtcacttatgtgatgacctcaacaaacccattttattatacaatgaaaaaagtgtacgaagcttacatatgatttttttttaagtttcttcctgccagagcatggattaaagaaactttagtaaagagtaaaaaattttaaaacacacagtttgatatgaattttggtaaaagttatcagagacaaatactagtgggccaacgaaaacactgtatttataggaaaatttgaattggggcaataaatatgtcctgaggctttggtggcatcaaagtattggtgctttattttttgtgatttattgttttatcaacagaagtgagcacttgtgttcagaaaaggataattcacacttaaatcttgtttttatttaatcaagcttaaataacaggttagagtggtagcaaaaaaaaaaaaaaaaagtctaatatttagtttgaatcttaaattggtcacccagagctgctctctctaggagcgaacctctctatttgtcaataaacaagagagagatacaggctcccagataacaggcatttggtaaactggcgacagtcatacaagcgagaatgttaaaatgacttcagctctttctagcttcattatgtcagcctggcagatcacatatggcattatggaaatcagcaaatgaaaaccatattgatcagcattgagaacaaatgtaaaaaaggtggtctcagggaggagcagagaagaagaatgctttcctgttcaacctgataggcccttgttaaggccttttaatcatttattaacataaccctccttcttccctctccactcagattacctcagccacagagcatcctgctccatttatcttttaatgcttcctttatttaatttatttttaagctctaagttatactcttatttcagaattgagttttacttttcatggtattgtttaaagtgacttaaatgacttttcccaacaagctcaccaggcattcaaaggaagaaaagcatttgctgagattcacctatcagcaaataatttactcggtatgcaccacaaacaaacgcagagagacagagaaagacagtcagccagacacattaaaaaaaaaaaaaagaaaagtaaaatctgagttgttactaagcctaatt

SEQ ID NO: 87492 - DNA, 2239 bp, Homo sapiens
cttttcagggattggaattgagcctggtaaaattccttaggtctaaaactggaatctcaggcaccttctctttccctcttcattttctgagttcgggagaaaggtggacttttgttttatcttgtttcttttgggggaaacttagagtaatatttggtctgccaaaatgagatagagaaatggaaatacgtgctttgtggaggatcctgttttccttgagtgtccttacctgaaatggtctctttggttttgtaggttcagactgaggttggaacgggcttgcttctctctctcaccttctccctacccaacccctgcctccccttttatttttatgtcgagtttcatcatttggtaagaaatttcagagggatttttaaatatgaaactgtgtctttttgtagttgatgagtaacctgtggatgtgaatccttggaatcctaattggcacataacaataattgtttctatcctgctataaaccataagtaactcctaaaaaaattcacatgcacacaaaaaatctgcagtgtggatataagttaatgccctgaagctggtacatacagaccacctcaacgatggactcctttatgaatgatttaggtaattgacacaatttaatatttgcaattatttttcctttgaaacaacacttaaaaaaaacaaattctacaacatttaaacagttgaggcatcactctcctataaatttagtattaaatttcaaaatacgtatttgttttaaaaagcaaatgtggttaatctcgaaatcattgaactttctctttgctctggactccttgtctgaggctgtttgggatggattaattttaacttttctttcctgtttctttgctttcccagtgcatctgggggaaataactctgattgatttggatatcaaaagatgtacaatgtgaagatctaatttatcaaaacagaattcaataattttattcattttggctctcccttgagactccaaagatatattcagtaatatatttgaaaaatccaggtataaaaatgtcttttatcttctcttcatcttgtatactccttgatttctaagtacttttcctcttagactcatattactatcccactttcctttctgggctctacatcaaacagtgtaggaattacagcaggagtgctatctgtggaagacttactccccttgtttgttgcagaagagcagaacattaaacagtgagtggactatgcagaaacgctctccctctccggctcttttctccctccctgcctctttttttttttcattcttgcctctccttctcttcctctgtttctctctttctctctctctctctcttcccccccacccgcccccattcccaatgggagtgttgtttatagagcattataatttataactgaagagagtggatttaatttcagtggagaggctcgccagcagggcgccagcctgcaatcatatgaatcagcaagctgcaaactctattgaatggaaagtattatcgctggccacaaacggacactgtttctcctaaacaactcccttggtgcaggaagaccttgtcttcattcatctattttacatatctacttctgttttaattttgccatttcctaaaagtgttttctgttttagattgcagcttttctctaactaccttatttcctgatgcaatattgaaaactgctattgtatatttctgactgatttgatatctcttctttccttattctttaccatgtatgactagttttctgtttgcttctccttcctatatgcaactcttttttttatgagacctgttaaacctgccaaaagactaaccattagcattaatactgtaaaatgctagtcagtttggatcacctcaagttttatttaatcatggatattttgtttatactccgacattttttctacattcatggaaagatttattttgttgtcttgcaaacatctgggagatgatttcttattctttacatgacccatcaaatgtcttgtaatgttagtacttgtgcctttataccacatttttctcaagtgtttcagtcatttttttaggaaaagggatagaatatgtgcatgacttgtggctggtatttgttttttgctttaactcaaaatcagctgctttaatgtagctgaactaaatctctaggttattctaaaaatcaagttggaccaactttgctgatacctttttaagaagtattttactgaattcatgtagct

SEQ ID NO: 87493 - DNA, 3143 bp, Homo sapiens
caacaactcaaaatatatgtaatcataatttttctcatttcaagcacaaacttgtgaatccatatatattcatacattttatcctttaaagtgtgagaatagagttatagtcttcactgtctcagctaggtttttcttttcttttttcctttttgcctttgattactccataagaattacacacagaagcagaaaatcaatatgtttacctctgcttattttcaaaattgaatgttgctgtggtttgataccagagacggtatacccagtatcagctttgagagattttgtttggttttagtttaaaattccttgtgtgtgtggatattacctctgacaacaattaactatcagtaaaagtaaaatgttcattttttttttccccaagaagtagtgagtgaaatgaagaagaaacttgtgagatgatttcaggtgaacatctttctaaatccttttattcatgacttaaaaccatttggtaagtctgacccaagatgtatggatttttattgaattattaagattacaaaaactacaggcagctatcttcacacatatcttcagacagtaatcttgtgcatttttaacatccttgaggaggtgggagaactatgttgaagtgcagacatttgattaaggttggaatgactcaacagtagtgaaaacacccttgccttcatcttttcagaggcctggagaggcagaccctttgtcttttcacttgagtcctgccttctttgtttttgtgttttgttttgtttttgcctaaaagatgttcctctctacctgtaatgtaacattcaagaaaaatctggtttatctgtgcctcatcctgattaattcctattttcaaaatctaccataagaactttcaaaatccagtcctagaacagataagttgtgtttgcctgtgtattctatgcaaaagattagtttctttaaatttatacacacaagttaatacctttgagaattttctgcaattgaagtaaaagaaaaaatatgtggttggcatctttgatttttttttttttgtagtgacagtctcgctggtatctttgatttaaataaaaatatatattgaaaatagaaccatctataaatacatttgtccaaaatctttatatgctactagattcaaagatataaattaactacaaggaaatgccattcactaaaaagttgctttttatcatttaaagcagggtggtttttttttttgcagaatttttgcatgttatggtgacctgacttcctaacatattatctgattccttgatcagaaaaactttataaaaatagtctgagttaattttttttttaatttactggataaccttgtaaaagtccctccactagtcatatagtgaatatgtcacatttaggtaattgccattgccgtgctggatggttaatatacggaatttccgagcactgatctaatagaacttgctggggcatcatggcagacaagtatgtctcccctccctgtgactgcgctcctgcatggtatgcttggcaagcttagcaaagcttaaaagtcagctgcatctgtgtgatccaactttgctttgactgggagcaattgagtacaccatttgttttttctaaatatcacaaaaattgtattttccatttactagggccttttaagaaaaaaatgcctagggctgatggtttaccaacttttttaccatctatgcctccaaaatataaaaaaggtcatggtcttactactgattatagtggaccacactatggtcactctagttaaaactgtgaccttgaagcgggggttgggtaaggaaggccctacttgtggcagctttcctccacattttggagctttgatgtgttcctgcagctgatataaatgcagggagggggtgtcagggagaggcagctggctggcagcgacagattaaaatatttctgacccacaaatgtaaccaaatgcccatatttcttcatttaacataattaatgccttgtatttccactgactttgataaagtggccttcctcttcccatcccatcccccttccctgtgtcaactttgggacgactacaagagatctatagttaaaatactctgcagatgatgaaggatagcatgtctgaaaaaagctaacataaaagtctcaattaggttgctgcctagcaggaagcttataaccacattaaaatggaaaagttatttcatttttagtatactgtatttcagcagcaagagttgcaatctgagagtaatatgaaacattttggtttggctgccaagtacatccacattttgttataaatgtataattacaggaaatatgtgaaaagtgttaaatatttcttatcaaatattgttaaagaggtattctggttacatttggaatttagaaaaggcctgggatggattttgatcatgttacaaggcccacttgttgcatttaatttaaagcagttgtcccaatttcattaccacagagcatagcgttttcaaatttattctttaaaagacagagatagtggcacaaaatgtgctgtgggtttaagcaatatttgattgatcatgtgattctatcagtatcttttttttcttttattttgcctcagtatacacatttctgaatgaaaagatagacgatgtctttattttaaacaatctagtggtggttgaagaggccatctggaaaggtgatgtcaacggagggtagggtggttgctggtggaggggagtagccagcgcccctcccctcagcacacataccagcccccgcaattccagtttcatggtgcctgagttgctgtctggttggttgaactcattctcctcagcttatatttaactcgtcgcttgttctggaaaagtagtagtactgccttctctggcctttataaacatgattgctggacaaagatgagcagcacggatttgctgcgatggtcagaattcaattatattactctctctgaggcaaaaagcacacatttaataactaaattggattccttctactaagagatcctaaattcgtgtttaatagccagctaaatgtagagctgatttatatttataggctggttgtagatttggttgatagaatataaagtttgatctgtatgtggatggttttactaccccaaatgaaat

SEQ ID NO: 87494 - DNA, 1050 bp, Homo sapiens
gcatttgcctctacaagaatattctcacaccatagatatagagaaaggacaggtatatacatcgtattttatttgaaggtatcctgacagaatttctgcctatcttttttcctgctacagtctgttgtacagcagcaagaccaagatgattccagtaataagccttattggtatggttcactgatttttttggactctgcatttattttagcagacttccccaataacattttgcagttttcagcttttagttgttgaaaacaaaaataataagtaaaccagttcagggatatacttctctttctgaaactgattccatgtcataatgccctccttggggaggagcaacgtctccagccgaggctgcaacccgaggaaccactcctgatggaatatgagaaagaaaagtgtattatttacattcttaatgttttgccttttgttgttatttgggacactcaagaggaccaacatgacgttagagctttttacttaataaattatatacatatatatcttgcttaagttttataggtaatcctggaagtttagtcttactttgggaaaagatcaaggcaacattctattcacattcgttcagcaaatatttgttgagcacctattatatgtcataatagtgagtgcctagaatacatttaccagaggaaatgttgttcctactaaatgagtaaaaccctgcggcacacacgataaatattatttttaaaaagtggttttaggccaggcctggtggctcacgcctgtaatcccagcacctggggaggccgaggtgggcagatcacgaggtcaggagatcaagaccatcctggctaacacggtgaaacccagtctctactaaaaatacaaaaaattagccgggcgtggtggtgggcgcctgtagtcccagctactggggaggctgaggcaggagaatggtgtgaacctgggaggcggagcttgcagtgagccgagatcacgccactgcattccagcctgggcgacagagcgagactccgtctcagaaaggaaaaaaaaaaaaaaagttttttt

SEQ ID NO: 87495 - DNA, 1211 bp, Homo sapiens
gagaaggagcaggttctgccctgtgctgcaagatctgagtcagcgatcaaggtcagtctcagttcattaacttcttctgaaggcttatagtcattgcaaatataactgcttataccttatgttatcattatatagtacggttttggaatgacttatgttcacctcaaatgtgtcctagagtaacagaaggatgctgaaatgtctagagtagtataaactgatttctgaccattttgcctagtttcctaatgcccacaaatggaaaagtctcacctctcaaggtataagtgtggataaatactctcacatgtgctgagatcagacaggggcctgcttttaaatgaatcatccaaaaatcattatttattttgaggagcaatatacaaggattctcactgtacttccagccaatacattatttaacattagaatatatttcatattattaaggtctcaccattaagaaagatgttttctcaacagttctaatacctatgtcattcttatgttcagacaataccaaaactctttttaactgtaaattgctacccttaagcccacttttaaatgatgtttaatatattccacttgaaacaaaatggcaaatcatattaagcttaacagtttttgagaagtctggaatgaaggtaacattttatgtgcccagtcctttacatagaagtagaataacttggtttgagatttttgtatgtggataacctagctgtgcaatgagataggattctttttccttttctttccttgttatttaaaaaaaattgagatggggttttgctatgttgaccaggctggtctcaaactcctggccttatgcaatcctcccatcttggcctcccaaagtgctaggattacatgtgtgagcccggccgagatagaattgtttcatttaaggattcctcagtgtactttagaagcactccacaccaacctttataaataaacagaaagtcagaaaaattgttatactttttcatttgttaaacatattttaaagaccatttgattttcagacagtggtggtggtgataagataatgtattgaggttgtttttaagccaagaatatctgtggatatgggaccatttttacttatctcatgtaaaatagattttgatccaatttctgtgagttgatttttctgaaaatgaaataattaacattattttcttttcttttgagacagagtcttg

SEQ ID NO: 87496 - DNA, 1603 bp, Homo sapiens
ttgagatcataggtcatttgtccttacatgcctggttcatttcacttagcataatgtcctccaagctcatccatgttgtcacaaatgacaggatttccttcttttttaaggctgaatagtattccattgtgcatatgtaccacattttcatttatctgttgatggacattttggttgattccataacttggctgctgtgactagttctgtaatgaacatgagagcacagatatctcttcaacacactaatttcctttcctttctgtatatacccagtttcaggattgctcatggtttgtatggttaaaataaggaaatggccaaagtatgatttcaataatcgcacggtgtattaccatacaaagagattctcttccctgcttccctacaatgctcaaacggggagaaaatgagaaaaaatcttgtagggaatacactcgatagacacagtgagttccattttatttagagtccaattgatgaattctggtagctcaattaagatagaatcaggcctcagtggaagtaaagtctaatcacagttcgatatgtacttttctatgggagcttctcaggagagatggtttgaccacacaagtccttgtacactagtgagtggtgcaggtattggcaggtgagactttggagaacagcttgaaggctgacaaagagtagtcctgctgcatcctgaggtctcagtgtgtcttgtcaaagtcctggggttaggtcaggcatgggtggttcacacctgtaatcccagcactttcggaggccaaggcaggaagattacttgttggcaggagttcgagatcaacctgagcaacttagtgagaccccatctctgtaaaaaatataaagattagctgggtgtggtggtgcatggccatagtcccagctactcaggagactgaggcaggaggatcacttgagtttgaggatgcagtgagctatgattgtgtcactgtgctccagcctgggtgacacagtgggaaaaaaaaaaaaagctcttgggtttacatgtgttttggagtccagtagttgagatcagtaactcacatatgtggtctgataaggggtgatgtaacattgtcatggggaagggcattatactccatgtttttatcttagcaaaacatatgtcaccaatgcagcaaattatgtgaatgtttggaatcatttcaaagctgtcccagctagattatatgatagctctatttttaattttgggggaaacctcaatactgttttccataatggctgtgctaattcacattcccaccaacaatacactgtggttcactgggagaaaatattaacggaagctacacattggtagaaagtattttccgctcacccaactgataaaggacttgtatccagaatatataaatataaaaagctcagaactcaagaataagaaagctaacaactgaattaaaaaataggtaagtttgagactaggtgtggtggctcacgcctgtaattctagcactttgggagactgaggcagaagggttgcttgagtctaggagttagaatccagcctgggcaacagagtgagatcccagctctacaaaaaataacagaagattagctgggtgtg

SEQ ID NO: 87497 - DNA, 1060 bp, Homo sapiens
ttagtttagtactttaaaccttagacataaaaaagaagactatcagtgaaaatcaattgaaatgtagttagataaagatctgatgtacaagcagaaggcttagttgcagcacaatataatcaattaggactctccagctgcatacagagttttacccatccaatcacttttcacacgtttcttccattagcttgactagagttattcttctttttttaatgtgaattatgatgaatgagattgttgttatgaatatagagatgggtcattatcctacagaaaccagattgtgctggtgtttagtgattagggctatctgcttctgctatcaataaagtacagatttatctgtctcaaattatgattgggaagccagtagtcattgttatctaattcatttaacaatgttacaatacaaatgtataatataaaattgtttttgttcagctgggtaattgacataacttttaagttgtgagggtaaaggaatataatttatcaaatagaggtgggaaatttttcatggcttaaaatcaaataaatattcctcaggaattagtacccccaaatttaacaccctgggtgtagcctttaagatgtcaaaatgtggaaagaacaaatgaagtttacgtaccctatatgaagacgctggagctttgcaaagtaatgagcatcggtttattacagaagttctgtaattaattattacagtctaaaaaatgatacgatgttttcctgggcttgggttgaggaattcaggaggtgggaaggagttattggatctagtttaatgcaccaagtgactggaaatggcattgctaggtaaattgggccgtcagcctaacattagcattttttattaaaaaaaaatactcaatccttagaaaacttacacccaggtagattagtagagaaggtcttgctagaaacagctatttaattttaatcaaacttgtttttctttgcccttaaaattgaatttttgtttttgttcttattttaagtttttcctattccagactcctattgtcaaagaaaaagccttttttttttttttttt

SEQ ID NO: 87498 - DNA, 1989 bp, Homo sapiens
catctaaaccatttttagctagttgtttattaacggtagtggaagagtgtggactatgagtttgtgataacggttttttttaacttcttattttgaaaaattttaaacataggcagaaggagaaagaatagcttaaaaaaaccccactagccatcacccatcttcaataattatcaataaataaccaagcttgtcttatccttatctccctaatcctactctttgctggttatttttattttaacagccttatttaggtataatttacatacaatacaattcatccatggtaagtatacaatttaatgatttcttagtaaatttacagagttatgcatccaacaccacaacggagttttagaatattcctattaccctgtgttcccatatgctccttaataggagctcacactccccaaccctacgcagtcattgatctaatttctgtctctatgtatttgtcattctggacatgtcatgtaaatggaaacatacaatacgtagtcttttgaggctggcttgctggcctaatgtttttgagactcatccatgttgtcgaatgtagagtgttgtggactatgtcagcactttgttcttgtggccgtgggccccttttcactgagccttctttgcctttatcttcacttgaatttgtgggctatgtgctgaatgacttccctgttactttcagtgttgttttagaggaaaacacagttgttgttttgtctttgttttaatgaactgatatctcctgtgtgtccatgctgattcttaagttgtttaaggaaatatttccttaatagaagaaccttctttcaggatcctcctattcttcctcccaatattgaaaatcattttttaaaatttgccattaaacaaatttttttgtttttcctgaagaaactccccttcatttaaaaatctatagtttcttgcttttagaaaagaaaacattactttaaaatttgccattttgtttgtcagttaccaaattgtccactctgggaaaattcgatgtgaagagctcataagaacaaaagcatgatcttaagtatggtttttagacaaacatgttttgaactccatgttgtctcaaattagaaattttcccttatctccgtagttcaaaatatatttttatttaattatattcaatgtaatatatttttaattaaactatattttaattcatatgatgtctcaagctaagcattgtacaaaggactcataaacatatgtttgttatatttttctacatgatgtttgttaagatgtttaaaatgtcccctaagcatggtgctaaagtgctatgtatctgttgttcctaagctttatttaggtaaatgttatagtgcagtttgctgtgagtttaatgttagtgaatctacaatatggtatgtccagaaaaagaaagagggagttcaccaacctgtacaaagcttcttgggaaaatgctagggtagtacctatagtgcctgattgaaactatggaaaagatagaaaggtggctaaatttgtgaatttatgagaaaatgactgatacaattgttgataggctgaaagccaaagaaatttacattacccagggtcaggaaaatgttatgcccttctcagctagtgctggctggtttgaacatttcaaaaggcaatatgttgtgaagaatattaaactttcaggcaaggtatggtctgcaaatgcagaagaatttttaaagtaccagcttaagtgttacacaggaaaagggttatgtggaaaagccggttttcaacactgttgagactggcttgttttcaattgaggagacattggcaaatgaaccaatgttacatattaataaatgacattttagttgatggaaaatgtcgtgaccagggtcttgcaggaacctaaccctgtttttcccagagaaaatttcagtattcactaattcagtgttcatagtgacttcctaagtaccttgaataatgagaatagattgtcattgataa

SEQ ID NO: 87499 - DNA, 1116 bp, Homo sapiens
tattttaaattttcaatcggttcaaaattcaaaacataaaaggatacataatgaaaaatcctttctcccttccctgcccccagccacccagtttctctgtttagaggccaccaatattaacagttgttttttttttttgagacggagtctcgctctgtcgcccaggttggagtgcagtggcacgatctcagcttactgcaagctccacctcctgggttcacgccattctcttgcctcagcctcccaagtagctgggagtacaggcacccgccaccatgtccagctaattttttgtatttttaatagagacagggtttcaccgtgttagccaggatggtctcgatctcctgacctcgtgatccacccacctcggcctcccaaagtgctgggattacaagcgtgagccactgcgcccagccaacagtttctttattcttccagaaatgttttatgcagtacacatttgagtaggggaaaaaaatgaagtaacccttatttattcaaaatttcaagagtattaaagtaccattggtttctacatgttatttttattgagtcaacttgccaacacaaaccaacataaaccaagactgtaagtgttatcaaggacatcaagatagacccttcactaagagattttaagaactcactcaaaatactctcagcatgaggcttttagagtttcctatctttggactttatgttgctgacatgtgttctcagctagatttctggtatgtctgtgaaactcctttcttatcattcgtcttttagtcgtggacaaagccagtaaaagagagcatggatatgagttattgagtagcactgatgaccaacagagttacccatgttgcttttcccttagtttatagtctatacttaaaagtttttccttctaaaacacctagagctgagaatgacagttttacccccttaccttcataataaataaatagaattttaaaacacagaacagaaagctagattccagaaaaatgttggcaaccatgtatagggttatttattgatgactttgctcattggcagtataaagggcgtgtcacttgtcattagcagtaacaatttcaccacattatgttctctttttattttctc

SEQ ID NO: 87500 - DNA, 1094 bp, Homo sapiens
tgcactccagcctgggcgacagagcaaggctctgttaccaaaaaaaaaaaaaaaagaaacatagagtttagaaacgtcaacatttatataataagagttccaaaataatatgatagggagaagcaatgttcacataataactaccaagaatcttccagaattgtagacctcagattgaaagtataacttgagtgttgagcagagtaaataaaaataaatttgtatctatgtacgttgtagtgtaattgaagaccattgatttttaaaaggctagctgagagaaaagacatcttttctacataaatgtgaaaattaggttgatgatagacttgtaatttggtgacaatagatgccagaaggcaatggagtaatataccagagtgctgagctgataaaaaagatattatttttaattttacagttctatacccagctaaaattcaatacttttacacagtggcagtttaccactgtcatgcttttgttgaaaaagaaaatcctttaaaaatgtgcttcaccaacaaaatataaatgtagaggtaggagtgatatgtaagattcagaattatgatggtagttaactttgaattttataatgataatagaatagcaatacctttcatattataatttacttacatggaatgaaaacctcagacagtaatgacaagaatgatgtggagttgttcgctggcaattaaagcatattcaagacaaatattgagatactgagtagcccagaaaaaactatggtataaaaatttaaggacactgcggggcactgtggctcatgcctataatcccagcactttgggaggttgaggcaggcggatcacctgagctcaggaattcaagaccacgctggccaacgtggcaaaaccccttctctactaaaaatacaaaaattagctgggtgtggtggcacatgcctgtaatcccagctagtcaggaggctgaggcaagagaatcacttgaacccagaaggtagaggttgcagtgagccgagatcatggcactgcactccagcctgggtgacagagggagactctgtttcaaaaacaataaataaataaataaaaatttaaggacaaacc

SEQ ID NO: 87501 - DNA, 1800 bp, Homo sapiens
cttaccatactctgattactagaaatatataaatgaaaccaacatttctctatcctggaaaaaaagtgtccagtagagtctgtccttcctgagcttagttaaagcaattcttgtatctttgttttatattttttaaccttttccaatccttaatacatttgtggtcttactgggatatgccaggaagaaatttcttccttctatttcttctccctctttttagctgtctactgtataccatgtagaaccacaaaatgcatgtttttatctgttctgttgtgtagaatgtatatgctgccagccagccttactctttcctctctacactgccacagctacaactgcttccctgtcaaacattagaaaaacacaggtgggcacctagtgcatggtgttacagtaaagacaactcgacatcatactgactacaaattacctcccctagtttaaaggcaaatagtagctatcacaaccaaatttagaatgtgacaccattgtttaggtgtatgtgattcatttttattatctaatcacatatttttttcccttctaatttgtgccctgactgcaccttgtgaaaggttagaactgggataataactgtgatgaacaagttattcaagaaatacttgcaaggtggacaatgttaactttgaacagtgaacacaaagggtaatgaattactaataccatagttcccttctcaaacagcagtgacagcttaattttgataggatccctatgatctttgtaagcgtattcatgccaggaatgttgtcctcagcaatagatcctatctctatcccttttccaaaagcccggtaaagttagtttgcttaaaactacctgaaaatgtctttctagacatccaccttactgcagggccctagggtcataacctcttaaccttacgggttataggtctcttgctttttgatctttcttggttctttagtttttgcctacttcctccacaacattcaagccttgttatataaggaaattggaaacaccaattttggatgagataagttaccctttcttccagaataatccaaaaagatgattttaaatagaaacatgcttgggaaaaatttagcaaaactacagcatcctgtctaagccagtttgaagttgccccccttcatttcttatcctctttataaaaaacaaaacaaaaccaacttagaacttactgttgacttagtgataaagtttttattcaggtcccaaaggcagcttgcttgagacatcagaaggagtcagagtggtctgagcgaatgagaaggagattaatattaatacaattagttagttagcttattattcttgccttactgggcagtacactgtttgataatagtgacaactaacatcaatttggcacttactattgacaaagcattatttattattttatagccatagcaacttggtaaaggagagattattattcttatttcataataaaggaacctgagcttcagaaagggccctcggcttgccgaaggccgtatggtaaatcaatgaccgagctggtgtggaatgttagcctcctggatcctgatcgttcagcctccgaaacattcctactgaagaggcattaggactagagcgtatttcttttgattatcaatgcgggtggtagtgaggtatcctcagctgtttggctggctctcttattatattagtatctttttactattatcttgcttctgtttcagccaaaatttggattttgtttctttgccacacccataggatcaggtacagttaacctgtttgagcctaataatcaag

SEQ ID NO: 87502 - DNA, 1019 bp, Homo sapiens
tcctcgctctgggaggtttgatacactcttcatcctcctcagctcaccagagtcactcagtctctgagccaaacctgcctttgtttacaacttttccggaaattttcacagagggagagaaactctccctcctctttcagtgttttatttttaagtcaacacttttctcaagtttatttgtgctaaaccaaattctcctacaaggtattgctctgtattcaaatgggaattgctgcatttctataaatagaatgaaggtcatgtgaacgagttcagaagattctagatatcacattttacgggacctttacatttagttcactattttttgaaaataatattctatgtttggatttgtctttttttcccacattcatatttgactgcgcattatgtgaaaaattgaatttgggaaacattgagtggaatattttttaagctgaaatacccatgttaaaaataacaaaatgtgttgttgcttcatcattgtaactttcttaaaaacagaatttatagcccctttattaaatatttctagaatataattgcctctgaaaacacagtaccagggtttttttgttttcgtttttctttaaatctcattcccattaattgctcagtctttaccttggcggagaatgaaaaactgccttggaacttattaataagcatttagaaaaactcgacaaaaaattaaagaattggcctggcatggtggctcatgtctgtaatccaagcactttaggaggctgaggcacgcagatcagttgaggccaggagttcgagaccagcctgggcaacagggcaaaacaccttctcaacaaaaaatatagaaattagcctggcgtggcggcacatacctgtagtcccagctactcaggaggctgaagtggaaggatcacctgagcccagagaggttgaggctgcagtgagccatgattgtgccagagtgagaccttgtctcaaaaaaaattaaagaatgacaggataaaaatttagggaggccgattccatctgca

SEQ ID NO: 87503 - DNA, 1114 bp, Homo sapiens
agaatgaggtattttcatttctgcatacttctaattctacaagaaagatagctgttgagagagctaatatcaaggaaatggcaaacaaacaccttaggtgatcctgtgtgacattcaggaactattgcagacttccaggactcaagacagtctcctcagccataatgtcattgaccttgacatactcagaacaaattggtctgtgtgattgctaccacatgctgtagcgcctcctaaccctgccgttggtctggagtgaagcagagcaggagaaagggctcctcatcagaggatatgcttcttttatgttccttagactcttgcccagcatgcttttcccactctatttagtcttaaaatggctaatttaaagtttctgaagctttgtaggagccgcagagtgtacctagttttgccaggcaaggactgaataggtgaatagtcattgtattcttagggtgtgaaactgtttcgggagcaaaagataaggcaaacacaaccaaaaagacagcccttttgcttagttaggaagataatttatgtccccaaagctctttcagtgatctgtacccatcagaccagtagaatttgaacttttttcccaactgaagagtcaactgagatgagtaataagcacactcctcacttctggttttcttttacgtctgtaggtttttttcatttatatggagaacacaagtcgtagccagtgaaagtttgtataggcccctctgtttcttgcactctagttataggcacttgctaaatgtttcttgagtggatgaatgaataagtgaatcctggacagattgagatgtatggggtgagtcataatcctggcaaaaccctaattaaacacagtggaaccattgccttatgcacagggcaacctcaggcattctgcgttcatcgtgtctgcagtgttctccaaattctgaagcagagatgtctagatgcttgtttagtgcggagggtcactttctttatattttaaaatcagtaaggtcatacttaacttcgtttgtacatattaatatatccataaatgttggtagttcctttgggtactatgagtgactataatattaactaaactgcatttttagattagaaa

SEQ ID NO: 87504 - DNA, 1127 bp, Homo sapiens
aaaaaaaaaggccaccccgaaacaacagctagtgaaaaaaaaaaaaaaatcttgttctgataacgtcttttccctggcttgcttacagtggactgtggagtaggaatgactctagagccgtttcaatttaaaaagatttgtaggcaaacttgctgtcctcttctgttgctgaaaatcgtgattgtcttggttacagtgattattttaataaaatgcaattatctgaataattaatgtatttgactactctactgtgtcctccattcacagaggccaaaatgtcaaagatcaagtagattgggagaataggaaaattctcattataaaggcaaggggaggagggaaaggatgaaatatttggaatttcagtgcagtggtttctatttatccgaaatgtcaagggcagtgtaaaatgtatttttaaaatgtgtttctgtatggtttgtgcccattcttggcgtggctgtggctgtacagagaccattgttctttgaggaatatgagggggtgtctttgtccaaagtgacaaaaagaagacttggaagactgggcttcctttgttcctgtgcggtgctgtaaaatttggtttgaaattaggacctcagggaaggaccttcaatagagagctttcatttcctgccagcattttaatcactctggggtttaaagtggatggccggccagcataatggccctatgtttaatagaacagcttgtatcttgaaggccagttaagggatctgtcatccgcccaatattcgtcttttctgtttcctgtccatttatgaagatcacccacccttttaggtggcttccctggatcattttgtaggggagctgctgccactgcttcttaaagaggctgaacagaaacccagttgaatgtggtccagtcttcagcccacgcagggaagttctgcagagtgctttaattagacacgaagttcaccacatttgggagttgattccatcagttgtagagggactgtgtcagatttcacaaaaaatatagaattggaagaagattaaaatttatccatatctcagaattattggcacctattgacctgatatgtgctcacatcatcactgtggtggatgttaatgtcatcctgtcatgcacagga

SEQ ID NO: 87505 - DNA, 1785 bp, Homo sapiens
ccaaggcagggagaattgtttgaacctgggaggtggaggttgcggtgagctgagatcatgccattgcactccagcctcggccacagagcaagaccctatctcaaaaataaataaataaataaataaataaatattttaggctgggcgcagtggctcatgcctgtaatcccagcactttgcaaggccgaggcaggtggatcacaaggtcaggagatggagatcatcctggctaacatggtgaaaccccgtctctactaaaaataccaaaaaaaaaaaattagctgggcgtggcggcgggcgcctgtagtcccagctactccggaggctgaggcagaagaacagcatgaacctgggaggcggagcttgcagtgagccgagatcgcgccactgcactccagcctgggcgacagagcaagactccatctcaaaaaaaaagaaaaaaagaaaaaaattcaaaaacattttttaatgaactatagggatattttgatggactgttctttggaattaacaggtccacaagccagtggcttttctggaaattactgaaagctaattcttcagaagagtatgttctagctaagggtgtactataaaggtggtaaccagtagctagcaataacaagcttgttgttggtttcactgcagaaaatttaccacttgcatgtacttactgcattggtttaccctcaagaaaaagaaatacagcctctatatacctcttacacccactagatagaactaatcaggatctcttttgatcactggagcagataagcaggaaatataactaaccaagattaatttcacatattatctattattatagtttttcctaatctaccccttgacttaatctaattattttcagttcagggagcttcctgaaaatggaggacaaggatacatttcacctatgtcttatgctttaactctttttagagaggagaacaaatctcttttgaaattcatttgttaaagaaaatatttcagagtcactagcaaaagaaaactactttcttagttgattctttttgctctggatggagaatctagagatctggggttttactcatcactgtcagtaactagctctctgtccttctgacacttcacctctctgttcttcagttttgtattttgtgaagcatctacactagatgattcctgtcctccctctagatttgtagtaattctatgatatattacttgaagaacagaggcaacatttaaatgtaaatttccaaacacctgcattccaacatctccataaagtgcgaaccaagatacattatgccactgactataaaatacagaggaacatactttttaagccacttaagctcaaactaaaattgttagaatttaaagaagtgtggaaggttaacattaacctctcccaatttccatctcttttcacatttacctccttaatttgctaacccctcagttcttgatatccaggctccattaaatgtgaacactaacgtctcttagtgcagtagttctcaaccttgactatatattagaattccttggagaccttttaaaaattccagttgaagttggagcttaggcatcagtatttttcagactccctgagtaattctagtgtacagccagatttgaaaacctttgtcttagtcagatctctgtgcttttcaggatataataggtaaatccacttctctagtatattcaaatatatattttggttggttctcccagtagtagatcgctgatatttcagaacactctgctgaatattttattgaaattttattt

SEQ ID NO: 87506 - DNA, 1006 bp, Homo sapiens
attcaagctgagttttgttatatggaaataagaaaggaaagtcatcccaggcagggagaacagtgctcggaaaacagggtgtacatatggggacgagcaggtggtttggtttgcccatcagacagtgtggcaaggacagcaaaaggagatccagtctgagaaataagactatacagtgtagtcctttgaatactttgcagtgtttcatatacatctggagtcaactggtttgttgggatttgcatcttgcatccaccacttcttacttctgcaacctcgggcacattcctcatcatctctctacttcagtttcttggtccgtgaaaactaacaggtgaaatgaattctaagtatatgtttcatttaatgcagtaaatctaagatatcattatttcaagatttaatcaatataaaaatagactgaagtacttttagcacatttggcttcagcctagccatatttcaagtgctcagtagccacatgttgctagtggctaccatattgaactgcacagatctagaacatttggaacccattcttctgttctcctgtctttggttttatgcacacaaagagagaaacattaggattgaatgcaagccatttcatgttgataggcatagctaccacttacagatgttgctgagatgccagaagttaatccaaatacattttggtctcagttggccacaggagacttgtcagcagttacatagaatgaaagcaatcactgctagcaagtccatccttttggacatacaagtatcgctctgccttttttttttttttttaaagaaataagactcatctctcctttattctttcctgaccatgcctgcctttgtattcctgacagccttgaaaggacacagattatgtggtaaatataataatcaccccttttcacattagacgcagccctttgaattcccagcactgatctaattccaattgcttctgaagtttacctttcacacttgtgttggttttagccggtggatacta

SEQ ID NO: 87507 - DNA, 1132 bp, Homo sapiens
aaaagaaagagaaaaagaaatcaggagagtttaaaagcattccacaaagtcagtggttatatgttaatctgtgtagtgtgctttgtttcccagataatttagaagcaattaattctggatagacgtgtgttgcatgtaatgacagatactgattgtaatgttttattttggccaaaaaaaaggtggggggtggggagtaattttcctcaaaatcattatctggcagggtgggaggttgtttttcttttgtatacagagaaacagagtcccaggtaggaatatgtgttgtattcatggcagttcggcagacccttggaatataaccttcttcatggtccatgttctagtcctgctttgagaaccctcttttgagtaaagaaaatcttcaaaaacccatctctgggtttcatcctgaggatccaggaccggtgttctctttcttaagaggaaaaaaaatcacaatggtagaaaattctttgcaaatcctattgtagtcttgattgatctctcttctcattgctcttcgtcggcctcttcaacccttctgactgtgtgtattagaaataattattatcaccattaaaacaactttctttgtctatttcaattattttctttatgttaactattttctttttagagttgcttatctatttagcaggctactgcattagccttgagctagtattgtaagatgcaaaattatgttgccggcatcagttgggaatttcatggaatttgcttctatttgactatatttccagatggaaccatgtgccgaagtgtttgttttgggcctccatgaagtcattcctttgcagtgatctgtagctagactgcgctctcttgggactaacctgtgtgactaatttgagtaggagggtgataaactttgttaccacttaaaaaggggctaaaaatacttcttttttaaaaaactcctctccatattatctagcaacactctttgagggataatggaaaggaggtgataaagattagagctgattgggaaggttctgaatgcccaagtttcatttaggaagcttcacacctttgagccccagggaagagtttggaccccaggcttttacaggtttgtagtaaaatctgagctgcccagaacactctg

SEQ ID NO: 87508 - DNA, 1989 bp, Homo sapiens
cagtgctctgtaaaatgccccaatcagtgctctgtaaaatgcaccaatcaggatcctaaaagtagccaatcgcaaggaggattgaaaaaagggcattctgataggacagaaacggaacatgggtggggacaaataaaggaataaaagctggccatccccgccagcagcggcaacccactgaggccccctagcaggctgtggaagctggttcttttgctcttcacaataaatcttgtggctgctcactgtttgggtccttgccacctttaagagctgtaacactcacctcgaaggtccgcagcttcattcttgaagtcagcaagaccctgaatccactggcaggaaccagctctggatacagtacgtgggacactgaatactcaaaataattctggaagaaaatagagactcagagaaacgaagtaactttcccaagactgctcagcccataagcagcagagtcacgattgaaatctggactgaccgtagacccccagctcttaactgctttttgtattactctctattccttttaaattggctgactttatgatcataatgcaaaatagattagccatatttttatatggaggcaggaagcttgactctaatggatcacccatattcctgaattggatgatgatggtaaagagaattgctttacaggggtgatttttatgttggagaagatacagttatgatcaccaccctgagttggtttaaatatacgggttataactttgtatgaacaagagttttgtttttgtttttgttttgtgagacagagtttcacttttgtcgcccaggctggagtacagaggcacaatcttggctcactgcaaactccacctcctgggttcaagcgattttcctacctcagcctcctgagtagctgggattacaggcacccgccaccacacctggcagtttttcgggttttttttttttgagatggagtttcgctcttgttgctcaggctggagcgcagtggcatgatcttggctcactgcaacctccgccttccagtttcaagcgattttcctgcctcaacctcctgagtagctgggattacaggcgcctgccaccacacctggctaatttttgtatttttagtagagatggggtttcaccacgttggccaggctggtctcgaactcctgacctcgtgatccacccgcctcagcctcccaaagtgctgggattacagttgtgagccaccacacccaggcacaagagtatttctgcttgaccaattccatcataatgagataatctgccctcatagctatttctgacagtgatttatggtagtgcagagctggctttggcaggtcttatgtctttatggccttgctttttctgagcgacacatttgctaccattggtgtatggctctccatttcccagtttccacggggtgtcttcaccgtattcttatcctctgctgaccctgctgctgtcttgttttctttcctgtcctctttgatatactctgttattgtaagccaggcttgtggcttctgggaggggtgattggcagggtcagtcagacataagcactgaaacgtgtgtcccagaggtggaagccaaatttcctctcagggccctgaggctaacctcctgtgatggcttcatggctagaaatagcaaaaatcgaaatggatattgcagatagtccagacaagcaaacagaagtccaaaatgcttgggtacctaagatttttttaatttgttcgtgtatatttttagcaatagaagcaatatagcatacctttgagccagtttttcctaggtgtgccaggtaggttggcattcacagttctcaggagacaatcaggtactgatttagtgagctcatttttgaaatgcaaaagcaaaaaggaataaaatagcaggttaccatagtatagatagtaggagttgattggcaccaacatctttatttagtttgggttagaacagattctctgcatatcagatttgaagaga

SEQ ID NO: 87509 - DNA, 1035 bp, Homo sapiens
ttgactacagcagatgtttcttcttttgacttggcagtaaaattttattaagcagttttgcaagtagagagcagcatactctacctgatgagtggctggagatcttagcccttttgtgcaatcagcttagttttctcctatctaccatcaggcccccgcctctaggttccttggatctcaccaaccaggcctcaggccttgtaaactgcagtcctcttgggtttgcttccctacccacccatgtaattttcccaaagaaaataatgttagaagagcagccgcacttgtggttacaacttgcggcattgaaaggctgtcacattggaactttgttcctaccagttgtgggtttacaaaaaggagttggggtactttgttgggatgttttgttaggatgcttttctgaatttttccacatctctttggtttggatgttgacttggaaatctcttttgaattagcttcttttggagagctttctgcttttctgagcacttcttggatcctttccccaacaaagccaccaagggaacttcttctgatcctatctcttttgtaggtggtaccctatttgagtccttctgaagactggagcacataaaggcctgattttttcttctgagttggattggatggtttaacataatttgtctctatgttttctgtcttgggtaaaggaatatatttgtgaattgtggctgatactactttaaaaaattccaaaaagaaaatctaaaggaccattcctatgattattgcaacccatttctcaggtctttcaaagaaaacaactcgtaaagatactggcagttgaaggtctaagtcccagcctggcatgaattcccagagagccttgggccttgggaggaggggtaatatacaagattagagtgcaaagtccatctggtgagaatttgtctggtttgtgcttcctcagcagggaggaagtagcagtgacctcagtcctgaatggttatttcagaagtgtatcatggtgggaatttagccagctttgtggcagatgaccaaccctga

SEQ ID NO: 87510 - DNA, 2048 bp, Homo sapiens
atcacagggtcaagagatggagaccagcctggccaacatggtgaaaccccttctctactaaaaatacaaaaattagctgggcgtggtggtgggcgcctgtagtcccagctactcaggaggctgaggtaagagaatcacttgaacctgggaggtggaggttgcagtgagccgagattgcgccactgcactccagcctggtgacagagtgagactccgtctcagaaaaaaaaaaaaggattagaaaatttatactgctttaaatacccagtgagtatagtatatgattgctggaaaagtcgttcatcctgaccaagaacaatacaataacaacaaaaccattacctggaaaaaccaactagaaattcagtgagaacattttagctttttccttttaaatttttaaaattctgacattgcctggttacattgaaacagccctgttgtgtcatcctactttctttttcctggtattttcctctttgggactttggtttcattaatctcaatttgttctgaaggcactaaggcagattttcaaagagctgtaattgtcacagggagagcacaatgacttattgaagtttcacatgttgctctttttggaactaccagagattggaaccaattctccatccacatctctatccgagagttaagttttctcttctctggtgcttgtcaaaagtatttctcccagctaatctcattcccagttgccaaagaaaagatctcaagcataactcctcatctccaggtcacccgacaaggtaagaagagagattaaatgaatgtgcccaagtttctttcccttacagcctccagatctccagaatataccttctttagtttccacatcacactttcctacatttcttcttaatttgatgatgtcttgagagtatctcaggaaactggtatgactaccaaggggacagaggcttttgtagcgcatcaatacccctaagtctatccatccttctccagaaacacagtgggcacatctttgcaccctgtggaatcaatgttagtgctgaaatcagagtagacttggctttgtacttttgtctgggtagttggcttaagtgccgtgtctgtattgagtgacacttctccatcagaattcttattcttttggaagcctagactatttcttcatttgaccacactgtgcagggttttagtgctaaagggttccggatgtagctgctcttgtggagaaccttatcacagctttcttttccctaagttatttgtggtaaagtcctggcagtttgtttagatgttcagtgagtgacacctaattgaagaagtggctggggctggacttcaaggtggatggttttcttaccaagtactatgaagagatttgctcctagactttagagatgggaaatgctgctctcttttcccctgaaaattgagtctcgtcaaactgacaagttattttctgaaactccgagtcataattgtaccatatttattttctgattttttttaacctttcagttaataaatgttttccagcctccatcagcctctactggtaatcaggagaaatgggccaatggctttatgtaactgaggtttctgttttaacatgaaagtactatatttaccttcaaaatgaccctcacttagatcagactacctggggttgtcaagccttccatcttcaagccaagaggtagtttggtttttgtttgtttgtttgtttgtttgtttgtttttcatttatttttatttattttattttatttttattttttgaggcagagtttcactctctcgcccaggctggagtgcagcggtgtgatcaaggctcactgcaacctccgcctctggggttcaagtgattctcctgtctcagcctcctgagtagctgggattacaggcgtgggccaccatacctggctaatttttgtatttttagtagagacagggttttgccatgtttgccaggccggtctcaaactcctggcctcaagtgatccacccacctgggcctcccaaagtgctgggattacaggcgtgagccaccgcgcctggcc

SEQ ID NO: 87511 - DNA, 1001 bp, Homo sapiens
aaataacttgccgaaggtttaaacagctactaaatgccgaagtcaagacttaacttcaaagccctgtttccactttatttacagaaagctcaaaatgcccctgaaactctgaaatcactgtggtatttcacactaacttaccagaaattcccaggacattaattcagggatctgagtttagtgtgtagagcattacccaatatgaaaacagtggagttccacagttttatgagaaaacccagagaaacccatagtacgttagacaaattggaattgaaacgcttaagtaaaaaaatattcattttaaggtcatctgtttatactgacacaaggtctatagaaaatgagagagttggcatcatgtttctgaaatatgcaattttacaatgggaacgtgttataaaatgccctgccactgttgttttccttgggatttagagtgagagacatgaaggctgacaactctcttcctgttgtaggtcagagcttcaaggaactctgtaatcttcccaccagctttattctctcctgaaactcacgggtaaaattagatgctggctggacgtcagtagttgagtttgaaagctttcagaggccaagtcagacaactgcagcagactgctttctcacagtaccagtttgagagacactttgtaccgactaacatagtttagtaaaccgatgagtgtctggcaattttgccgtaaaacgccattaataacaacgcctataggagcagaagaaaatgatctttgtgtggttaatcttggaaacaggatcaggctttatcttccttttaccaatatgctgcctttacctcttgatgttgctctactctagtgtactgttacagttgaaaagcaacaactctagatgaggatttagttggaactattttattatatgcattataattgactctaggaggcagacatggtgaaaagggtgtgggaagaaattatttaaagggtgaatgctctcccaaactatcatcaaacgca

SEQ ID NO: 87512 - DNA, 1379 bp, Homo sapiens
tcctgacctcatgatccgctcccctcggccttccaaagtgctgggattacaggcgtgagccactgcacctggctggaaagttaatttttaaattgccacagtggttggtaaattaaaagatattaagtcatgatgtcaagacttttattttttgaaaagaaaaaactaatttaggccaggtgcggtggctcacgcctgttatcccagcactttgggaagccaaggcgggcggattgcttgagatcaggagttcgagaccagcctggccaacttggtgaaactctgtctctactaaaatacaaaaattagctgggcatggtgatgtgtgcctgtaatcctcctggattacaggcacacatcaccttgaatccagcaggcagaatgagccaagatcgtgccactgcactccagcctgggcgacagagcaagactccgtctccagaaaaaaaaaaaaagaaaagaaaagaagaaaggtggcaagaaggtgaaacatggaattttccagagcaaagccaggaagtactgtgtaagaaaggaccatgtgatctgcaacatgaccgtaggggaagactctgccctcctttgttttattctcctccacgtccgagaacctgtcctatataggtcttcgtgtgtacaaagctcaccgaaaacccatactcacccctccccgagaaaactgggtcacatatctcttgaatatttaatgtaatgtcctacatttggtgcctagagagaaactgttactcacttgtagatgtcactcaggccacagacagactgtcattcactgaagacacagtatccttagtcacatttgatcttggggactctgcatctctgcttcttccacctttgtctgttttgcatttgtcatttattcattcagtattttctattagctaaggattgattgcttgactactcagacttgcaaattaataagacatagactctgtgtttaatgtatattcctcaatctagttgggaaagtagaattttacagtcaatgatagtgtttctgcctgtctatccctctctttttgaatcactaccaccgacccccaccactaccacaattttttcattttcttttgctttctatttgccagattcaaattattttttaaattgtcatataaaagaaaatataacattatcatcttaagtgtccactacagtaatacgtatgtatattatggtacaacagctcactagaatttttcatcatacaaaactgaaactctatacccattaaacaattcccatccccaccagtaattgtctttctgggttttttttgttttttttgttttttgagacacagcctcattctgtcgcccaggctggagtacaatctcggctcctgggttcatgca

SEQ ID NO: 87513 - DNA, 1042 bp, Homo sapiens
tgtggtgatggttgcacaattctgtgaatacactaaaagccattgaattatgtacttttttttttttttttaaagatggagtcttgctttgtcacccaggctggagtacagtggcatgtctgggctcactgcaacctcctcccagattcaagtgagtctcctgcctcagcctcttgagtagctgggattacaggcatgtgccaccatgcctggctaatttttgtatctttagtagagacggggttttactgtgttggccaggctggtcttgaactcctgacctcaagtgatccgcccacctcggcctcccaaagtgttgggattacaggcatgagccaccatacctagcctgaattatatactttaagtgggtgaattgtatgttaggtgaattatatctcaataaatctttttttttttaaggcagcctaggtctgacacacctaatagaacagaagctctcgcttctttcttctctttccatcagtcagtgatgccctttgtgggcaggtttgtgcacagatcaggggttccattccattccttattatttgggttcttcttgaagagcagcttctgcctagcccatggtggctaagagattcacaagccagtttgtattttgcaaactttcccttggggcctcagcagaggatatttttagaacagctgtgggtctaattttgatgtggcccagtgactgtacaccaggcctcatcactgccttgggataagcatatattacattcagtcttaatcccttggaggacacagagttgttcagtccatcctggtgtagaccacaaaccatgtttaaaatagtgggctaagccactgggcctccatggtgaggtggcactggtccctctgcttgagtgaagaaaaaaaaaaaaaactaggcaggtaaccacaagccaagttgggcttggctgctgcaggctgattggatgactgtggcagtaccagctttgctaaatctcctttggctcactttttctccctctccatgtctctacatctttcttttctctcaatcctgctc

SEQ ID NO: 87514 - DNA, 1157 bp, Homo sapiens
tgtttttaaatgaaaaaacaattccccttaagaagtggaaagtactcaatagcaccaaatattaatttttaaatataattcaagaagcctggctgagcacaccaagcttttatgcctgtaatcccagcactttgggaggctgaggtgggaggatcgcattaatgcaagagttcaagacaagtctcggcaatgtgaagaaacccagtctctacacaaagtaataaattagctgggcatggtggtacatgcttagagtagatcctactcgggaggctgaggcaggaggatcgcttgagcccaggagctcaaggctgcggtgagctgtgtgagctgtgtgagctgtgattgcaccactgcactccagcatgggtgacagagtgagactctgtctcaaaagaaaaaaaaacaaagctcttttctttaaaatatttctttgaaactaagcctagaggtactattacctttggatcactattattaatcattccttaatagaactttggatttttccccaggcttaagtacactggttatttctaattctttgtgattttcctggcttcagatctttccaggaacagctctgggtctcttggccaatttggcatcagggctctgggcctttgcccccagcttctgtgattctctcaaaggtctttcagtattgatcagggagtcattcccactgagtccttcaagttttcttttactgcttccccacaaaccgtagaatgagaaaaggatgattgaagtgaagagcctagcctagtgccggcccaagttgggacttgctgaacattggtttccagccctgtggccccagaataccccacagttacacctcagctgtgggttcctctgggactgttccccagaaggagatttttctgccagttttaatttactttttggggaacgaaaaaaactacctgtaatttttcctgtctacttttactagagtttactagaggtttcctcaagttccttgagcataatctcagagaagaatctaacccatgttttctttttcccattgcatttactacagttacaacgataataaatgttgaattaactttcactagcttttaaccaacatgtaagcactcccctttaaactgtgtcttctgtgtttggtgtctacctgtgtaaaatag

SEQ ID NO: 87515 - DNA, 1036 bp, Homo sapiens
tccagctggcgtgtctttgaagttggtcccatcatgttaaatgttaactgtaatttctcttggcccttgctggagagtgctttccttcccgttggtatgataatagccgcagctatattggccatgtgctagctgaccacctcagcaattgctttcactcccggagtgacatagaaggagctttgtactgtgcatcgtgaaacttggggtttgacctggttctgccaggaagccatgtgatcttgagcaagctcattctcttttctgatcctcatttttctgctctgtacaattctgggtaagggctagaggatttctaaagcccttccacttccaaatctgtgattccaagattgggagaatgcacagttactcgcaactcctttttctccctctaccccgggcctacacccctcgctacagtgcttctccacatgctgatcccagtaggtagccagggtcagagaatactaacaatatgtagagagctcaggatcattctgaccctttgaacttgaaatcctcagagagctttctattctaataaaagggcataatcttggtgatatgacaccccctacattaaactccattatattaaggaaaccttagaactcggatgtacaatctagcttgataatttacaattctgctgggattagtatgaggaataattatatctatttattccactgtcagaatgttgactctagaatttcatattgtctctgtcactgaagattataattaaataatatgtcgaatgtattgatcatatttttatacatttgcttgatatgctatagaggctttttttttttcaatatatcacgagattaaattcaaaagtttgccaggccatctaggtctgtttaagagattttttttttcctgaataaaccacaattttttgatggcttgtcattttgacatcaactaaagtaatttatttactccttagtgcagaactgtatctcttttagcctttagtcagactcagtagctatcatgacattagaataagaagtagtatgtg

SEQ ID NO: 87516 - DNA, 1006 bp, Homo sapiens
catgcacagttagcctgggctttaaaaccccgctccctccactgccaaatgagttgctgatgggaattttttgaatgtttgactctgtgtctctgtggaccacaacaggaccacaggctgttacacagttagcatttaacttacattatgaagtgacagaatcgcacttgtgtggctgatagagaccattgcaagtaactaacaaccgtacaaatagcgccctgaccttttcatatctgtggggcctgattctcaacctccatcctgtcctgcacatactcggcgtggcctctccccaccctgccctgaacagttattagggctcacagggcttgcagggtgaccctctgctccagggatatgggcactgcctggagggtggtgagcctttcctgggaagacctgcactggctctccctgagggctttccataccaattcattcttggtcagtggcaggcacatttcacactgaattccaccccatggggctgtgtctaattggacaaatttgaacagcaggcagcacagccactgccgcagggagcattgatatatggcccaagcaagggactaaaatcttaaagtgacagggccccgttttcaaagaataactggctggcttccaggagtaacaggcctgatgatgaccagcaggagagagatgggccaactccacaaagcaggggcttttttagggaggtgtttttgaaatgagtgtctccatttttcctggtcttggtggcaagataaacaggatagggtggtccctggggacagtcatctgggacccagtcatgctgaatgtttctctcactagagactcactgtatctgtatccagattaaatctggctaatatatactgcagggaagcctcggcagagaacagagtgaaaaatcgtgttgtcatacattactaagcacccaccattcatttgtttggcatccatcaaatctctataaatgctaactgtgtgtgctattaaatgcgcactgcccggacac

SEQ ID NO: 87517 - DNA, 1049 bp, Homo sapiens
ggaaaagacattaatcagataatctcacaaattaacataattacaaattgtgtgaagtataatgaaggaaaaattccatgtggtatgagagcatctgaaaagggtatgcagggagagtttccctaaggaggtcccatttaagcttggctctaatgggtgagataaatcagcaaagggagtaagaggggaagaggaaaaagaaatgcttaaggagttgaaagagggcctgggtggctggagctcagcacctaagcgggacaatagcctggggtgactgtggggtcttgctgctcatgtggactttagttttatcctaaatgagaagcatgttttcagcagagggtgagttttgaaaagatcactctgaccttactgtggaagacaggagactgttagagaagtcgagtagaacatgatggaatggattaggctggcccagtagcaaatagaagtggacagtaatgagtgttatttaggaggtagattccacagggctttgttacggagtggacatgggtgggtggagaggaagagatgttaaggatgctccccagttttctggcttacttcactcatttgatgtcattcactaagagctcctagtcacatggaggaggaggcttggatacattacatttccagtggatttgaagatgttaaatctacagtcagatctatgggtcttcagcacagaagaggtgtttggtctaggggtttccttaggaaagaatggggagagaagaatgggaggtgataaaaagatggattggacaccatctctccctttaggcaactcaaaatctatttgtatttgttgttagaggaagaaaagaaaaaagaaataacaaatagtagaaggaaaaatatttttaaaggaaatataaaagggcaataaaatttttaattaaaaaacaaaacaggccgggcgcggtggctcacacctgtaatcccagcactttgggaggccgaggtaggcagatcatgaggtcaagagattgagaccacctggccaacatggtgaaacctcatctctactaaaaatacaaaaa

SEQ ID NO: 87518 - DNA, 1448 bp, Homo sapiens
cacttgatgtgaggccccttggagaagtactggttgaggaagcgtatgcagaggtttgagccaaacaactggatggcaaggcaacagacatcccactgccgttcctctgccacctctgagtgtgatcagatgtctctcctgtcagattccctttccaatattatcctccaggaacttgtgattatcctctgtctaagtcaaaagcagcttaattcctctaaaaacagtgcccgttgggcattttgcctggagagagagaagcaaatctgtgtcagcgttctttgctcagttctgctctgcagcccccatggcgacaccctctctctttggaccacctcctcccctttcgcttccttccacacagtccagtgctttgttaggtacctgcatcccagcaggactggggacctggctggatgtgggcttgggtagagttggccagatgaaatgtggttggcaagaaggtcctgagtgtgctgagacaggcaagagtcagtaataagatcagagagtagaagactagggccaggagcgtgggacaggctaaggatgccggctagcccccaatcccagagagcatgcagctgagtctaagagaggcttcactgatacccataaggaggcggaatatgcaaaccctctttgcttaggagaacctgagttcacctgccaaaatcatcctttgacattaaaaaaaaaaaatccccttgcttttaaagagccaacctcttaccagttgcttctcttttgtcagagacatgggcctcttcaaccaagtctctgggtcttcttgtcaagactaatttccttttaggcccagcttcatcttcacggggactttcttccatctgtgcactgatgttagtgtcccgttgtcatttaagtccttgattctctgagaccactatagagactttaaagaaggtgggtcctaagttttgagggtaccatggagagcaaagtagatgatatctctgcccccatggggcttatattctagaggaggaaacagccagcagtggcagtagtgtgttacatgctgatagggcaggttcagggcacctgacctaacctaggagaggatcagaaaaggcttcccagaagttcgatttaagctgcagttgagggatgagcaaggcgaagatgtaaaggccctggggtgaaaggaaggaggttgttggagggactgagggaggttcatcatggcttaccaaaaggaagggagtgggagagatgagccatgggaagccagcagggcccaggtcattaagtaagggacaaccatggcgaggagttgcaatgtcactccagccccttgtttgccaccatggacaggtattttatgattcctggatcggaaatacacacacacacacacatacacacacacacacgcacacccctcacagaaaaatagccactctgtcccttctcatgcggaggaagca

SEQ ID NO: 87519 - DNA, 1018 bp, Homo sapiens
aggtggggtgtagcgttcagagtctggaaagctgctagaggccagatgatagacagttgtgctaagaagattgggcttaatcctgagggcagatgagtaaaatgttcagattcacattgtagaaaaggtcacccaggtggcactaggaagaatgaattgaagggaagccacattaataggcggaaagaccagtttaaagattgctagaataatcccaatgagaactggtaagagcctaagcccagtggctaaggaaagtaggagacaaattcaagagggcttgggaagtaaaatccacaggacttactggtcagctggatggacgggcgatgtttgggccaatgagaagatggtgttgccacccacctaagtagggatagagaaggaagagcaagggctggagaagttaggtcatgaatttgtttgggagatgttgagttggaggtgcctgtggaacatccaagtgagggtgcttggtcttacgcagatggttttggagcccaggagagacctgagttagaggtgcagttttggaagtcagtagcatataggtagtactgggtatttgtaagcgttagagtagctgaactcacccaagaatagtttacagagaaagaagagaagaggactgagggcaccaaaatttgagttgcagagagaataaagcgaggccttgggagagacttgggagcggtcagagagggaagaggaaaactgaggaagctagggagtagtcagcaatttcccaatgaagtcaacttgctttatagagtctgggttgcccacaagggaccacatcattgtacctaagctgccatgatcatgggaggacagtcacgtgcttcttgcaacctcttgggcagagattcttttttttttttttttgaaacagagtctcactctgtcgccgaggctggagtgcagtggcatgataccggctcactgcaagctccgcctcccaggttaatgccattctcctgcctcagcttcccgagtagctgggactacaggcgcccac

SEQ ID NO: 87520 - DNA, 1063 bp, Homo sapiens
ggccaaggctggcgagggctgaacagatgctctgacatgtcaaggcaggaaatgacagttcccaggcagccctctgtttcaggtgtggaacaggctccgaacacactttgtgtgataaattgtagtaacgccaggctgagctctacctccacccccttaggctgcaagactaggacatgaggctgaaagtcagagaagtccctgtgagacgagggccctgagcaagcactggccagactgtagcaaggccactcaccaggccaccccgctggttctacttccgcacccacctctggcagccatgatgcttctgcagcatgccagtttgttcactgagaccttcacagaaggtcgcacaaccaccctggacggtgagaaactaaggtgactgaggcaagtcattgaaccaccctgagccttggcttcctcatctatgaaatggagttgacagcatctgtcctgcctgtggtaaaaattgctgtgatcccacaaccaaaaggaaagagagaattatgagaaaaatatgtacttattctgtgaaaatatgtgagattttcatgagagacttcctgttccagtggactcttccaccgcccttgagtggggaacatccaggccttcacactcacgctcagcccatcacccctctgtgcaaggtgcaaggtcctctgcccacctgaagcctcaaggcctgatggaaaccatccacagccactctagtaagtgacccctccattgtccaaaacagtgctgctgcttagcctgctcttctcaggccaagtctttgttgaacagcttcagtgcaaggacctgggaagtcgggattctgtaatgtaccttgcccccagtcaggatgggaggccaggcccagatcttcttcccaaggaccctgcacctgaaaatctggtacaggtttgtcctttggagtgagagctcttgggtttaggtggttgagagaggtggaaggttgaccacacactccaaatacacatgtttattgcccaagctgggaacaccatttttaaagcccacatagttaggagactaccaaaataacaaagct

SEQ ID NO: 87521 - DNA, 1047 bp, Homo sapiens
caacctgagcggagtaagcatgaagcaggctgggctggtttcagcccctaccagcttttcctcatgctgcctttggccttgcattcttgcctctgagcgagtccagcaactagggtctgggtggcttcctgcatcccagagcaatcagaagacatccttaaatgatgagggagccctggcccaggcaagtgcatgttcatgtgcgcacacacgcaaacacacacacacaacatgcactcaggaaagccaccaatcatccatctccagtacagctgtaatacagcctgcctcttctttccaaaacccttctttgttctagatagctgtgctgttagtgactgccctagccctgcttttgtgctgacagaggctgccccagcaggcctcttccctcctttcagagggaactttctgttgggtgcagctgactctggctagaggccttttctctcctgcttgcctgagtcctctcaagactctgtcactctgctgtgcactgctccgttcccgttccacatgcctccctgcaaagaaccccagtaaggagaaacttacaacaatggggcaggcgctgatcaggaccagcaagattcagagtcagagcactgaggcagggcttgaaatgtctgacatcatcacacagtcccacttccccgtggctcctccagatctttagatgtttaggtttatggtcaggcgtttccctcatccatccccatgccggtccctccgttccttcactaagacgtgtcatctccacagcactagctgtgtggcctgcccgtggtgctcctgtaataactggcaaatgaacaggatggaaacgataggtgcaagggaggaagagggggagcttggctacatgggtagcatgtcatcatgccactgttctcccagctggacccagagatgagaagcatttaccagggcttgacttcgcttcccctggaagggggcctaagtgaggaatgtggcttacggcacaggcttttgcctgcatctctggggtccctagccagcctcggctcacataaaccggagcccggt

SEQ ID NO: 87522 - DNA, 1036 bp, Homo sapiens
aatagagacgcagagacgatgaattcttactcagcctctggctacttctcagtccttttcttctgtcgtccttaggcgtatttctcaaggccttgtcttggccctggtctcttctctctcagtacctggcaatctctgcttccgtgtctccaattactatccataaactgatgatttccaaataatttccaagttggctttgtctcctgatctccagaaccatctattcagctacctattgacatatccacatgtctacgaactgaattcctctcttcgggccctttccttctctcgagtttccccatcccggtgtccaaagccctttgagaccagccactgccctcgctccagactcatctcttgctgccctgggccagctccagccaagctaaactcccagagggtccccgagcatacgcagtctcttgcccgcgaggcttctgtgcatacttttccttttgcctggaatgctgtctctcaaagccccctcctctctctgttacccccctcaaaataacttgactaattcctgcttagcagacattcctttcaatattgccttttctagaaaaatagaatttttaaagtaaacaaaacattgacttattccaactgttttgtgtctaggtaaagatataacttaataccagtaaaaaagctttttaaataaacacctgtgtacatattaagtacattttctctttcgactttaactctttcaataactgtagctgcaccttgtctttctttttagtgctctcacacatctgatatcaaaagcccaggccttatgcatgggtccagatccgtgtgtaaagtattccttttttttttttttctgagacggagtttcgctctgttgtccaggctggagtgcagtggcatgatctcggctcactgcaacctccgtctctgggttcaagcaattctcctgcctcagcttcccgagtaactgggactcagatacccaccaccatgcctggctaatttttgtattttttagtagagacagggtttcaccgtgttagccagg

SEQ ID NO: 87523 - DNA, 1039 bp, Homo sapiens
acaccgggccaattatcttttagccatccctactctctggtcagtctcattttaaaagcagataattgatttatcagtattcgctacagaaagtagttgaccacatttgactttgcagacatttcagaagatgtggtggtggttagaattttctgcatcccacatatttttaaaatctgcaatttagagagaactttatccagtccagccctaggggtagatagatgcatcctactggcccaactcattgcaaggccatggaaataggaactgacagtgttgccccagaaagctggagaagtgacatttacatgtgttatgtgggcctctcaggtccctttcccaaacctgagattctctgattctaagtgaaaggtgagcctcctttatgggtcctgggttagccacactgttcctgtcctaagcaaacccggaggttgtgtgagctgaagatgctgccttcacagggccatcgtggctcatagccccataggtcacattccctgcttccctaccacacacaaccaccaagctgctttgatctttccagagaatcttctctcctcttcctacagccactctatcaggcaaactggtatttaccccagatacccaggaagggttagtctttcggcctcctgaaagtaggaatcgctctcctctccaggatccccagtgtggccgcccatgagacccagtcttgtcttttaattttttcctccaagccttacctctccaacttcctgggtccccttctcaagatgcacaagggtgattcatctgtgcaagccatagcttctggcttggtctggctctcttgccaaagtctctaggcttctctgggtaatatctctgattgcccagtgctcctaaaattgcacctgtctcagcaaatgctatcacccaagcaacttagccagaacctagggcttttcctctgccttatctaattgggccctggagttttcctccttctacagcatctacaaaagttctctcagtgtcttctcttaatgacctcatcagtggcccaacgtgt

SEQ ID NO: 87524 - DNA, 1088 bp, Homo sapiens
tcccagctacttgggaggctgaggaaggagaatcagtttttgttttttggcttttttttttctttttttgagacagagtttcactcttgttgcccaggctggagtgcaatggcacgacctcagctcactgcaatgtccgcctcccaggttcaagggattctcctgcctcagcctccccagtagctgggattacagtcacccgccaccacacccagctaattttttgcatttttagtagagatggggtttcaccatgttggtcaggctggtctcgaactcctgacctcaggtgatccacccaccttggcctcccaaagtgttgagattacaggcgtgagccaccgcgcctggccaggagaattgtttgaacccagaaggcggaggttgcagtgagctgagattgcaccactgcactccagcctgggtgaaagagcaagaccctgcctccaaaaaaaaaaaggaagaaggaaagaaagaaagaaactctcataaagcctgtaccacaatgattagaaaaattggcataggggaaggtgaatggaaccattaccatgaaagtcataaatgccatgaactgaaagaaaccatgaacagaagatcctccagtgggaagggaagccgggaaaagcagccctccagggaccattctgcctggatttggatatggggaagtcctgggcaggaggccgaggggcagaggcactgaagcctgaaacagggcaccccctctcacagaggactgcaccttggaccctgctgtcccttcagctgtccagagcccttccaggccagaagtggcaaacagtcctgagagacatggaggtcctggagattcttggagagggccaggcaccactctgggccttgtctgttagacggattcctccaccatctctcatacctctcctccttcgtgtacagggagggggcggggagaggggcgcctccttgccgcagtcccagggccccaaggtgagaagtaagaggtggggaagggcctcaccgtgtcctgggctgtagggccgggccaggccaggtacagggaggtccttgtcccaaagactccagaatcgtaaccctcaagcact

SEQ ID NO: 87525 - DNA, 1018 bp, Homo sapiens
gaccgcctgcgagagggaggggcggccgagcgcgcgtcccccgcctgtctgcgggacctggccgatgcgaagtgacaggggccggagctttgttgtggagcctcggccgcctggcgccagccgcccccgcccgcgccctccccctccagccccgggcggcccgcgaggcgccccccggggcctcttaaaggaacacgcacactcggcccccggggctccgccaggggagggggttcctgggaagggggagggggccggcctaggtgggggaggggcccagcggaggcctcacggcgccgctccagggcctcccaggcctccccagcgccagctttcggtgagcctcgggcattcctagctggagagtttggctgggggtcgctacagactcttcagagcggctgcagcaggacctcagggtgatcgcgggaccgcggggcggggcgagtggtgggatcctggcccggacagagccccggaaagccagagggaaggtcggtgccactgtaggtggggtcgccgtccccagatgcagccgctgcactgtcgccgccaggtttctcggtcaaataacccaggcctgagtgtttcaaactcttcaggcctcggacccctggaccagctatggatggactaatgaaatggactaatgtctaaaacgcacacatttagatgtacacatactcttacaaggacaaaagtatgtgtctacacacacacacacacacacacacacacacacgcgcgcgcgcgcgcgcgcgactttgcgaatgtattcacggattcctaggccggtacctgggttcccggctaaggaaagctgccctggttattatctggtcacctcaccggctgcgcaaacgtgtccacaacgggtccctccccgagaggccacatctcgcctaaggtggagccagcaggtatttgcctgtggaaaactgcagtggatcctgccccgtctgcgtagactgcgcagctcggagtcaaagattcgttctggccagagaggaggtactaa

SEQ ID NO: 87526 - DNA, 1045 bp, Homo sapiens
ttgaaaatatcaccaaattcccctccatgggagctgtactgatgtatatatttccaccactgctgtggccttaccaataagggcgggagagcaaacttgtggatttttgtcagtttgacaggtgaaatgtggatatcagtgttagctttaatttgcatttcctttattatgagtaaggttaagcatcttcttttaataaatttcctctcctgcgaactgctgttctcatcctttgctcatttttcttgtaggtttttgatatcaatttctaggaactcttataaattaggaggatgtagctcttatctgtgatgagttacacatgtccaggttatcatttgtcatttggttttgcctgtagtgatattcccacaccgatgcttttgattgaattgaccagtcttttccttatagattttggattttgagttattgaaagccctaacccccctccttacttataagggacttttcttttagtattttatggatttatttttacatttaaaccattgatccttttgaaatttatcctggcattgatttgaggtgtgaatccaattttttttttttttctacagagctatccagttgtcccagcatcactaattgagttgtcccctttcctcccctggttgaggtgccttatttctgaacactaaatccctatatgaatgtgtgcctgttcacacgccagtcttttaactgttgagactggataataggttttagtgtttggcaggactgggcctccttgatcttcttcagagttttcttggctagtcttgtctattttttcacataaattttagaataagcttgtagtgttaaaaaaggagcttatttgtatttttattggattttccttaaattataaatttacttagagaagactgataggaaggcttttctatttgctgagggttttctggttcttcaaaacgtattcaggtttccttgaaatggccctgcacgtttcttgttaggtgtgtcacctgatttgttaccatgataaatgcagcctttctttcactacattttctca

SEQ ID NO: 87527 - DNA, 1044 bp, Homo sapiens
caactaagtctcaaatgcttgttgaattagtgaaaaatgtgaggttcagtgctttttcctgccatacaacattgcccagagagcttttagagcttcaaaacatgctttcctggaatatcataaaaatcatgtatttatagtattgatatataatactgtacttttagaattttattaatttttttaaatggagagcccagctatcattttactgattttcagggaataatgtcaataattaataatttgttacaaaggaacttaccctttaaaaccaatcaataagtaaaattttttaaattaaaaaaataaagaccaagcaaatgttttatgttatttaataaaactcataatgtatattgattgacagaaaaggtgcttatactctgaggcactcttcttgtaagggatacagaagatctaaagtaagcagaaaccaatggattccttttaatgttaatttttttaagcacacatgggactgttagagtatttgaagtaatataagtctatgaaatacaagaacagcctttggaaacatacaagatggttttgcaaccaggttacaactgcactatgagttttctaactagtctttgttgctttactgaaagtataatctttgtctcaagccggcataattcatttaagcaaggcagtttgaaaacaatggtaaaaagaaaaggtgaaatcttttttctttgaattgtttcattaacagaaatacctttctaccataccatagaatgctttaaacataaatcaaactggaaccaaaatacagtggcacactgactttccattgactttcaatactcttctgtagtattgacaatattaatcttcttcctatccttcccagtgttatggtctgttgccttggagcctataggttactttaaaataatatcaaaaaataatgccctataaaatttagattttttttgtctttgtagaaaaattgaacatttatgttactcttcaccccctcaaaatcctatgataataaagaaatgaaaatgtcaaacctacaatattacaaag

SEQ ID NO: 87528 - DNA, 1353 bp, Homo sapiens
gggaccactatcatatatgcacttcacactgactgaaacatcattatgtggtgcattactatcccttaatttcatattgtagggcatcaacatctaatttgtaaatgctataattaggttttgtgcaaattaaatttttttttttttttttgagatgaagtctcgctctgtagccaggctggagtgcagtggcacaatctcagctcactgcaacctctgcctcctgcgttcaagcaattctcctgcctcagcctcccaagtagctggcactacaggctcgcaccaccacgcctggctaatttttgtattcttagtagagatggggtttcaccatgttggccaggatggtctcgatttcttgaccttgtgatccgcctgccttggcctcccaaagtgctggaattacaggcgtgagccaccacattcggcccacaaattaatattttatattctctatgaaattttaattaacttcaccatgtaattatttatttcctagtgaagctgtaaggcatttggataattcatagaaacaggttgggccaggtgaggtggctcatgcctgtaatcccagccctttggtaggtggaggcgggtggatcacctgaggtcaggagtttgagatcagcctggtcaacgtggtgaaaccccgtctctactaaaaatacaaaaattagctgggcatggtggtgtgtgtctgtagtcccagctactggggaggctgaggcaggagaattgcttgaacctggtaggtggaggttgcgttgagctaagattgcgccactgcactccagcctgggcaacagagggagactccatctaaaaaaaagaaattggttaagagtaaaatcatgaaaacatgatcagttgacatatttgcacttcaaccagaagtcccacaactaatcataatcttaaccagtcaaataaaaaatttttatttttctggtgtcttgtgtatttacattagcccatttgtaaaccagatggcatgtgggttcagatttgtgtatcgcttagacatagctatatgtatatatatacaaatacataagctatgtgtatttgtgtatagcttagacataagactacaacaactagatttaagccctagaacatgtcacccactgtactccccatcattttattttttatttttgtttttattattattattattttttttttgagagagtcttgctctgtttcccaggctggagagcagtggtgcgatctcagttcactgcaacctctacctcccaggttcaagcgattctcctacctcaacctcctgagtagctgggattacaggcacatgccaccacgcctggctaatttttgtatttttagtag

SEQ ID NO: 87529 - DNA, 1046 bp, Homo sapiens
atccttttgattatttcatattgtctattgctgctataagtgctctgctacttatactgtttccaataaaaccaaggcatggagaacttaagaaactttctgttcaatctcaagtacattatgatataatggtaaaaatcagaatccaaaatcatataacttctgcttgaatgccatctgtctattgggtatttttacccaattctaaaccgcctcagtcttaattatcaatgcctttgatattgaggatcttatttctacttatgtcagttaggttagattttgatgcagatatatatttatttgtctaaaaactatcatagtaagggagctttacatttggtacaaacttgaccttcaattatgaaatgataaatttttgtgaatctatgcagcatctgaaccaatgggttgcaaactcaagcagctacatgaattaaacaggttatttaaatgagtgggttagttgaggacagtggtgagatagccaaagttttagatggtagcaaataaattttaattattttaagccacagtaagggccacacaaaacacaactatgggccttcagtttgcaactgttaataaaatagtttgtctttttcctgctcttcacacccctccaaaattacacatacactaatttattggggatgggaagcaagtagtttaactgtttccaaaaagtacaattaagtatagctttctattttgggaaaggcttgtaaaatgtatttgaaaagtaatgttaactgatctaaaagatcatcttcccaaaccacacttgagctcagtttatggtgcttactttctgtcaaaacttagaaaaaacattcacagttaacttccataatgtaaaatgtctgtctcattaggcattaaggaagcattggtcaacaggtataatgttgttagattataaggtaatgtgaatgtgggcatgacctcccaaatagatcaaagactaatctctttgacagttacaagatggcagagcttgccttgggccttttgctggtggtgcacattgaaactatttgtttgga

SEQ ID NO: 87530 - DNA, 1003 bp, Homo sapiens
atggaggagccagagagatgagatttgaatcttctctacagtgagattcaaatatacaaacatttcataaagtggaatggcctcatcagaggttagattacaacaaaactattcagattataaaactattcagaataggccgggtgcagtggctcacacctgtaattccatcacttggaggccgaggtgggtggatcacttgaggtcaggagttggagaacaacctggccaacataatgaaactctctctctctactaaaaatacacaaattagctgggtgtgatggcacaatcccagctatttgggaggctgagacactagacactagagttgcttgaacttgggagggggaggttgcagtgagccgagattgctccactgcactccagcctgggtgacagagactctgtctcaaaaaaaaaaaaaaaaaaaaaagaaagaaagaaagaaagaaaagaaaaaaagcaactattcagaataataaagcaaccttttttttttttaatatctggctagagcaccaagtattataatagactcaggggacagagtgatacacaacacagtttatagccccttgtctcatgttgcttatagtctagcaaggaatattgacattaatgtaatgaagaaacaatcacagttgtgataaaggctataagaaaaagtcacaggaaccctgggaatgttatagcaggtctttggggatcaagaaaggcttcctgaggaagtgatatttaacctgacactggaaagaaaactaggagttatgaatgtgtacagaatggataagagtattctcaacagagagaacagcatgtgttaaggttctaaggttgaaagaggatagcagtttccaagaactgaaagaagctgaagttgtgagtctgagagaatggcatgtgaatagaagctgggagaggtatttaggagccaaatcacttaggactctgtatgccattttcaggatttgggacattctaagttatgggaaaccagatc

SEQ ID NO: 87531 - DNA, 1056 bp, Homo sapiens
tgtgttgggaaaccaaaaaattcatgtgacttactttgttatgatattctccttattggggtggtctggaaccaaacttgcaatgtctctcagggatgcctgtatatgttttcctgtatccttagacatttttaaatctttggtgaatctgaatgagtgagaaaaatttagtagatacagattttattttattttcaacttatactgtctttggtcaacaggagttattttcaaagtctggtcctgggccaggtgcattcgtatcacctgggaacttaatagaaataaagactttcaggctcatccagacctgccaaatcagaaactgtggaagtgaagcccagcaatttgtgttttatcagtcttttaaccacagactcatgggttcctccggggaatcctggggtcttttgtccatctggctcgcttctttccagtgtcctgccttgcagatcttgtgatttagtcactccatattctgatctcttccacctcagctcaacaggaccactgcgctctgcttgtactttaatgctctgtgctgtggtcaggaaattatacccaagcagagaactgggataatggagttcacctaatgaattccacttagctccagaattactgtcttgtgctgtttggtgtctactacctgaaaacaattgctccattttgcccggttatgcgattacttacaatggaagaaatattcttaaaccagttactcaatcttggccagaaacagttgtatctcattatcactgactgtttcctaaacaatatatttgaaaaactatagtaataatttgagcctaagttgaacttattgttcatcaaggaggattttcttttacttcctacaggcatttgaaagtgctggcaatctgagaaaatttgagattttctgaccactgagctgacttattgattatgacctatatccctccccctaggatacagtcagttagggtctcataccaaagcaggagttctttcattagaatagttatctttttaattgttaatactttactaggtactgtgaattagataattttt

SEQ ID NO: 87532 - DNA, 1044 bp, Homo sapiens
caccgcgtctggcttttattgttttcttttcacatgatttcaggaaagtagaatttcatgtgtaaatatgttagttgttttacaaatgtcattttttgaagttttttgcattgtaaatatcattgtatatttttatcagaatgtatcaagaagtaactgtaaatcaggtgtcactagtgcattactgcactagtagtgcagctctgacattttcagagtcctcagtattttaactaatttatgagagagagtgttccttttcagagagggctgtaggatcttcatttccagttagattgccaacagaggtcttactttcactttagggcagtatttgtctatattattcctccaagtgcacctccaactgcacctgtgttcattgaaagtttgattctgaaatataacccagcctcttgaggtgaaagtgctgagtcaaatatcaccaaacaggaagctgtttcaatagaaattcatattcttggttttcttatattttcagtttgtatttagcaaaaattaaggacattcatttttactgtaactaaaaaagttatttaaaaaacactactactttttcatttttattagtatttaaaaggaactcttttttatttctaacatatgccacatatgggtacatatcaactgaataaaagaaagtaaacatttaaaacatatgagtacctcatgaaatgaataatgaagaatcatctttagatggaaaaatataccaggttctacttatgaaataaattatgtgagtaagattacaaaagatggtagtctgtttaggcaggcctattaaaagcattaagacttgagtactggctattaaagtgagtaaatggcaatattataaagttaaacacatgccaaaaaacattttccagaggactgggattgtaacaataccactaatgagggcaaagaggtcttaatgcaatttgcactttctaaagtttcaaaaagaggctttgagttagtgtattattaatgtactgaacatctggaactgtgtaaaagctatggacattgagcaaa

SEQ ID NO: 87533 - DNA, 1049 bp, Homo sapiens
ctttttgctagagtgtaattcatttacattcaaggtaggtattgaaaggtaaagagttattactgccatttatttatttatttatttatttatttatttatttatgacagggtcttgctctgtcacccaggtcagagtgcaggggtgtgatcataggtcactataaccttgaactcctgggttgaagggatcaacctcagcctcctgagtagctggtactacaggcatgtgccaccacacccagatacattttttaaaaacttttttttttttagagatagggtcttgctgttttgcccacactggtcttaaactcctggcttcaagcaatcctttggcctcaagcaatccttctgcctcagcctcctaaagtgctggaattacaggcatgagtgaccacgcccacccagcattgtgaattattttctagttgttgtgtaggtactttgtttctttatttctcttgctgtcttcctttgtgatttgatggtttcctgtagtggtatgccttgaggcctttctatgtttgttatgcactgcactgtaatttaaatatttttcttttggatcttattcactagattgtgaagcgatgctttctccaaaaaatttctttcaagttttagagcaacaaatttacagcagattcagatggcaatacttgaaagtagtaacttttaggtaacattatagtggttgcttcttattcatctgcttccctcagcctgaattctaatagtgcaagagcactgacttcattatagtttaattattagcccatttacagaagtatagaaaacgagttgcctttttcgcctacagttaatctattcaggaaaagaatgaaacatatagttgaatttgtgtgaataagtttatacattcagattttagccaacattattaactcagtcaacagttcttcatttttaaaaagcaaaacaagtcagattatatacattttaactaaatgattactttagacattgatgaattaactgttgatgaaacaacagtaattcagaatttatgtttcaaagagttaagaa

SEQ ID NO: 87534 - DNA, 2042 bp, Homo sapiens
atcttctacaatttctctcatcaacattttatagatttcagcgtacaagcctttcttcaccttggttaaatttctttctttctttctctctctttttggtagctattgtaaaaggagttctcttaatttcttttttggatagtctgttattagtatatagaaatgctactgattttttgtgtgttgattttgtatcctgcaagtttactgtatttattcatttattagttctaacagttttttgttgtagtctttaggggtttctatatataagattatgtcttcagcaaacaggggcagtttcacttttttcttttctatttggatgctttttatttctttctctttctaaatttttctggcaaggacttcagtactgtgttaagtggacatagtgaaagtgggcatccttgtcttgttccagatcttagaggtaaggctttcaattttttcaccattgaatataatgttaagtgtggtcttatcatatttggcctttattggccaaatatgcagtacatttcttctatacctaatttagtaaaagtttttctcaggaaaggatgttgaattttgtcaaatgatttttctacatctaatgagatgatcatatggtttttgtccttcattctattaatgtgctgtatacatttattgatttacatatgttgaactatctttccatccagtgataaatcccatttgatcatgttgaattgttcttttaatgtgttgttgaatttggtttgctagtattttgttgaggatttttgcttttctatttatcaaggatattggcctacagttttcttttcttgtattgtccttatctggccttggtatcagggtgataatgctggtcatgtaaaaagaatttagaagtatatcctccttttcaacttctttgaaagcatttgagaatgattggtattagttctttaactgttaggtagaattcagcagtgagccaacaggtcttgggcttttctttgattggaaagaactcattattggtctgtttaaattttctatttctttatgatgcagtcttggtaggttgtatgtgtctaggaatttatccatttcttccaggtatccagtttattttgttggcatataattgtaatagtcactttgatcctttgtatttctgtggtatcagttataatatctcctcatttgtttctcattttatttgaatattctctttttttcttgttaatctagctaaaggtttgttgatttcatttatcttttcaaaaaccaattcatagttttgttgatctttgtgttgttttcctagtctctactttatttatttattctctgatctttattacttctttccttctgttaattttgggcttagttcttctttttctagatccttgaggagtaatgttatttatttgggatcttcttttttgatgtaggcatttgttattgtaaactttcctcttaggactacgtttgctgcatcccttaagttttggtatgttgtgtttccatttttgtttgtctcaatatattttttttaaatttcccttttaatttcttcattgcccccttggttgtttggttgttcaggaacatgttgtttaatttccatatatttgtgaattttcccaaattttcctgttactcatttctagttttataccattgtggccagcaaagatacttgatatgataacaaacttaaatttgttaaaacttgtttcatggcctaatatataatctatcctggagactattttatggtatttgagaagaatgtgtattctgttgctcttgaatgggatattctgtacaggaataccttattttattgtgctttgctttatcgcactttgcaaatattctgggttttttttttttcataaattaaaggtttgtggcaaccctgtgtcaagcaagtctattgtcaccatttttccaatactatgtactcacttcatgtctctgtgtcagcatttttttagcaataaagtattttaaaattaaggtatgtatttttttagacataatgccacttgtacaca

SEQ ID NO: 87535 - DNA, 1025 bp, Homo sapiens
tttttagagacatgcaattgttaacagcataagacaaaaagtgaataatttggcatagtcaattgttattcctgtcttcagatctgactgcacaattcatctcagctttctatttctttaagatccaaattaataggcattatgtttactaccccttctatcctacctcttatttggttatctcttaactagatctcttccttctgagacactgtgcatatcaatgccaggtcagttttccaaatattgcttttattacatccttttatctgcctaaaaatctattgcttcctttgctcatgagataaagttcatatttcttaagcttacactcaagatgctcaatagtctgacctggatctgcccaatttgaatccttcaaaaattacctcatactcccttgaggataccttgttctttactctatctttgcttttgatgacacctctttggaatgccctgtccactctttgtctgtccaaatccaaatcctacttatcttttaaaccccaatatatttcctactcttccatggttttttctcaacttttcagctgtctgtgtattcttacttcctcaaaataactcattgacaattgctttgtgacagttccttgtattagtcagtactctttctattgcaagtgacacaaacctaccctaaaaaatgcttaagaaaaaatacttgattctctttattgtgatggctttattctcaggcaagttctcactcttgcttatggaacaaagataaccataagcagctagctcacctggagaaaagagcatggccacatattagtccctccaaattactctggttggcctaccgtggatcacatgtctgttcctgaacctgaaccagtcactgtgaccacagaaggatggaatactctatttaactgacaatcctgggccttacccccattgtgaaagtggtgatgtcctttgattcacaggttaatagtcctgccagcatcacatgggagttggagaagaacaattctccaactcccatgttggag

SEQ ID NO: 87536 - DNA, 1702 bp, Homo sapiens
taaagctttaagtggaattgatgttgaaaagtgtaacatcaaaaagtaagttttcccagccttgagaaaaagctactttattggattacttttatgcttagatagaatgtatctatatagtacataacagtgcattgggccatagcattctagtattcacatgaatttaactgtatcataaggaagagaaatagtataattgagggaaaaaattgatggtatgaaaaagtaaattaattctaattgagttaccttaattctttttgtatgttaattgattaatgtgatcattgcaaaagccaaaaagaattcagtcagaaatatcatgatataatttgcattccattttctctgtgaccgtaaattgttggatattgcaacatatgtaacataaaccacatgtcagctgtttcctgcctcactgttgacaagagccccattcataactcttctttttatccttttagtgaataagtaattattcaatatagaaggcaggatatttggaactggctatttaatgtggcagcactctgtaatgaaatctgctgttactggcaacctgagaggagaatgtaacaattccagcatggctgtaactttatctgctttgactgactgtttatttggcacatcagtgaaccttttatcccagtgagtgacagctccagaagggtcacatttacatccattctatcatgtattgtaatatttaatggcggacaaggttgagtgagactgggagtaatttgaacttgcttttccactgagttgaggctaaaagacagcttcatccccagtattgtggtgtaacatgctatgacttagcatttgtttatgaaggctaatcttactgattacaataataaaaaaaaacagtcaagtagagtgtttgttctactaaattaaaactctttagcacacagtcttttaagttacaatgctatttaccttttttccctccccatcaatgaccacttctataaattaaccattttacactatttctctaaaatgagactttgttctgtgtcatttggtgtaataattgagacttagaaggaagtagttattaagaacctgtgagttctaatatatagcattaaacttttttttttagtatttgagaatttggaaacagaagagaaaaatcaggtaaattaagtagactatattcctgatgttccatatggtttgtttaaagagacatttatataactatttcagttatgaaactgagttacaagtgaaattgtccaggaaaaactaccctggatgataattttactgattggtttacactccatgacaggtaactgaatttcagatatacttgttccacacaagcaacctgctttcattattaaatattaatattttgcatttattttcgtacctttgctaaagaagaattttctctttttgaagttgttaagtgatcctttagattcaacttgataattctattcttttgtaaactatatttaaaagtgcttcaaaagcattggtgtattaaggaatatttgaatgaactatgctgtgaacaaaactattaactctaaactataatatcacaagttcgtatgaagcctaagaaaaaattaaaattgttcctactttgttttatcatttttataatttatgaaagaggagagttaaaatgtactcaaaacatttggaattggagagttagagtggtatg

SEQ ID NO: 87537 - DNA, 1025 bp, Homo sapiens
tctttgtcagtaagatgaggtgatccttgtcattgtcttctccgtggcttgatatatagggattccaatgtctcttgagtcaatgaatgaatgaaatgggatattagatgaaaaatgtttagcacaaggacaggcttaaaaatggcagtattattactaatgaaaatattgggatatatgtttgtcacgactaaaatactagcataagatggtttttctttttggccttgaaaaatagtaattgtcctgtactttttcctttaaaagctaatctggattttgaagtatctttttgatatgtgcagcacttcaaattaggacatcatttaagcatctgtcagatttaattgtaatgcatgggtacagtatttggttcagggacatttagtcataattcatcagtttaaaaaaagctaagttacagttatgtgcaaaacaccactctcgatgaatgagctatataaagaaatgtaagacatagtttctgtcttcaaggaatttgcagtgtggttggaaagacaatacatgcacatgtggaaagttatggaagaacacaagtttttgtattttttttttttactgtttcattgacctagttttccttttatttcactcaaacaggtttctcttcattctctttttctctctacttctttatatacttagttttcgtactcctgcctgcttttgaaattcaatttgtagtctcctttgagaatctctcctgatttacagttagcaaaggaacttcttctttggcaatgaaattagttcctatttctttatcattttccatttctaaaaatatttaattgctatgctcatttttcaggtatttaggcatagtatttttttgtgtgagtggtagggaaagtttggagaaagttataaatctttagaagttgacattgtggtatgttaccgtttgaacttataattatagcttgtgaaaggaacagtggcaaggactcagcaattcatctttctttcaagatcaaatcttcgaactcttcatctttgaaaga

SEQ ID NO: 87538 - DNA, 1052 bp, Homo sapiens
aaaaaaaaaaaaaaaaaaaaaagagtaataacattttttgaaaaacctttaacattataaaaaccaatacagaataaaaattaaaatgttctcccttatgttaaccccatctccctttctgctttccagaaggaaacaccatgaacactttcatgaggatctttctagatccgtttctataaatttataaggatatttttaatagttcttttacagttttgtttgtgcatttaactctcttgtttatgggatttattttcatgcatgtatgaggtcaggctctaattgcatattttcccaaatagttgatcagttgtcccagtgtcacttaatcatttttccagttttgaagttttgctgttatcatgtactaaattgttatatgtacttggattggttcctggacttttttttctctttaattttttttttttaacagtatgtgtgaaaaaatatgtcaaagaattccacttggcttcaaacagaaaagcagtagacccctgccctaattctattattcaccaattcccactatctgaagtaaataattttcaattatttatcctttgtattctgatagtttttgaagtagcatgcatattttgcttttctcttgagttttcggttttagatactttctgttgtcttcctcctattcttttctcctttctcattacttctacccttcagcctgccagcatttggtatttgtattgttataattctataaatatttaaacttattacagttctttccccaaaccagtatttattttttttggtgctagtagttgtcttgtcctttgcttagtttcctatgtacctgtaactatttatctccaaactctctgttagaaagtaaaatctatcagttcatttaaatacatcaggtcaagatgtccatatttttagactttcaatatttagtggaaataatgaaaaatactcttttatattgaattaaattttatatttctaaataacttttttctgaatataaaagcatcatctaagagaaaatttgggaaccaccaaaatgtgtacttaaatta

SEQ ID NO: 87539 - DNA, 1010 bp, Homo sapiens
gaaatcatgactgtttacattaaaagttttattctgagttcttttcaatgtagaattatgcttaaattttgatttacttttattttccaattagatataagattggactttccaatattgctatatttgatgtccatatgatgggactattttatgagaagttcattttacaatactctaattttgatacatcactaattaaagatagtttggctaagattcatgagtcactactatgttctatttcctttaagtgttgtaatgaggtgcttatttgcatttttaaaatttcttttattattgcctgttagaaatagtctttttttggatgcaggaaaaaaatacatagagctgttttggcctttgagaacaactagccagttaaacttctagttcaccttaaacttcattttggttctgtgtttacagattagaaaacgtcattgctttggaacagaagtacacaatttggatgcaaaagttgattcaggaaagactgtaaaactcaactctccactggaaaagataaactccttttcgccacagaaagtatgtattaatgccattgttcagttttaaagaaggaagatatggaattttctaaaccaatttttgacaaaagaggaacaatagtataatacaaaggacagtagcaacccactcagaagtcctcaatgctgtcacatctctgttactaatgtgtgagatggcaaagcctattctctctatgcctcgtttccttatttataaaataagagaattggactagagagagatctgaaagtcatttttttctgttctgtattttaatgtttgtaaattctccaactccttacagttctttcaggattcttagggcaacagttctcaaggagtagtccaaggagttctagatattgagatttttttggggagtgatctgtgaggtgaaaattatttttgtaataatattaagatgttgtaggccaggcgtggtggctcacgcctgtaatcccagcactttgggaggc

SEQ ID NO: 87540 - DNA, 1032 bp, Homo sapiens
gcagtcactgtggcttagagaaggtaactaactttcccgaagtcacacaactaatacctggcagagtgaaggatacaaatctagatttgttagactctaagacatgctcttgaccgctgtgatttataagactaggaaattattttgtttccatttgttttgtttatacttttattaattccagtttctgtttccagatttctcccttagttttggttctctggttttctttgtaaggcgtgtctcaatatttgacattttcatttctgttgtagttaggaatctgaaataaacaggaaagcactatgtcttcaatgtggtctgaatatacaattggtggggtgaagatttactttccttataaagcttacccgtcacagcttgctatgatgaattctgtaagtatttttcagcagttaagtttttattaagatatagatacttatgacccataaagtacattgagtatttgactgcattcatattctcagtaaatggagaatattttctgggttcacttggaagaatatctaacctctgggaaactactgattgcagctaaactgtatatatctgtggttaaggcaaagaagaacattctgaaaaatgttctcagctcatttggaatttctatacttttaatgaaaaactgctatacttttaagtaaaaacagagtatttactatcttttacacagaatactatttttctcaccattgttttgtttggatcatgtagaaaattaatatacaaatttgagtaaaccagctttccagttttgttacagctattttgccatatgtacttcatatcttatttactggtaacaagattattagtatcctgaatttgttcttttcctttcctagccatgtttttatacttttattacatatatatgtatccataaacaatatagaatattattttacatatttgaaactgtgcattgatgtgatacggtaccttactttttatgcagaacttgagttttttaacttagcattatttttaatgtatagccctgttgat

SEQ ID NO: 87541 - DNA, 1083 bp, Homo sapiens
atattaacatttactaatatatttacacattttatttacatcatcaacaaatctgatgaaaaagagcatatgtgattattttaacacagcaggttatgaccagtctttgaatattgatccaggaatgtgcactgcatttaattagaaaacatacttttaactttttctgaactcctagggcatatctattcacacaaaatatcgcaaggcctcagtttaaaaaaaaaaggagcagttgtatttaatcttaagggactacaaaactgccttgtttaaaaatatgaaaattcttatgctatttttaagatacttttattacttttatttttcacatcaaaattacttaattgaacattaagcatctaataaaaagttataaatattctatcacatgtgatactatgcacttcatgatttgaaacagctacaaactcattctcatagaatatgaggtagggccagtagtaaccccattttacaaaggaagaaaatgagatgtgactatttactagtgaaaaggctaaagttaaatttcatttctcaaaaactacaccttcttattagcctaatttcttttacaagtgaagcggtctggccaggtgcggtggctcacacctgtaatcccagcactttgggaggccaaggtgggcagatcacctgaggccaggagttcaaaaccagtctgggcaacatggcaaacccccgtctttactaaaaatacaaaaatacaggtggcgcgtgcctgcagtcccagctactcaggaggttgaggcacgagaatcccttgaacccaggtggcagaagttgcagtgagccaagatcatcccactgcactccagcctgggcaacaggggaagactccacctcaggaaaaaaaaaaaaaaaacacaagtgaagaggtctgtttcaagtgggggtggggaagtgtgtgattgaggtatatctcagagagaaaaaagggaattactttctacattgataatttttttttaatgattagggtttacctgaatatgtctgcctaatcaatggaagttactgacagaggactgcaaaatccttcggcaagacaatattttctac

SEQ ID NO: 87542 - DNA, 1536 bp, Homo sapiens
cacgtaagtggtaacttattttcaagggttatcttaatatctcaaacaaaaaggccaaattcctttccaaatttcttggccttaatgttttttttcccttatgttgtaggtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctca

SEQ ID NO: 87543 - DNA, 1047 bp, Homo sapiens
taggacaattgatctctctctccagtcttactagttatacaaaacattttataatttttaatacctaaagatattcttgagaaacatgtaataactggattttgtattgcagatatttgctatccagttgctttctcacttgtgtatacaatatgcattaccaaagtcacttagtgtggctcgtttagctgtcaatgtcatgggaactttgttaacaggtatgtagccaatcaacatcaacaaacatctgacataaattattatagttcctatattttctgcatttagtgatgcaatatgttttttctgtcactctgagacagtatgatacaatatgtgttaaatactagtttaacttatgccgtcttttgaattcttcttttggaaacttctgtttacaaatgtgatttatagtgtagtgggaatgaataggtaggcaaattgtatttttcattttgtgaatgagtatatatagatttgtaaatataagctttctgtattttataaatggaaaacaaatacactttcagaatgtaattgtatcagtagataacaaatgttcatttattacaaatgctcagagttccagaaaaatatcatcatatgtataaatgaaagataaatgtattagatgtcttcataagttctaaaacatattctgatattttaaccaccttctggtttgtagaataaaatggtctgaaaataaactactttaaaatatatgaactataatgcaacccttaatgtaatggcatagttaacttagtattctttctcattataatatttccataataccctgttgtttttcttttcatcgtatttatatcctgttataattatttgtagtgattaagagtttacactgcctgaattcaatctcagccccaccactaactggcttgtgatctttaacaagtttcttaacctctctaacctttttttaagagttttctcatatataaaatgagtgtcataatagtactttggtcattcataagattgtaggaattcaatgaaataatgcatgtaatgtacttattg

SEQ ID NO: 87544 - DNA, 1041 bp, Homo sapiens
ggagactttatgatgataaatccagaatagtgacttatatttatggaactagatacagaatgttttggcaagtcttatttcatttacaggtattatgtcatttctattttacagacgaggaaacagtttagagagcctcagtgacttacacagagtcatatagcaagtatggtataactaaggttttaactcaggttttaattttatatgccatgattattccattacaactgtgaacgtttctgaaactactttgtgtttactgttttatctctgtgttttttaaagagatattttaataggttagatgtctgtagcttaaattttttcaaagttcattcatatgtattttctaattatttactgaatataactttctaagatagaaaggactggatggctacagattttaatatataaaaaactgttttgaacatgtgattattttcttatcaggctatgggtaatgacggttaatgcacttcagccttcaataaagtttgtacgacaacaaaagtatactcagaatgacctgatgatagatcctctcattgtcctaaggtgtgatcagagggttcacaggtacatgtcatttgagtttcatttttattatagagctgtactttggagagtcaaaagaaattgatgaaattcagtttaaacttatattttaatttttcttgcagataagtaggcagtgtgacctgtgcggttttttgtcttatttttttagttgtgtttattcatgaaatgtatattcattttaatatttagtatgtgattaataaaacctagctttagagaaatgccattcttggttttggtgccacaaatagtggtttttctctctcacaatttagaccagtaaagaataactatttctgttctcacattaaaaaggtttttaaaaaactggtttcttgtgaaccgttacctgcgttaaaactgtgatctttttggcatgcacaatagtgatgttagcttcattgattccacatttggctctaaatccttaccaattgctaaacttcagcattgctt

SEQ ID NO: 87545 - DNA, 1056 bp, Homo sapiens
caagcgatcgtcctgcctcagcccaccaagtagctgggaatacaggcatgcatgcaccaccatgccctgctaatttttgtattttttgtagagacggggtttcaccatgttgcccaagctggtcttgaactcctgagctcaggtgatccgtccacctcggcctcccaaagtgctaagattacaggtgtgggccagtgcacccagccaaaaaaatgttaatgatacattatctgatgtgttatgattaagtgtgaagtaaatttcccctcaataatgaagcttggggatgaattagttattggttattgataccaatttaaaaaactgagcaaatagaaaaaaggtattaactaacccaacatatatgttgagtaagggggagggcacttgcataagaatgaaattgtaattaaaggattatcacatagctcaattatgaaaccacttctgtagtcataataatatgcatttgaaatattgctttaacaaaaattttaatatacctgtgttgtgagaaacaggaaaaggggcaatgtgtattagaagaagtgggactcacaggagtggaagcaagtaagagagctaactaaccttcaccttgtagagtagaaagtcaacagataatttctaaattggaaaatcaggaaattacagtcattataagagatatatggggaggatataaataccagaataaaaagataaaagagatgaaaatagtagtctctggggagctaaagtctaaaatacaaaggtgtgaggcagaccttatatactacttaacttgtatactatttatagcccagtattctgttttctagacctgtccaggtgttaaggatccaatctatgaaccagcagagacccaatgactaaagacaaactttgctgcacactgaaatcacctggggaatcttttaaaaagtactgacgcctgactcccacccacaaacagtctgatttaattggcatgggttccaacctggggatcagtagtggtaaaaactctccaggtgattttaatgtgcagcaaaacttggaacaactgcaaagatc

SEQ ID NO: 87546 - DNA, 1458 bp, Homo sapiens
ctcctgtctcagtctcctaagtagctgggattacaggtgcctgccaccacgcctggctcatttttgtatttttagtagagagaggggtttcaccatgttggccaggctgatctcgaactcctgacctcaagtgatccacccgccttggcctcccaaagtgctgggattacaggtgtgagccaccgcatccatctggcccttattttaataagtttagttgaaattgtacctaggtttctgtaggaaacaatagcaagtaactatagttactttttagccacattgttttcttgatttgtttggtctatagtctgagagaacactactacttcctgcttgataaactgtacagaatttaggttatgattgctaaattttctttttagcattttcagctgtcccagtaaataacacacaagtgatgcagattatagaacacttgactctactctctgccagtgaacttataccatatgcggaagtgttaacatccaatatgagccagctattgaattcaggggttccacggagaattctgcaaacagtcaataaactatggatggttcttaatactgtgatgcctagaaggtaaattcagtgtattgttacatgtaatagataattatatagcagggataatatacaataacctaaatttaattgtttaaaaaatttttcaccactcatagcagtatttgttgactatatgacaatatatctcctttcttaagactactaaatagttgttatatctttaagtaaagcaaactttattgaaatagaaaccttacagtatttctaactttaggaagttcttgaaaattgggttatcatgtatagttatttgtggctaattatgatttagatcactgttatatcttggatctttgcagttgttccaagttttgctgcacattaaaatcacctggagagtttttaccactactgatccccaggttggaacccatgccaattaaatcagactgtttgtgggtgggagtcaggcgtcagtactttttaaaagattccccaggtgatttcagtgtgcagcaaagtttgtctttagtcattgggtctctgctggttcatagattggatccttaacacctggacaggtctagaaaacagaatactgggctataaatagtatacaagttaagtagtatataaggtctgcctcacacctttgtattttagactttagctccccagagactactattttcatctcttttatctttttattctggtatttatatcctccccatatatctcttataatgactgtaatttcctgattttccaatttagaaattatctgttgactttctactctacaaggtgaaggttagttagctctcttacttgcttccactcctgtgagtcccacttcttctaatacacattgccccttttcctgtttctcacaacacaggtatattaaaatttttgttaaag

SEQ ID NO: 87547 - DNA, 1202 bp, Homo sapiens
ggaagttcttaaactgtagtttgcatgcacaagaagtgcacattcctaggcctccattctagagcttctgatctagtacctgggatggtattcattattctgcacatgaaacaagcttcccaagcttatggtgctggtggtgctctaatcattctttttttatttttgaacgggagttttgctcgttgcctgagctggagtgcaatgttgcgatcctggctcactgcaacttctacctcccaggttcaagtgattctcctgccttagcctcctgagtagctgggattacaggcacccaacaacacgcccggctaatatttgtatttttagtagatacggggttttgccatgttggccaggctggtcttgaactcctgacctcaggtgatccacccgcctcggcttcccaaagtgctgggattacaggcatgagccaccgcgcccggccatctaatcattttttgagaaacactgacttagagcataaccctctttccttgtgggctgatggcttgataaaaatgagaggggtggggaagcttctggtgtttgagcatgaagaatccaattgattttctgtaaattttcaagggttgcattcagctttactacgtctccttgctactaactacccacatttatgtattgtggatgactggatttgtgaagaagaaatcacagggactgatgccctgctacggcgaatgctcctgactaataatgctaaaaatcattctcccaaacaactccaagaaggtatagtaaattattgatactcctttaaccccttttgtagtacaaggagatgctaggctaattgaaatcttataatcatacagaattttcccatggatataacaatgttttggtgaatgtattttaagtatataaaatactctttgcgtttaaggaattttatgctcccttcccctcccccctttcctcctttccccctttccccttttactcctttccccctttcccccttttccctttcctttccttttgtgtttgtgtgtctttctctctgtcacccaggctggagtgcagtggcgtgatctcagctcactgcagcctccacctgctgggctcaagcagtcctcctacctgagtcccacaagtagctgggactacaggtgtgagccaccaggcctggctgatttttttagtttttgtagagatggggtttcaccatgttgccc

SEQ ID NO: 87548 - DNA, 1021 bp, Homo sapiens
atgcaacccttgaaaatttacagaaaatcaattggattcttcatgctcaaacaccagaagcttccccacccctctcatttttatcaagccatcagcccacaaggaaagagggttatgctctaagtcagtgtttctcaaaaaatgattagatggccgggcgcggtggctcatgcctgtaatcccagcactttgggaagccgaggcgggtggatcacctgaggtcaggagttcaagaccagcctggccaacatggcaaaaccccgtatctactaaaaatacaaatattagccgggcgtgttgttgggtgcctgtaatcccagctactcaggaggctaaggcaggagaatcacttgaacctgggaggtagaagttgcagtgagccaggatcgcaacattgcactccagctcaggcaacgagcaaaactcccgttcaaaaataaaaaaagaatgattagagcaccaccagcaccataagcttgggaagcttgtttcatgtgcagaataatgaataccatcccaggtactagatcagaagctctagaatggaggcctaggaatgtgcacttcttgtgcatgcaaactacagtttaagaacttcctgacagtcatttgatcaagggaaactgcttaaatgaagatcctgaagtaatgtgataaacagtgaggtgggaactactacttataaagaaagctttcaactttcttccaccccacccaacataacagtctcctaaagttgtttgacatagcaatggttcaagagttcagggtagaggaaagaaaaggaggagaaaagaatgtccatttggggactatcatatatggtttggaaaaggtcctattcagaaatactgataggcttctgtagagaacatgccctttcctccaaccctgttgagaatcatcactatagatatggtaaaattaaagttgcccactttgaatacctgaaaggtctcaggtactttatgtacgttttctcatctctccctaacattcatacaaagtaagcaatgcctcc

SEQ ID NO: 87549 - DNA, 1002 bp, Homo sapiens
caggagttcaagaccagcctgggcaacatagtgaaaccctgtctctactaaaaatacataaattagacaggcatggtggcgcacatgcctgtaatcccagctatttgagtggctgaggcatgagaatcacttgaacccaggaggtgggggttacagtgagccaagatcatgccactgcactccagcctggatgacagagtgagccactgtctcaaaaacaaaaacaaacaaacaaacaaaagaggtagtgtacaatactattcagagttaaaaaaatttttttttttttacctctgttaagtgtctgttaggttcaaccacaagaacctgctgtttctgtagctctaaattagctgaatatctgcaatttcatacagttcaacctacaggagaaaaaagcctgaaaatacatatcaactgaaaatagctagggttgcgttttagggggcaggctggtttgcaataactgaaataatagatttagtgagggaggcaaagaggaatttcactcttgaactgtttgaatttttaacattaagcacctattacacttcataacattataaacagaaaggttttttaacaataaactttagcagtaaaaagcaaaataaaacatacctcccaactcctgctgcagcccttgagcctgtcgaataaggaatttgataggaatctgatccattaaagaagaagaatatgatttgggctttctttgcatggcagctatcaaagataaaaagtgtaaaataaataaaatgtccagaaacaacagaaatcttaaccttcaacccaaatggaaacaaaaacaaagtcaaattacttttaatgcaattaacctgcgaatatagcatataaaagatgaagaatcattacgaaaacaagtggctacacaggaagaacaagaacatacctggagcaagatctggaaaatgtcctgaaatttaaaactagacagaagaaaattcataacaggttgagagaagccatgtgcaaaagtgc

SEQ ID NO: 87550 - DNA, 1070 bp, Homo sapiens
caatgatagttaagtgataagtctcctgtaagtgcttttcagagacattttcttagtctatctgagggtttgctgtgaaggacctatctctctctctccaaattcctatctaacgtgagctctcccatgacgacacacatggtgctctaaatacagatatggtagggacttaaaatgtttttcccactacttaaaaactaatagattaaaccgaaaggcaagcttctagtggagggtgcacctaagatgatacagatataatggtagttcatattttaaaatcaaaggcagttatgatactagataatatatttggaactgccaaaagttaatagtgagttttactgattcataattcatgtaaaactgtatgtacttttataattttgcttggtttttctttttgccacaattaattcagtgtctataacattctttcttaggattggatttatagacagctgtgtgaaacctctactccacttcatcctcaattacttcctttgattgatgtgtacataaattctatacttactcctgcgtcgaaatctaatccagaagccacaaatcagccagtcacagaacaggagatactcaatattttccaaggagtcattggggtaaaatagtggttcttttatatctattaacttatttttcttttagttcttcttacttaacccatatttttattttcctatcagaggacttctaggtagttctgaatttaaaattagattaaatttccttagatcacctctaaaaattaaaagaatggtattagttccaagtagtttgctaaacaggcacttttttttttgagatggagttttactcttgttgcctaggctggagtgcagtggcgcgatctcagctcactgcaacctcctcctccctgcaacctctgtctgccgggttcaagtgattctcctgcctcagtctctcgagtagctaggattgcaggcgcctgccacaacgcctggctaatgttttgtatttttagtagagacagggtttcaccatgttggccaggctgatctcgaactcctgacctcaggtgatctacctgc

SEQ ID NO: 87551 - DNA, 1034 bp, Homo sapiens
tatattggttctgtttttgagtattaacactttaatgttgggtttgggaaagcacttctaaaacagagtagagtacttgaacatttgaacatttatgtgtatcatagccattttagataagttccctagaataaattgtgtttcatatatttttacatgctgttggaattcttttggtaattttagattgtaattaagccaagctccttgagcaggatgaagacaatcttcacacaggaaatttttactgagcaggtatttctttttattcttaggtacttatttaactttcttttacaatattctttgggagaaaacttgtgtgtcttaccttaagaaaataatatggtcttttttctttttaaactcatgatgatttatttcatctttgaaactttcttaaagaataatccatttaaaatacacttttaaaactagtcataacataccaaggcatcttttgaatttatgtatttttggagactttgagtagatacttaggagaatactcttagatgttgctggtagggcatctcaaggggtaattgttttaatgtgtctggagaaagataaaatgaagtcctatttaaacctttaggctgtaaaattcatttctaactagattacaggctagagtctaaatttcttatacttaacatgttcttctttagccttagcacttttgtccatggataagcataaggatttttttcatttcttttttttttttatctcactttgtcacccaggctagtatacagtggtatggtcatagcttactgcaacctctgcctcctgggttggagcaattctcctgcctcagcctcccaagtagctaggattagaggtgcacaccaccacgcctaatttttgtatttttagtagagatggggttttaccacgttgaccaggctggtcttgaactcctgacctcaggtgatccacccacctcagcctcccagagtgctggggttacaggcatgagccactgcacccggccagttgttgcttttttgtggctattaatatcttta

SEQ ID NO: 87552 - DNA, 1041 bp, Homo sapiens
atttttcaaaaactaatttatattaactatgtgaatagagttcctatgaaggagctaatgcagattgcgatttaactcgttgaggtcacttagctagacaacatgtatactgcttagatcctgtagtctatttttaagctactgaatcatagttttttaaaatattcaagttctattttatagcccatttgaaaactgattttaagctctgctttttaaaacaaagttaacatttatttattggatgcttcatatatgtcaggtactgccttaagcacttggcatgctcatcttgtttgtagttgtcttttgtattcaataaacctttattctttgaacttactgttattattaaagcaggtctatcatattttacttagagacactcaaaagataataattaacatttgtctagccctgtatagtttagaactgctttcatacatgtattatctctgttcattcatctacttaacagactttgagtgcttgctgtatgttaggcacaatgttcgactgtgcagagtgagagaagactaaggcattgtccctgcctgaagaactgtagtggttatagaattgtaaactcttttgttttttttgagacgagagtatcactctgttgcccaggctggagtgcagtggcgccatcttgactcattgtaacctccgcctcctgggttcaagcgattcttgtgcttcagcctcccaagtagctgggattacaggcatgcaccaccacacccagctaatttttatatttttagtagagatggggtttcaccatgttggccaggctggtctcgaactcctgacctcaagtgatccgtccgccttggcctcccaaagtgctgggattacaggcgtgaaccactgcatcaggccaagaattgtaaactcttaattataggagttctataaggtaaatattgttgataaaatatttccttgtcattaaggaaattggggttcagagaggctaaccaatgtgcctaaaggtatataatcgtctaatagtagagctggcatttaaaccccaag

SEQ ID NO: 87553 - DNA, 1435 bp, Homo sapiens
ctgcctcagcgtcctgagtagctcggattacaggtgcctgccaccacgcccagctaatttttgtatttttagtagagatggggtttcaccatgttggccaggctagtctcgaactcctgacctcaggtgatccatgccccgcaccccccccccccccgcccccaccttggcctcccagagttctgggattacaggtgtgagccactgtccgtggccctcaaatgtatttttgtctcgtactttctttgtctctctgggaccgtaattgcaagtgtgtttgaatgtgtaatattgtcccagagtttactattcttttttaagtctcttttcattttttgcttcattttggccaatttctgttgttgtgctttcaaataccctgatccttttcttctgtcatgtgaaatcttcatgaacaattaattctgaaggctgaagaagatggtttctatcatgttagtttgtaggggcctgataaaaaatggagaacgacaagatgaagaaagtcttggaggaaggcgcaggacagatgccttacgcttcttgtgtaaaatgaatccttctcaggccctcaaggtccgaggcatggtggtaagtgatcctgtgttttattagacaaaggcctttatattaggtccaagaactcttctcaagatggttttagagtcctgtagaggtggggaattttatttatatactggatatgttaccttcctctctgggtttttatgttttgtaggagttcttcctctaaactttagatactttagatttggaagcatcactggcctttttgcttatgatactgaattcagtttgttttcttttctgtgctaggtggaagaatgtcacttgccaggccttggtgtggctttgacattggatcatactaaaaatgaagcttgtgaggatggagtgagtgacttggtttgttttgtaagtggtttgcttcttggaacaaatgcgaaagtccggacttggtttggaacttttatccgaaatggacagcaggtgagggttaaatatctgtataggctaaggatcagaatactttagcagctgctaaaagagaaagaaacattttttgaatgatgtcattagacaagtggttctcacactttctagtttcagggacctccttatattttaaaaaatcactaaggataccaaagagcttttgtttatgtggctttttttctgttgatatttaccatattagaaattaacacttaaatatttgaaatatttatttagttcttttaaaaataggaacagctggtgtgttggtatgtgcctatagtcctagctacttaggaggctgaagcaggaagattgcttaagccagggggttctagggtatagtgtgtgataattgtgcctgtgaatagcgactgtactttagcctgggcaacatagcgagacctcatctcttaaa

SEQ ID NO: 87554 - DNA, 1173 bp, Homo sapiens
ttggatgattcctggagacagagaagtgcgctaatgagacgcgtctttctcacatagcacccacacatctgctttttacccggtaacacaggggacataggatagtgttgtggcctccagagccttgaatctggcattggttctgcccagtgatttgctagtttttccaccgactcatggagggtgagaaagagaagcccaatagttcttgatgtatatcggggtaggcatgtgaaactatcggggtatgaaagaaagcacttaactatgaccattcacttttgtttacattttgtggagctcatgtgactgatatagtggagaaagtcttggactgggattttagtagatgaggattcagccttggattgtgcctctaactagtaatactattttgggcgtgttacttcatctctctgggcttcatattccttctttgtaaaatatgagtattagagcagaagattcctgaggctggaagagacattaatatactctgttttctttcccatttcccaggtgacagtataaacctagggagacagagaagccttgtcttgattgtgccaggaacattgccaacatagggacctattaaagatacaccacatttttcagggtttttagaaagttgggtgttcatacatgtgaaagttaaactcctactttcatttgtatttttaccattaggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttaggtaatgttatgttatattatatgtggatttggatttgacaaagaacagggaatcagatattttttagagctctccagaaaagagagaatgagaatctaaattctggagagcattttacttaggtcttttctgtatatagttacagttccagaatcttttgacttccatgtta

SEQ ID NO: 87555 - DNA, 1058 bp, Homo sapiens
cttatgtatagcgaaaaactgcaaatcaagcttttttttaaagggggtattcacttgtaaaaccacacacatggatatttttattttaaacttcaaaatatatgaaagtttaggaaacgggaaaaatcacataattcagctacagccacaatggagcaccaatatgtattagtacattgataattttggtacatttgaaaatttggaataccaaacattcatagctcactgcagccttgaactcctgggctcaagcagtcctccttgcctcagcctccttagtagctgggacttcaggtgcatgccaacacacctggctagttttattttttgtagagatgggatctcgctatgttgcccgagtctcaaactcctggcctcaagccatcctctcgctttggcctcccaaagcattgagattacagtcatgagttgctgccatacctggctaaatctaactgttttgagtgtattcctgaggtgtctattctgttattctgcttttgccaatatcttcctgtctactgtaggggagttatcaatcctggactgaagattaagaacctctacccttagtgtactatagctataaccagaaattctgcttgagattaatagaaattgatactgttagagctgggttttgttttgtcttttccttctagagcaacccaacagaaccgtcaagaatgaccttctgtttagtttaaagtctaggccgggcacggtggttcacgcctgttttcctagcactttgggaggctgaggtgggcgtatcacctgaggttgggagttggagaccatcctgaccaatatggtgaaacccgtctactaaaaatacaaaaattagccaggctgtgttggcatgcacctgtaatctcagctacttgggaggctgaggcgggagaatcacttgaacccaggaggcaaggttgcagtgagccgagatcacaccgctgccctccagccttggtgacagagtgagaagatcctgtctcaaaaaaaaaaaaaaaaaaaagtttaaaggctgatgctttaaagacttccttattttgctc

SEQ ID NO: 87556 - DNA, 2815 bp, Homo sapiens
ttttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatctttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatactttttaaaaaaaaaaaaacaaaaacaaaaaacaaaacttcaaatggaataaattattcatgaagccttcattgttgtgtcttattctgttgaaaatatttccatattaaatttgtgcaaaattagtagcaatatttttgtgtcattataaatggaaagggacagcctagaaactgattaatggtcttttaatttttctgaagtattttattttaaaaaggattttaatcacatacaaatgtacagtatgtagaataattgtatatttgtatacctaccaattccttgtaggctggccagttaggtattgtctagtccaaacaagctaccttcaaatatttaaagcttagctgtatcctatttttatttgatcataagaacaatgttcagaagtgagtaatccatcaaaaatagttctgcccatgttctgtaagcacacatttaaaatatttttgtccagacttaagccaagtaaggacatacctcaaaattattgtgatca

SEQ ID NO: 87557 - DNA, 1722 bp, Homo sapiens
taaacactgctattctaacttgagtaatctacttttgagaataatttttatggaaattgcttctttcccctcaaggactctctgttacactcttttttaaggtgactttgagtcttaaatgccataattgaaaactgcttccaaaatctaggttggaaataaataaatgacttatgcagtttatttgcttttcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctggtattcagactctattccactagtgaaagaaccattttttaaacttcccttgccttttttatttatttaattttcttggtttggagatgtcagtcccaaacaccag

SEQ ID NO: 87558 - DNA, 1592 bp, Homo sapiens
ggccgtgactcacttattcttatgtaaaaccaccggaagttgactgtttttaatccacaagtcatgctaatttaaatacttgctgccgggtgcagtggctcacacctgtaaacccagcactttgggaggctgaggcaggcagatcacctgaggtcagggattttctatatactagtagtctttggtgtctccacaaaacaaaggattctttggtcctttgggagggtgctacacatgctatctgtcctcttttctagtcataatacatgtatgcacactaaagtctgaaaaacagaggtaaataagatagtttacctagcatttcccaaacttattaatacacaaggaaaggattatttaacacctgttaatagtttattatcttagtgtttcaggggatgtgttcaggaaacacaactttacaaaaagtccaagggactatctagagcttttcctactcagtatttatttgcagaaaggatagtataaagcgggcattcacccttagatacattgtaacaagattaggacttctggttatgaactatcacctaaggcataatttaccatactttttgttcacttttttttttcatatatcttattttagttttatactgtaggcagtaaagccacctggtttgtttctctttgcttggaaatataatgggttgttagctagatccctttttatcataggaatagagtactggtactaattacattttaaaaatttgtagtgatttgcagtgtgagacttgcttataactccataaatcaagagtttgtagacagttgaaacatagctatttttggttatattcctaaatgtactacatgagtttctatatgtattgcagttgcagaggagagaacacctaaatataaaatagtaccttatacagtgtacagaatgagatctaccaagagttactgcagtgaacatcaccattgttttatcatagctttttaatactatattgacttataaaaaaaatgactcatttaattggagtgtggagtagtttattcctttctcccactattcattgccatatctaaatgagtgtgccagtttttacctaccctctattatgaaattgagtgggcaaagcaggcatctgtgcactgtattacttagagtgttctcagttcaaccgaagatagcttgtttaaggtttattgtgctgtaaccaaactatttgcttatgcttattcctgttacttttttcagtgctagacgtaggtatgtctgcgtagtcataaagggtgtcatatatcttaaggacagactactcaggtttaactactcaatttagtgcctccttaaacatttactttgcacatctaggcaaattagacttagcaggtaattagaaattctttttctaaggattattgtatggtctcaaaaacaataaagctaaagaaaaggaaatagattcaaagtaagttttgcacttaaaaatcacttctggctaggcacagtggctcatgcgtgtaatcccagcactttgggaggccaaggcaggaggattgtttgaggccaggagttcaagaccagcctggtcaacagaacaagaacctgcccc

SEQ ID NO: 87559 - DNA, 1063 bp, Homo sapiens
agcttgcagtgagccgagatcgcaccactgcattccagcctaagcgacagagcgagactccatctcaaaaaaaaagaaaagaaattatatatactggtgatttgattattgtagtatgcataggtataaaatttacccttttaaagtaaggaaggatctttccagtcttactttgcattccttcctcctttttgtaactgcaaagaaattagataggaaatacatataacaaaaagcaccagtaatcccaccaccttaataaaaccatttttacttttaagcaaattatcttctttccacatacgtttatgttgcaattttcaataagtataatgaggttttaaatattgcatttttgctataccctaatttatgtccttcccaaaatattggacatgtaagatttttttttgttatagataatgatgtaatgaacgttttcatgcatattatttttattttatctatttttaaataccaagaaatacattaactaatccaaaggatatgcatgtgacttggtagttgtcccttcatgttgccataataattttcacaacactattaactgcattttatagatagtgctagattaacaaagctaaattgaatccaccttttgattggggtgtggttttcaggacttaaaggaatattagcaaaaaagttaaagatgtcattgaaaattttgtattttttactcatctgtgaagttttacaaactttcccgtgaacttggcataataatacagacttgttaaacagttggcatatcatgcaatccttaaaatatgttctattaatgcttttacttataatactcctaagtacatagaaactggttttttttcaatatccttcagtattttattaaatcgatgtcataagataatgagactgattgctatgagccattctgtgtttatatctggtacttagttacactgagtgaactaatatacttttaattttgtctttttaagggtcagagtactgatcggctactatcaacagaacctcatgaggaagtacctaatattcttcagcaaccattggcccttgg

SEQ ID NO: 87560 - DNA, 1027 bp, Homo sapiens
aaaatgtttccttgcctttgtcagtttctacaggctacttgcattccttggctcatggtcccttcctctatcctggatgccagcagtatagtgtcatcacatctccttcactggctctaaccctactgcctccctcttattaggacccctgtgattacattggacccacccggataatccagaataatctccccatctcaagatccttagcttgatcacatctgcaaagtcttttatggtaacatattcttagattcctgggattaggatgtggacatctttggggggccattattcagactaccacatgcttgtttatgcataattatttgtacggcttttagcacaatacttggcacatggtagacactcagtaaatgttggttaaattaacccattttggttaaaatttcatttattttgaccctttcctgtgaatgaccataggatatggaaaatggagttttaaatttcttttctttctcctgtttagatggagcagatggaatgggtatctttgatttgttagacacaggagatgatcttgaccctgatatcattaatatccttcctgcttctccaactggttctcctgtacattctccaggatctcattacccccatggaggtgatgcgggcaaggtaactgtgttacaagttttagtttttctcggccgggcgcagtggcttacgcctaaaatcccagcactttgggagggcgaagcaggtggatcacgaggtcaggagtttgagaccagcctggccaatatggtgaaaccccatctctactaaaaatgtaaaaaatagccgggtaaggtggcacgcacctgtagtcccagctactcaggaggatgaggcaagagaatcacttgaacctgggaggcagaggttgtagtgagccgagatcatccaattgccattccttaacttagtaatggattaatatatgaaatgcaatactatttttccttggaaattagcaagagttgagattaattaacagtacattcatgcatttctacatcat

SEQ ID NO: 87561 - DNA, 1534 bp, Homo sapiens
tgattttatgaatattctcgcttaggacttacgtaaaggttttgtgaagcactaaaattaaggagatctgtttttcacaaatttgagctctcttaaaatgtcgggatggcacggtggctcacacctgtaatccagcactttgaggggacgaggcaggcagatcacgaggtcaggagctcgagaccatcctggctaacgcggtgaaaccccgtctctactaaaaatacaaaaaattagctgggtgtgttggcacacacctgtagttgtagctattcatgaggctgaggcaggagaatcacttaaacccgtgaaggtggaggttgcagtgagccgagatcgcaccactgcactccatccagcctgggtgacagagtgagactccatctcaaaaaaacaacaacagcaaaatcatataaattttagaaatatttatgacactctctttattcacacaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaaggtaaaattgtgcttttattagtatttatatttccgttttatgtaaattcacacacagttctgaccacgtctaggtatatatgttgaataaaatgcaaaggttatcaaataaggaaccacatatgtctaggccacaaatggcttaattcaaattttaaaaagacattttactcttattttaactttaatatcagtcttattactgctgttcttaattgttttctgttttttccactttctgattgttatttaactcatcctctgttgagcagataccaattgaatttggtgtatcctaatattagggggataaagaatgttcagtagcatcagcagtaagaattttggcttgatgatgactcgtgttggaggaatacactaatttaaaagccattaactatttttatattttaactttaacttggttctacaggatattaataatgctgttactttgattttttttttttttttttttttttttactgttgatacccacagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccaggttagctatctttagtttatatcagatttaattctttatgcagttaagtttttaagtattatatacaatttattcttcgtttattaaaagaaaaaatgtctttcattttcagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttgg

SEQ ID NO: 87562 - DNA, 1147 bp, Homo sapiens
tttttttttttttgagatggagccttgctttgtcacccaggctggagtgcagtggggcaatctcagctcaccacaacctctgcctcctgggttcaagcgattctcctgcctcagcctcctgagtagctgggattacaggcatgcgccaccttgcccagctaattttgtgtgtgggaggagtttcaccatgttggccaggttggtttcgaactcctgacctcaggtgatcgcccacctgtgcttcccaaagtgctgggattacaggcacgagccaccgtgccctgccaacatttttatgatactatgcaaaactaagtgcaatttttggcttagctgtcattttccaattatcttataattgggtagataagaattacattttaaatgcaatatttctctaagattgtatagtatgataataccttaattttttattttatagagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaataggtatttgtatttccctaaatatatcatatcattccatttgtaacattttgtttcatttttaatgaatagaaaaccagtttgaaggttttatatatattaaaatattaagatgtggggttgtgggtgctttttacttttttctttagtgaatgtttatattgtataactaacataattaaaaataattttgattaatctattatatgaacaaaaaagattaaggtcactaacttctgtgtcataaagcttgaggcaattattttagctgaacatttttgaaagatgtaaaaaaatggtctagtaaagtatctatagaacatttaaacttttctcatgtaccatctaagatatagcccctaataaactgagtaagttaacttcatttactaaaattggcgatttaaaattttatcatttaaatgttaggatgtagccgggtgtggtggtggttgcctataatcccagctactcaggaggctga

SEQ ID NO: 87563 - DNA, 2115 bp, Homo sapiens
ctttgatttagggatatttgtattcataattcatgaattggtgttaatgtatacctaaaatgactgcatttttatgctcacttatgtctgcattctgcaagcttttattcaaacaaaatggttctagtactattgttatctaggtgttttttcattagagatattttaattttgaaaaaaaattaatgaatttctaatgtaaaaatgaaaaagacctatggcaccatttcacccttgatatgtttatttttttggcctacttctaaaaacacccttgatatttttatcataactgttaattgcaaatggttaagcttattttaagtagctttcatggttggttttataatgtgtatctaaatacaataataaatttactaattctgctttctgtatgtatatttgtagtcctgtcgattaggtcaacatagacctgtttctcgactgttaacagatgggatcatgagagttggatctactgcatcaaagaaactatcagaaaagttggtagcagaatggttttctcaggcagctgacggtaacaatgaagcattttctaaactcaagctttatgcacaagtctgcagatatgacctaggtattgaatttgtatttattgtataaggctggtgttagcaaaatgtggcctgctccaccagctgtttttgtagataaaattttattggaacacagccatcctcatttatgtattttctctggctgcttttgtgctacaacattggagctgagtagttttcatagagactgtgtggctgcaaagacaaaaatatttattatctgaccctttacagaacaagtttgctgatccctaatgagggatcccatcaggtaggaagaaattatgggttataaataaattttctgttgcctctgtagggtctgatgttttaataacttgaagattcttcatttgttacagtttagagataaaataatttatagttaatctctaccaaaccaagaaatagttctttgttgtagctaagaaaacgacagctgtttaagacttgcttgttacatactttttttctttcattctacccgtgcctaactgtattgcttataaatactcttgaaaataaagatcagtggacttcctttagacttaatccaaagagatgcagaaccaaaatattgaatctcattagacattcctataatttgaaccccataacattataccattttatattttaattagctgtcaatgtagtcaatatttatttgatttgtgatttagaaaccctttgaatagtttgatgaatattgctagataccttttttacatttaattatacttagaaaatagaattttgttacactttcatagtaatcatttctttaattttgagtgaaaattctggctttttcaattccattttaaatatgtttcttcagtctctaggggaaaatagaaagcaagtgtaggtcacaccattagcaagcaatttcggggctataattaccaagaaaacatcaactggattatgattctgtttacacagtagaatttaaaaaaaccagtcagtgaaataaagaattaaatttcgtacctgtttttattctttaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaaggtacctttaaaaatactgatttttgcagaaatataaaaactatgatgctgcttctttcttt

SEQ ID NO: 87564 - DNA, 1051 bp, Homo sapiens
aataaaaagacttgtttaggaaattccttaatgttgaaaagtcttgaccactggcattaagtatttttgtctctaataaaatattttcactaataatgacttcattaacttttgacatttaaataaaaaggaggccgggcatggtggctcacacctgtaatcccagcactttgggaggccgaggtgggcggacacaaggtcaggagctcgagaccatcctggctaacacggtgaaacctcgtctctactaaaaaatacaaaaaattagccaggcgtggtggcaggcacttgcagtcccagctactcaggaggctgaggcaggaaaatggcgtgaacgcgggaggcggagcttgcagtgagccgagatggcgccactgcactccagtctgggcgacagagcgagactctgtctcaaaaaataaataaataaataaataaataaaaaggagacatgtcttgtttttaagtgttttcttaaaatacatctttcttatttaggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgaggtaggtgtttaaaaagagatgacattttaaaactaccttacgatttgtattgttgtatatacagcatactgggcagttcagttgattgggacacagtgatgatgtcagattagatgtttatttctcatactagccagttacattctttgctgagtttgacccagtctgttagatgtgtatgccgtgggtcagagtggctatccccctataggaggaagaaacattgagggcatatagatatatatcccttttaatgtggctttttctaaaacaaagggtaacaatgttaaatagccaggaaaaaagttacatttacaaaaattctagtc

SEQ ID NO: 87565 - DNA, 1081 bp, Homo sapiens
gctactcgggaggctaaggcaggataattacttgaacctgggaggcggaagttgcagtgagccaagatcgcactactgcactccagcctgggcaacaggagtgaaactcccatctaaaagaaaaaaaaaatggctgggtgcggtggctcatgcgtctaatcccagcactttgggagactgaggtgggcagatcatgaggccaggagtttgagaccagcctgcccaatatggtgaaaaatacaaaaattagccagcatggtggggcgtgcctgtggtcccagctgctcaggaggccaaggcagaggagttgcttgaacctggggggcggaggttgtgttgagctgagataatgccactgcactccagcctgggcaacagagcaagacactctgttgctattgtgtggaaaatagcgttggggtttggaagtagtgaaagtgagaacagaagcaggataaatcagttggaaggcagtttcagtagcttaggtgaaagatgatggtagcttagacaagataagaggccagcgagatgtaagtaataggttttaggttatttgggaaatagaacctacagggtttgccaaaagacgtgtaaggaaagatgaggcatcaataatagcttgagcacctgggtgaatggtagtactaactacagaggagggaaacacgggggagtaaatcagatacacatttggagataatatgttttaaattcagaggaatgattgggtctggagatagaaaaattttgtgtgtgagttattatgaaaagctgtggatctggatgaaataaactgtagagtaattgtagatagagtagtacaaggatggagctgacatttataagtggggagggagaaaaggcaccaggaaaggaaattgagaaggaggttggaggaaaaccaagggagcatggtatcctagaaatcaggtatagggaatttttgtttgtttgtttttgttttgagacagagtctcgctctgtcaccaggctggagtgcagtggcgtgatctcggcccactgcaacctccacctcccgggttcaagcaattctcctgcctcagcctcccaagtggct

SEQ ID NO: 87566 - DNA, 1556 bp, Homo sapiens
ttagtgtatagagtgcttattaatgatttttgaacttgttaattgatccttagtcaacaacaatcacttagagtagatatgttaaccagaaataagaattgactgtgcttgtaattcttgcaatacttgtcctttcataattttctatgtaattgaaaaacatttgggacgtttttagttgtatttcacattactaatatgttcctttatatatatatttgatcttcttttaccctggtgatgatagtgatggaagtaatatggatcaagaatatggcactgcttatacacctcaaactcatacttcttttgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactttgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacggtaaagtatgccaataaaatacttttttgtttgcttatttccctttagttacattcttaggaaaaagtaataaaggcagtttcccatgtggcaaatacatttaaagttggacttaaaactctttatggatgatgtttttaaagggagaatttcttagcagtttagtttaatttcaccaataaaagtatggttattataaatctgtaattatatacttatgtaggaatatgaaaggcacattccatatatttattagcataacattgctagtggtctgctttattcaacattctttcactcattaagtatttactgggcaccttgtatgtgccaggtattagcctagattcactgttgaacaaagcacacatattctttgccctttttgaatc

SEQ ID NO: 87567 - DNA, 1875 bp, Homo sapiens
tagctggaattacaggcatgccccacccagctaattttttgtatttttagtagagatgaggtttcaccatgttggccaggctggtctcaaactcctggcctcaaattgatctgcctgcctcagcctcccaaagtgctgggattacaggtgtgagctaccatgtccggcctcttattactgggttttaagttaaggttaaccttacttctgtgtattttgaaagtattggtcattttctttggaggaactttttccttttaatttggaggcttaccaaataaattaatctggagtcagtgattaagaaatattttatatctttcaacactagtatgtatttggctgtatcacagattcaaaatactacttttaatgaatgggctttactgttaagttatatctgaatgattactattttgagatcacattggatgtaaaattttagataaatatgtgctttttttaaatagcctggatctaaaaaatcagcaaatggatcagatgataaagccagctgcaaggaatcaaagacaggaaatctggacccgttatcttgcataagtaagcttccctcatctgtgctcgagataaatttgcgaacttttaatctcaacaaagctccccactccttttggtttaaacacagattcgcctatttttagtcatgttaaaatgtatgtttttattaaatataggcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagtaagtatgttttttctagaaaaataattcacttcctatattttcttatagaattaatttgttgctatagtcaaaaattattttatagtggttgcggttttgtagctaagttgaggactgaattattgttgtcactattaagaatgcatttaagaaaataatagaattgtatttagattttattctgtttaaagaaaggaaaaaaggtccagagcctgtttgtttatttattttttcctcctagaagataagatactgaaaacctaccatctttatattgtaggatttttcttatgtctataagcctgaaaattgtcaaattctagtgggatgttccatgtttgcacctctaaaaactctaccaagccaatatctgccccctatcaaattgccagaagagtgtatttaccgtcagagttggactgttggaaaattggaattgctttcttcagggccttcaatgccattcatcaaagaggggtatgatttatgttgttacaatagtatgtgactgcttatacagctttaatttttttttcatagatttacctggtatgctggaaaaataaaattggtttttgaaaattctaaaaattatttctggttaatcaattatagtgattggctgggagcagtgaatcacgcctgtaattcccatactttgggaggccaaggcaggcgtatcccttgaggtcaggagtttgagatcagcctggccaacatacgaaacctcgtctctactaaaaatacaaaaattagccaagcgtggtggcgcatgcttgtagtcccagctacttgggaggctgaggcacaagaatggcttgaacctgggagtcaggcattgcagggagccgagatcgcaccagtgcactccagcctgggcaagagtgagactttgtctcaaaaaaaaaaaaaaaaaggttaattgggtatggataaactattaggaaacttaagactattat

SEQ ID NO: 87568 - DNA, 1054 bp, Homo sapiens
agctttctgtggtctgtcagtttccactagctcatctttccaacttccttgttgtcttctcttttattctgtcatctcctgtcattttattggttattttaggagaataaagagaaacaatttcttagttgctgtgttgaaccagaagactaataacttaaaaattgatgtgccaatgtgattagaaaactcagatacttgcactgaaacttcactttccattgtgaaacatcttgccagaattaatagtaataatgctattttcatgaaacacaaatcaggccttcaaaaatttaaaacttaaagtatatctactcatggcagtaaaaaaaaaatacataatcactttccttgtataaatgtataaattgtttaaaagtattttactcacttttataaagctcccactttgagtcactgtactggagcagtttagatttaagagcccctttcagggaatggatttgtacaaaatagtgtgcttgaggacttgagaaccgtgagttacctaaaccgtgaattacctaaagacaacatattttggtagaaagatcatatagttaggaaacttggattttggccccatttctctatggctaaattttagacttcaataaattatttaatattttcatgcctcctcatttctgaaataagggattgtaggttagataatctttaagtaattctaaaaacattatgatacttaacgtcattttggaaatttttaatgcttatgtggataattaattttttttaatttttttatgcaggttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtaagagaaatcacagtacaccaaagggtcactgttgattttgtagcactgcatatagtaacactct

SEQ ID NO: 87569 - DNA, 1060 bp, Homo sapiens
tatgtttaacttttcattgactatgtttgtaaaagtaaaatttctctaatttgttagaatttacttgtggggaaggagaggttggagtggaacatagcataacccatatataagatacacgtggcaaatatctttttttctaattctttttagtttatctattagttaatgatagcatgtatttcagaatagaggctaagaaccatatagattttaaagatagcaaaatttctggcaagaaacattatatctttttttcatgggtttagcacttagttttagaagaatttgtgattgtttagtctgtgattctgattcagagggaaacctgtctaaaccctgagcaaagaaagaactgtatttgagcatagttctttacatgttttattctgtagccaaagtatatcaggatatcttagccatgatattcatcaatagaattaactcctatgttgtgttagtggtataccagatttgtatgtatatagttgtagaatacattatttgatctctaaaacatagttctgaatgcctttgattcacagaaagaagtctgtgatgaaataaacttgttttgatttttctgtactctaaatcttttaagtaagtcttctatatttgctgttttattttaatgcaaataaagctttcctttgacagtgaccttggctcagtttagggattgattctgaatataggagacggtaaaaaaaaaaaaaaaaaaaaaaaagtaccatttaaaaagtgggagattttaggctgggctcagtagctcacacctgtaatcccagcactttgggaggcaaacatgggaggatcacttgagcccaggagttcaagaccagcctgggcaatatagtgagatcctgtctctacaaaaaataaaaaactagccaagtgtggtggtacacacctgtagtcccagctactcaggaggccgaagagggaggatactttgaactctggaggtggaggttgtagtgagctgagaccgcaccactgcattccagcctgggtgacagcaagaccttgtctcaaaaaaaaaaaaaaaaaaaaaaag

SEQ ID NO: 87570 - DNA, 1039 bp, Homo sapiens
cctagttcttcacccatgttacctactggtatcctacttgtctcctgatttagctacaccagcatccttgataaattattcaaaaagccaagctcattcctcatggccttttagaattggattataaagagggtgaactgcttatcccttcttatcattcagtgctgctcaaaagttatcttctcagggaagattttcctcaccattttatctaaactatggtctttctctcccaaatcactgcctatcctgtatgctgcttttaatttcttcttagcatatatctgaaattatattatgtatttgctaatggtcttttccctattagaatgtaagctctatgagggcaaggactcttgtcttgtttactgctgtattcttctagcataaacacacacacccccttagaacaattctggatacacaatagaaattcagcaaatgtttgggtgaatgaaatggccctaaaatactattttaaaacttgttttctttccaggttatattttcttatttaatgtgtgtaaaaatgtggtggtatgaagttttttggttttaaaaccttcaatagtgagtttttgtgggcacattgtattcataagagctgttaattctagccataactttaaataaatgtattggttgcttgtgtacatgactatctgtaagtaaaatgaaggtctcttagaagttaatacagtttaaccttaaaatctgttctaaaattatttgacatttttctcactgaataagaatgagaaggaggaagcatagtgtagaaaagtagcgtgcagggtagagtggtactggattgtaattatgtaagttaaggaaataacatgctttgcctattccttgtcaccctttttttctgccttatagacaagggaaaaaaaagattgaataaaagagttttaattttaatcatatgtcttatgtgaatattgttttggttatactagttactgaaatgtgtatcatgtcacagttcactttttgcttttttttttttttttttttttgagttttgctgttgttg

SEQ ID NO: 87571 - DNA, 1524 bp, Homo sapiens
aaatttcaagccttgttataccttttaaccttaactagaatcttacctctatatttaaattagatactaaaatatttaaatcatgtaagacataatctttggctgtctgatcacatggctattaaatgagcatgagataattggcttttatgaatgtttctgcatgcccttatattttatttaggtcacgagcaaagtatttttttcccctttcaaattcaaattattttacttttagtattacatgtgaaaaagaaatgataaccgaagtgtctaatactattaactggtattatacttcgccataatagtgatactgtaaatatgaaacctttattttcacttttcaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagtatgtattttttttaatagtcaccattataatttaagggtggaagtgatgcaagttcttaatactaggactcagtattggattcaaggtaggatttacaagaataaattcattgagtattaactttgcattattcctttactgtgttttttcctcagggaacttcttcattatgaaataactttagccacaaaaagtggagaaaataatgtgtaaacacttgtacatcagccaacttaaggattttacatacagttagaattcccatgtactgtttttcttcttccagtcttccttccactgtcctgaatttggtaccttttttttttttttgagacagagtctctgtcacccaggctagagtgtagaggcacgatctaggcccactgaaatttccgcctctgggttcaagcgaccctcctgcctcagcctcccgagtagctgggattacaggtgtgagccaccacacccagctaatttttgtattttt

SEQ ID NO: 87572 - DNA, 1050 bp, Homo sapiens
atcacaaattaataaaaaacccaaataatgttactttaaacctacctttattctcctacagcctgtttttttgttttgttttcagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagtgtgtattttcatttataagttcaaaaattgcatgttgataattacttataattagaagatatctaaagtataaacagtcatttgtttgatttttctttaactcataatgttgatctttaaaattaatttcaatgctacattgaggtttgatagaaaattttatgaattttaaagaattttgtaactttaaatcttaggaggaagtattctgcttcatcaggtggtctatgcgaagaagcgacagctgctaaagtggcatcctgggattttgttgaagccacacaaagaacaaattgcagttgtttgaggtagattatttcccgatcgattgatgcctatgtgtgatagtttgttacgccactgaatgcttatgcccactttatttgaaacagcttacatgaacatatgtcaggattttttttcaaaagaaaattcaggaaaaatatttcaggaatttgaagctgattatagaagtacatgtaaatataagctttcagttcattcactgttaccagaggcagactctgaaagttttgtttcctagtagctaaataaaagacaattttatatggagctatggtatatatagtatctataagctatacagccatataaatctcttgagaaaagcattccttcctcaatggcactacctgagaaatttatcccaagagttctttctttttttaaaaaatgaagagacagggtcttgctttgttacccaggctggagtgatcatggctcactgcaacctcaaacttctggcctcagtcgatcctcctgccccagcctcccaagta

SEQ ID NO: 87573 - DNA, 1190 bp, Homo sapiens
taaacttaaacaataaaattgaaaaagtaatacacattaagttggtcagaagtgcacataaagatttaaaaaacacatttctagaaatctaaaaaaaggaaagctgcctttttccaaatctctctcagcaaagataaccaccactgacagcttattgtggtttattgtggtttcttctaaaaaagagaaaaaaaaaaaagaaaagaaaaacttatgccaaagaagcttatatttataaaaatgtatttttatttgtataaatgtgatacctacttttccattatagtacttttgagtgaaactaattcactagtcacaaaggtaattggttttcctgtcccatttttttcctttcagctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacaggtatagcagtaatttgtctcatcagctctggtaatttgttattttgtgtacagtaagtacttaagaaataatttattttgaaatagtttcaaacttcttgagaatttacaagtgtagtacaagtaatttccttagccatatttccaaactgttattatttactccatcaccctgtctgtatgatgtacattcattatcattggtctttttctgaaccatttgagaacaacctacagacatgatgtcccatcactcctgtgtactcagtgtgtttcccagaattaaggacactctcctatacaactattactcgatcctcttagtcagaaaatcagcattgatacactgccatccagtttgcattccctgttttagatattttgctttctgtatttaaaagtagcgtgcttttatttttaaaggtttatgtgtttatctataattaaaattactccaacagagcagcccattgctgtgttctaattcttagcccttaagtcctacaaaaataaacccaagcttttacagtaactgtcaatacagaactaaagcgttttagctattaaaaggggtttagttaccaaggtgcttattttcagcaaaacgccctgttactcagaagaacatacgcatatact

SEQ ID NO: 87574 - DNA, 1052 bp, Homo sapiens
gggattgcaggcgtgtgcaaccacacccagctaattttttttgtattttattagagacagggtttcaccatgttgaccaggctggtcttgaactcctgacctcaggtgatccacccgcctcagcctcccaaaatgctgggattacaggcgtgaaccactatgcccagcctgggcagacaaatttttaacagtttatataataaactcagtgtcatactttatcttcacagtaacgaagtataataagttgatttttctctggaatggttattactggtttccttttcttttttataattgcacgattatttgccacatttttcactgtgttcttatttggtaaaacagtcttttgttacttatttgatgtctgctttgggtttctagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttggtatggatcctgagtattattcctaaggggaaaatgcatgattgtatgtgttagttatattttgctgaataacaaacaagtctaataactcagtggctttcaacaccaaagatttattccttaatttcctgcccacattacttaagggctgcatcttagctggtttggctccatgtatctgctcattctgtaacctaggttaaatgaatatcccagtagctaggacatgctgttcttatgagaacagaagaataatagggactgaacctaaccatgtaagtgtactcagagcttctgctgggatatggtgtatgttacatctgctcacattgcattagacaaagctagttaaatggccaagccaaagtcattggggcagggaaatatattctgtctagagggaagcatgcttaggatgggacagttaattgtgaatgaattaatatttggaggctgaaaagttgaca

SEQ ID NO: 87575 - DNA, 1052 bp, Homo sapiens
gaagtcagcattctctttactagtattatgattttaacacaagccatttaacctctttgtgcctcggattctctactggcaaatgggatatcatttttctgtagctgcttaatacaaatgctagaaataggtttgatgtggcactgcctaatctagcatacatatggaattgttgctgttagagcagccagctttaatctataagcacgtcttcattttctgttttagaaataatcttttgattaatttcagtacttaatttgaggaacttttttttccacgatggaagattgttcaagtttcatttataaaattctgcctcattcataactttttgttttagatattgtagtgtgagctcatggagagcaacagtattctctgcaatcctttatagtaactaataatacttcgaattgttattgtggtgacatgtttttgttttaactcacttttctgagtgttaaataccaaaaatgtttgatgggatgatacaaataacatttctccttggaaaaaaagcaagtctgaatttactatgttagtattttctaattgttttataatattctctgactagaatattgcctttaatataaggatttcggagatttgggtgtggtggtgcacacctgtagttcaagctacttaagaggctgcggcaggaggatcacttgaggttgggagtttgaggctgtagtgctccgcgactgtgcctgtgaatagccactgcactccatcctgggtaacatagggagactgccatctcttaaaaaaaatttcaggccggcacagtggctcacgcctgtaattccagcactttgggatgccaaggtgggcggatcacctgaggttaggtgttcaagaccagtctggccaatacatggcaaaaccccgtctctactaaaagaatacaaaaaaaactagccggacgcagtggcaggcgcctgtcatcccagctacttgggaggctgaggcaagagaattgcttgaacccgggaggcggagtttgcagtgagccaagatcacgccattgcactccaaccttggtg

SEQ ID NO: 87576 - DNA, 1050 bp, Homo sapiens
aaaaccataatacttaaaaacaacaataaaaagcagcattttgcagaacacttgaagtggtaaaccagaataatgttgttgctaagttttgtggggtttttttggttttttttttttttttttttgagatgaaaccttgctctgtcaccaggctggagtgcagtggcgcaatctcggctcattgcaactgccacctcccaggttcaagcgattctcctgcctcagcctcccgagtagctgggactacaggcgtgtgccaccatgcccagctaatttttatgtttttagtagagtcggggtttcaccgtgttagccaggatggtcttgatttcttgacctcatgatccacccgccttggcctcccaaagtgttgggattacaggcatcagcccccgtgcctggccactttctaagtattatttactgtataatgtaagtaatatgttcactgagtgagcagaaatatgtacaggattcacaggtaagatgttaacttctggattttagtatagatcttttgttcatggagctatgttaataatacctgatactggtattatacctgtaaatttaaaaatttaaaagttactctgaaggctgtagaaatacagattaatgattcccaaacttgtctggatgtgggaatcacctggagagcttacaaaaaattattgatgcctgtgtcttaacctgggactgtaatctgggctttggaaattttagaagatcctaatgtaagacaagtttggaaacttttgaattcacggaataaaaataatctcagaattaagatggctaggggaggctgggcacagtggctcatgcttgtaatccctgcactttgggaggccaagacaggaggattgcttaagctcaggagttcaagaccagcctggacaacatagtgagacctcatctctacaaaaaataaattctaaaaattatctggacatagtggctcacacctgtagtcccacctaacttcgttggctgaggcaggaaaatcgcttgagctcaggaggtggaagctgcagtgaattctgatcatgc

SEQ ID NO: 87577 - DNA, 1049 bp, Homo sapiens
attacattatgtgtatacatatagacatgtacatataggatataataaatccttgctggatataacataaagaaaataggattaaatatttggttcaatatgttctaagcctttgtattagaataattagagccctggaattagtagtaaaaaacttagtccatagagagtgataaatttttgattttgtgggataaagcagtaaaagttcacaggaaggaaaggatggctgttgttaatggccattgtattgggcagtgtagatgtagaacattttcatcattgcagaaagttatttttttgggtggtattgcttacacaagaacctttatatttataattaaaacagtacttttggtgcttcaataaagaaattcatcgattttttttttttaaggaagtaaatgaaagaatatgctttaaatttcacccataaagctgtgtttattttctgccatatgtatggcttttacattatctcgtgctctccaaaactgattaaaaataggcaccatgagatgtaagtctcccctgaaaatgtattattaaccattagtagcgttaggatgtcctttggttaggtttctcactgtctccgaaaaggcaaatttctagagaagctaggagctattgctgttaggttttttatggactcatttcctctcttcctgtcatctaatgtactgtccagtagaagtataatgtgagccacataggtaatttaaaattttctactaggcacatttaaaaagctaaaaaaaaactaaatgtataggcaaaattaattgtaatatattttttaattcagtaagtccaaaataatatcatgtcagcatataattaactatgcagaaggttttaatgaaatagtttactttttgtactgcttttgaaattaggtgtgtgtgctgtgcttagagtatatctcagtttggattggccacattttaagtcaccaatagttatatgtgtgtattggctattgtatttacaacacagttctaggggtttaagcccagttgaacttggtagtgtttattagtgaaagg

SEQ ID NO: 87578 - DNA, 1024 bp, Homo sapiens
ttttttggcaggttgaatgactaggggaattaggacaaagtaacaagtgagccagcttagaaattggcatcataggtgtagagtgtgtttaatattttccaggttatacaaacaagtgtccttttcattaatacaggaaccaattcagtatgttcatgatgtcattgaattttataaggtggaaaaatacttttcaggtaatttaatagaatatgtggcacttagaccttttattccttgtggagtaactttgaaacctgataatgtctagagatacattgaagtgattgtagcttaatattctggggtaagctagtgttgatgaatatagagtttaaactgtaaccttttttacttggctctgaatagattatagtgtcactattttattatttccttcatttctcttttagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaaggtaagctatcttaaattctgacgtgatatttctttagatttgttcctttttgtgtcttaacagagaatgtgggataaaacaagctaatatacagacatattccagaggttgtcagtgacagagtactagatacagtcaggttttttttttttttaaaccactttacaaacttccctttatacactttaagcattttcttactgtaggaataggctgtattttaatacagtggcctaaattttgatttgtgatgatagacttaatgtgggatgaaagcagagacttaggcttggaagtatcttttttttagtatttgtggaaatatatgcacagcactctgatattaaaattaagtaacaacacctgttaaggatagtgatctgtgagtatgttttggatcaagttaacccttcttattcccaatctctcaattccctttaat

SEQ ID NO: 87579 - DNA, 1018 bp, Homo sapiens
cgttttggttttaaatggaagtagataacggtgtctttgatataatagaatgtgaatttttcctatttaatatttatgattaatattagacttaaaaaattattctataccaattctgaaatattgtcattttctcaagcttattctacttttttttccctaagcttacctttttttttgtttgtttgtttttttggagactgaatctcactctgtcccaggctggagtgcagtggcacgatcttggctcactgtaatctctccctcttgggtgattctcccacctcagcctcccgagtagctgggattacagggctgcactatgacgcctggctaatttttgtatttttagtagagatgggctttcatcatgttggcgaggctggtcttgaactcctgacctcaggtgatccgcccacctcagcctcccaaagtgctaggattacaggcgtgagtaactgcgcccagcctaaagcttatttaaaataaaatttaaaaaaaaattagttgctttgaaagacttgactatcatttaggagaaaatataaaaccaacattaatctttgtagtggcacagaatttctagtgcagttaaagtccactatcatactttttagttaatgtttattctacccatttgttgtataaattgtgcatataaaccatgtgtaactcttaatacatgtctttgcttttattcagaagctcatattgtgtctgtttttctgtgggtatagtgtatgcatttttggtgttgaattgagaaacgtttgtcttttatttttacttaaacattgaacacagatgacccatatttacaaaatgtttataaaggtatataggctatagaaggagagttaattatatttagactaagcaatttaaaatcttgtaatgaaagttagagtgctgaagtggtatcattatttgtagcacgatttgttggatgctttgtgacagatatgaaatggatagagtacacaaaaaaatttttctgacctacatccagacttatctc

SEQ ID NO: 87580 - DNA, 1249 bp, Homo sapiens
tctttccctttaaataaaaataaaagcaaacactgcgtcctctcccatttgtcatcttaaaaaaatcatagcaagttagactgtgatgagactctttgagaaaactgataccttgtgaactaaaaaaactcagggctaaaaatatttgttctttttcctggctcctgaggtctgtaaagtagattttagtaacatgttcagatagttttattataccagaattttatcataatgaatagtgctcaaactaagtggactattgttctgaatttaattttggatgttttaattgaaggatattaactgtagtggactttaaccttaaatgacagctgttaataggattgacagatagataaacagccaggcataggaatctagtcccagccaaactaaaacattgttgtgtgccccacatagtctaaagagagtaatttatttctactattgtaaaatttacttgtgatgtggcccgactctttaaattggctagtctcctaggtgacaacttcatttgctgtatttcttctgcatactgtttttttgatcaagtgtatcttctaagttttcaagccaaacataacatactaggctgtttttaaatcagttttcaagttttgccatagataatgatgcggccaacttaaggctctcggtatatttgttgaatgtataggttattaatgattattcaggagaaacactgatctagcatttaaacatttctctttatttcaggaaatacatggtattttctaccatgttaatttttgagccattattcattagcatatgttacattttaatagttttgcaaaattgtattggagaagattcattttttaccaccgtggagatatttaaagatgccatttttttgagaaaaatgttgagtgcagggtgtgtctgcttttttggttgtgattttttttccccattgatagagaattattttgatgacttatcacatactttggcactactgtaatctgcatcttcaggaaaaaaatatggtaatcaaatttagcatttgtgttttcttccaataaatagtccataaaaatttcaagaaacactgatgattaagaactgtaatgctaatagtaacagaaaagtactaagaatgcagagttgaactttattttctctggacatagagctacaagagaaggaatttttttttcttttttttgtagggatggaggtcacactttgtctcactcagcctgcagtgcttaatcatagctca

SEQ ID NO: 87581 - DNA, 2007 bp, Homo sapiens
tagggtctttaataattgattttcagttaaaagtttgacaccagtgaacaaatgtgaccagttaggacagagaaaaatgtactctgtttgcatattgaagtgtgtgtctatatttaacatcattcagtttcttctgtttctacttggagtacatatttgcttgctattcagtgacatggtggtggtaatttttaactgtattcttctccctaaaattcttggttgttgaattataaagtctttttttgttctaatttgcagtcaatatctcaagcatacattgaaaaattgtaatgtcttaatgaaataagagacatcatattgagtacttttgactttgagtgaatatgcagtaataaaacttaatgctttctttccttcaggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcaggtgaaagaaactttccatttctaactaatgatatagcaacattgtatacttctcccagaatgtcatatgtattacaaattaagtttgtttttgtgggagacttaggaggccagataaaaattcagcttcattgttttatttcaccatgattattttattttacttaaattatccatgttgttatagctgggtttttaaggcgtgaatgactttctccttccaccacctctcttcttaatttctcacaggtagttagggcccgaagaaggcatgttacattaatctaaaaaaatggaatcaggaaacagagttcctaacaaagtcgtgtaatagtttagaagccagatgtaacttttgagtcacttcagccactgctgaagttgagtcttttgcattgaataggcagatgattctaaaagtactggaaatgtaactatccgtgtgtgtgtgtgtgtgtgtgtgtgtggtgtgtgtgtgtgtgtgtgtgttttaaggcatgtattttgttattgtcatttgtgctatttgattaacttatgaaggcatatgttaatttagttatttttggaaagtgactcatatactgttctgtcaaacataataagagaaaagtgccaacttgtttagcttttatgggacatgggatcataatctaaaaggttacacaaacaattttattgtgagcaaatcaatgtgattacttccttattttcttgacttttaggaccaaatgctactttagaaagagaaactatagcttttcatataattactgaagctttaaattgtgaaagtcagtattaactgaatcttagataataggaatataaatgattggttgtatgctataaggttccaaagacttcagtaagatagtttgataatgatttttgacagataaacttaggatttctagataattttttttaagttcttatttgaaattgagtactctgaagtttttgttattgtatctctgacctataggatctattttatttttggatagaatgtattctaggtgtctgtatcttgaactggtacttagtaagaccaacatttatgtaggaatgtacgtgttacatttgtatgttttgataattgcttttcacattctaatgaacatactctccagtgttaattgttatttttgagagtgactgcaattcttcaagaaagctttccagcttttgtagtttttctaataagatgcctgctgcagagtccagtccttagttgtgtgtatttaatgtagttctaaatgtgtaaagtgatgtgtatatgtatatacatatatgtacatatacatgatgtatgtatatatggtagttttagcgagacaatactttctaattatgccaaaagctaagtccgccagcctcctttttc

SEQ ID NO: 87582 - DNA, 1665 bp, Homo sapiens
ctgcaccccagcggcctcgcgaaataaatgagaatgtcttggaatttttgccaatactttctcttccaaagaactcaaactgatttccacgtaattctcactgatttgtgaaatgaaccttcctggactgtaaatttccccgcaaagagagggccagggccccgggtcgttttatactggccggggcacccagcagatggcgctatgttagtggccaccagctggctgccccgtcccccgagctcaccgcctccgccgaaagcttcccggccctccctcgctcacttctctctccccctcccaaccgagcccgggcccacgtgacctcaaggcggccaatgggtgagcagagagggcgagctggtccctgtggccgccattaaagcgaagggaaaacccgtgaattcggattaaagggggaaaaacaccgcccgctgggcccacaaaatgggggagactacggcgtccagccggtgaggccacaggagggcaaactttaggccggcttggcccaggaacgacacgaagacagagccagagaatggtctgagcccgcagacgccgccaccacctccgccgctgaggagactctgggcttaaggacatcgccgctgccgcgccgggggcctgggcttctctcccggttctcgcccttcccgctcctgtgcgggcgcctctccgcccgggagaaccgtcctgggcttgggctctgccgtctcggacttgattttgattatttattgtgtaatttattatttttcttgtggtaggggcacacatcccctccgtcccccagagagggacgagcgtctgcgggatccgcagtccggcccgccaggcgagcgcggcgcggccctcccgcctccggccctcggccccgggcggctgggtgccggccgggcggcgggggctgctcgcggcggcggcggcggcggcggcggcgggggggtgggtggggagggcgggcgcccggcggcctcctcttccaccgcccccccaaccactaccccccccccggccctccccggtgtctgtgtttctctctctggtcggaggcggcggtaatggcggatggtgggttgtggcgccggcggcggctgctgtgagggacgatgagtgcctccttcgtgccgaacggggccagcctggaagattgtcactgtaacctcttctgcctggtgagtgccggggccggcgggcgccgagggaggggggccgcgaggtgcgcccttgggccgtgggggagggggccgggtctggtccagatgcccgagttcccgggcgaggcccagccggagccggcgccctgcgaagctccgcggccagccccgggaggcggcgttcgctctcctacggtcccgggctctgtttaggggagtgttggcattttttctcgtcttgtttcggactctccttctcaccgtagtctcgtcctcaacttgagctccttatctggcaggacagtaacctttccctcttgtcttgcttaactgttgcttttctccttattggccctgtatccctgcttcacactttacattattgcccctgctccccaccgcctttatgtcttacccttttaatttggtttccccatgtaaacaggaccccagaacttaagccctagaaacctgtcttggttttacattttttttgtatgagtca

SEQ ID NO: 87583 - DNA, 1048 bp, Homo sapiens
tataatcccaactactcaagaggctgtggcaggaggatcgcttgaacctggggggcggaggttgcagtgagctgagattgcgccactgaactcctgcctgggcgacagagagagactctgtctcaaaaaaatttaaaaataataatattttacagtgcttgtaaagagaatatgttaatgggaagagagtggtctgcttgggtctctgatagctgcgtcaagtcagtggagccaataccttcaccagaatgtcctgtgtgacaataaaatttgttgtgacaaaataactggcacattgatatatatgtgctagtatgactcatgtgagctggtctctgtgtatactaacaaaatttagtttagcaaagctgaggaccagactttaaatatggaaatcacacgcaagtaccgctacccagactttcccagctgacacttcttcaaattgcaacacacacaagattaacataacagccacagcgataatcaaaatggcaactaacaattgatgagtacttattaaatgtcaggtatacttctaaagctctacatatgaatttcccattgagtcttcacagaaatcccatgaggtaaaataaaaaacagaagcaaacacagattatgtaatatgttctaggtcacatgttaatgagtgatggagactaaatttaacctaggtaagctgtctgcatttttagccacacctggggagggaggagcgccacactaattttgtagaatacacacacacacacacacacacacacacacacacacacacacacacacatatatgttaaggtggctcatgcctgtaacccaacactttgggaggctgagacagagtctcactctgtcacccaggctggaatgcagtggggcgatcttggctcactgcaacctccgcctcccaggttcaagcgattctcctgcctcagcctcccgagtagctgggattacaggcatgtgccaccacacacagctaattttgtatttttagtagaggtggggtttctccatgttagtcaggctggttgcgaactcccga

SEQ ID NO: 87584 - DNA, 1213 bp, Homo sapiens
cactccgaaaagcccctgaccgccggccacgagtcaagctgccctacccgaggcactctccaaggggagagaaactcctaggccagcgactcaccctgcccgcagccaggacgtgaggcccctaagctgcccgtttgattttctcagggacaatgtggagtggtcggaagagcaagccgcggcggcggagagaaaagtccaggagaacagtatccagcgggtgtgccaggagaaacaaggtgcgcttaaatgggctctcattggtatcaacagccagcgtactgccgaacgcgccctcccggagaggccagggaaccgcggccgcccagatcctttattcctggcctgatgcagatctcaggagtagagcgggacagggaggggatgagcaaggagagaaaagggctgcattgtaacaaaatcttaagtcgtagagggtttttttatatatagttttactttggaggagggtaatgttgtctttaattatgtttagtagatccacgttgatatggctagccaatgacaactgtgtggtcacgcgatcatcttagaacctgtactttttacttgatttgcattttccatgaggagatgttttccattgaagcttcattgaagtgattagattctaaatattgttgggaggggggctagtgactggtgactgtgtgtctattacttgtgtgatggttatgagaatttagggctttagtcaaggaaaggtggatgcagcagagtggagataagtctggccaaagaaaaggaggcccctgcttgagaggtggatgatttcactgcaaaatatccctagatagtaaaactaggactgattgttccagacaattgaagataggactacaaatttagtacccgctgaaagagttctgtacaacaaaaagattccagttacaaaacattcaccctgcatattttgacagcaactagatcaaagcaagttaatagttgaaagggattttgaaaatcatgtggttcaatattctctttttatagttaaagacacttggaccacaggacattaagtgcttttcccagaggtaagcagtcagtagtagcagtagtggaactaaaatcctgtttcttagggagtcttggttgattcagcaggtgagttgtgagttgttaacacacttcttagtggattccaacttccattgtcactgtcctgctcaatttgttaggtttttattct

SEQ ID NO: 87585 - DNA, 1049 bp, Homo sapiens
aaaaagtcccagatcagaagaaattgttgcttctcttctaatacagttacaggaatggagagggtagttaggatggtgcctgtttcttaggcctgggataattctcttcctctgcatttggatggtgttgcagagtctagacctggaaaaatgtctagattggtataatgtaaattcataaatggggactgcgcacgttactggaagctggttctggaactggtcagccttgggattgagtcctatggtgtgatcttagacaatttccttaccctctctgagcagtgagactgctgcctctgcactttatagttatgaggatggagataatgtatgtaaaagggctaagaacagtatctggcacatagttaagcccttaataaatagttgctgtcttcattaccacgcagcactgtgtttaggacaaggttgtcagggtccccttttcatacatttttcagcacagtctattacaaatattttcacaataataatataagctcagtaagaaaatacttcatctacaggaccatttgctagaactcaaaagataaaagcaatccttgcccttttttctagaccacctcgtttctgctaataaaaacccgtgctcttgtcttttaagggttcctgaagtcaacatcaaaatcaacaaatgtcatgagtactgtttagctctggtcactacaccttccctaatacagttaggccagattcttgttgattattatttttctagcttttctagctttagggaattaactctggaaagttctgtgattaatagttcatttctgtctgcaggttggctgtggtgtgggaaacacagtctttccaattttacaaacgaacaagtaagtatgttgtaaaagtttatgatagcaaagaagataaaagtgaaggttggctgggcgcattgcttcacgacagtaatcccagcactttgggaggccaaagcaggattgcttgaggccaggagtgtgagaccagccagggcaatgtagcaagaaaaaaaagtaaaggttttttcaaaacttgctgcatcaaac

SEQ ID NO: 87586 - DNA, 1088 bp, Homo sapiens
ggtgttttgcctttgttcacgacctgtgtgatgaagagaagagttacccagtgcccaagggcagtcttgatattatcattctcatatttgttctttcagcaattgttccagacaagtaagtttgggtcccttggctggtagtgtcacaaaaaggaagctttggtgagggacctttttttttaaaataggttcttgctctgtcagcccaggctggagtgcagtggcacgatcatggctcactgcagccttaacctcttgggcttaaatgatcctccctcctcagcttcccaagtaggtgggaccacaggcacgtgccaccagtcctggccaatttttgtgtttttagcagagatggggttttgccatgttgcccagactggtcttgaattcctgggctcaagcgatcctcccaccttggcctcccaaagtgctgggattataggtgtgagccaccatgcccagcctggcgagggaccttgatattagagttgggctcaaagtaaaaagagttttgtttatgttctgatagacacaaagaagccacaccatttgtagtgatgtgagcatctcagccattttcctaaatttgtcttgatgtccaacttctgttctggcctcgaaacttctgcagtagttggttcttcatttccttgttgtggctcaacattgggaaagaatgggaaatcagtctctaatgagtatgtggggaaattcctattgatagtctcatcacatgccgttttagaactgtgaactgtgggtgtcacagctcttaggtaatgtctcattattggatttttattttattttattttatttttttgagatggagtcttgccctgtcgcctgggctggaatgcaatggcgtgatctaggctcattgcaacctccacctccccggttcacacaattctcctgcctcaacctcccgagtagctgggattacaggcacctgctaccatgcccagctaatttttgtatttttagtagatgcggggtttcaccatgttggccaggctggtcttaaactcctgaccttgtaatctgcttgcctcaaccttgcaaaatgctgggattacaggcatgag

SEQ ID NO: 87587 - DNA, 1586 bp, Homo sapiens
ttcatcctatattcttttgaaattattgtcaatgattcatatttttagtttaaggactacttcctgagtgggaaataaatatctgaagatacttagctagattaaggctgatagaaggaattttctttttgcaggctagttcttgttttgttctttcccctgtgctcaacttttacagaaattatatgaagggtttgaggggtttatttttgctgttaaaatcaaatcagaactagggaagaaaaagtggctgtcatagaagaggacttctgagctgctttaaaacttttcaatatattactgtttgatgcagcacatagtagtctaccacttgtatgctatatttacttgagatttacctgcatttgatctttcagtgaaataattactgtgagttttgttctacagaaaattgcctcctcacattttagtgtttatggtttcacagcctactttttctttttcagcagaaatgatggaagaattgcatagcctggacccacgacggcaggaattattggaggccaggtttactggagtaggtgttagtaaggtgagtaaaatgatgatcatgaacactattcatattctaatttaaacacattttttaaatgattaagagcaatttgggtaggcccttctgatagtttgcaggggagaagatttgggtcttaatttcagtgaacttttagatcctactggtcattccagtagtcatttaacatagtaggtttgaaaatgttctatatgggaatatatgtttcttcttcctttctggtataggagaggtttctcatggttcttgttacaaggaaactaacaggatgtgtgtatagattctatgccatattttgttaaaacttgtcagccattcagaaagaaaattacaaggcattgcatagctttgttacattggactttggaggtagttacatggtagagtattgaaaaattggcctctgtgaagtctgcagactctttactggttgcacccccagactggtttgttgctcttctcattcttccttcttagtttttatttttgttgcaggagcataatattagattaggcccccattaacgggcacgtatgaagttaagcaatgttatagtttcctatgcatgtttatgtacccactggtccacccctctgctctcataggatgattttacaatgtgtaaaatgtttgattttaatacagtatgcaaagtatatttacgatattttatttaaaagctttattggtccaagatcatattacttgggcttgagatgtgtgaacgtatgagctactgaatttttttttttgagacagagttttcctcttgtcgccgaggctggagtgcaatggcgtgatctcggctcactgcagcctccacctcctgggttcaggtgatgattctcctgcctcagcctcctgagtagctgggattacaggtgcccgccaccacgcccagctgatttttgtatttttagtagagatggggtttcaccatgttggccaggctggtctcgaactcctgacctcaggtgatccacctgcctcagcctcccaaagtgctgggatcacaggcaggagccactg

SEQ ID NO: 87588 - DNA, 1001 bp, Homo sapiens
ctcttgcctcagcatcctgagtagctgggattacaggcatgcaccaccatgcctggttaattttttttatttttagtagagacagggtttctccatgttggccaggctgggtctcgaactcctgacctccagtgatctgcctgtcttggtgttccaaagtgctaggattacaggcatgagccaccacgcccaaccagcttgatagtttttgtttattcaacaaatattgagcacctgctgtatgctaggcattgtgcaaggtgttagggctgatgcttgagcacagtacctccacatctgcagtatggggagagagagatgataccgtgatgagatctgtattagagctgtgacaaggtgctgtgggaacacaggatttgttacatattcttaatttctttggccacttaaacagtttacttttgtggcactttagagtggctgtgcccctggacgttgtatactgaagttacatttacaaatgtaaactctctgatctaggtgaagtagcttcaaatagaagtgagcaatatatttgaatactaaattgatctctaaatgacctctgatgtgtctttttaacttgaagattgagcataaggctaatgtccagatctgtctgtttaaatggtccccccacccccgcctcccgtaagtcagtaagtttgtattcaaattttacatagttaagctcactgatctttggattagggttgttgttctgtttttaggttcgtgatggctgtattcaagtatacttttgatggagtagggcataagtgataagaatgagtgacattcaacatgttgctgtctagacccaacttaaagtcatgtaactaaggtatcagaaaactttaatacagtaacctatctgtttaataggaaattctacctttaacatagaaagaagttctctgtacagaaaaagaaatttacctatttccagtttttttgtttgtttttgagagggtctcactctctagcctaggctggagtgc

SEQ ID NO: 87589 - DNA, 1023 bp, Homo sapiens
cgcctgtaatcccagcactttgggaggctaaagcaggcagatcacgaggtcaggagatcgagaccatcctggctaacacggtgaaaccccatctctattaaaaaatacaaaaaattagctgagcttggtggtgggtgcctgtaatcccagctacctgggaggctgaggcaggagaatggctgagcccgggaggcggggcttgcagtgagcctgggcgacagagcaaggctccgtctcaaaaaacaaaacaaaacaaaaaaagaatatcactgtgttgatgacagctttgtttttcaaagatcaaaaaagatttcagcccctgcagctccaaataagagagcagagtgacttccctgtgatggtgccatctagtgggactggttcagcctcttgggctgtctcttgaatttctcctaactattcataacatttttcagtactttttgatgtccatagaaggaagaaagtcagtgccactgtggattctttcctagtggacaagagtgttacaagtagctacagcctttgaactttctggttgttgtaaatcttctgttgtataactttcgagttttttccacctgcaaattagatatacactccattacttagactaaaacaaaatggccaaatctccacatctattacttatatttaagttgctcattacctatatttaggtttttaattttttatttctaattttcttgcatagtgcaaatttttaattttcttgcatagtgtgtttataggtaggtactcagtttctcagcatatttacttcataataatggtaaaacaaaagtcatttattttgggctttgggatgcactatttggtttttgtttaaaagattgacgttttctgtcatgaactgatgaggggaaagtagtaatgtgcacccaaaagtctatagcaggctctctagtctagctgcccctttttaggaggacctggagccatcgtcttagcagttttgaggtgataaggttaaactgggttgtgaacctagtaattttctgg

SEQ ID NO: 87590 - DNA, 1050 bp, Homo sapiens
aagtagggattgagcagaagaagggagcccctgcctctgagagtacttgcctgagacagcctcagcaacagaagtcagggcaggatgagaaacactgaagtcgcattcttcccaggaataaagaaagccctcagggatgggtgcggtggctcacaactgtaatcccagcactttgggaggtcgagacaggcagatcacctgaggtcaggagatcgagaccagcctggccaacatggtgaaaccccatctctactaaaaatacaaaaatcagctgggcgtggtggtgggcacctgtaatcccagctactcgagaggctgaggtgggagaatcacttgaacccaggaggcagaggttgcagtgagccgagatcacgccattgtattccagccggggtgataacagtgaaactctgtctaaaaaaaaaaaaaaaaaaaatcatcaggcttcttcttcagttttgctatcctcttaggattaaaatttatttatttatgatttttttttctttcagggaccacttaatagtgagtcttccaaccagagcttgtgcagcgtcggatccttgagtgataaagaagtagaggtaagaagctatgttcatggcaggacttttcatacttgtacgtttgggccaggtttggtggctcaaggctgtaatcccagcactttgggaggctgaggcgggcagattgcttgaggctgggagttggagaccagcctgggcaacatagtgagaactcgtttctacaaaaaaacttagcagggtgtggtggtacacacctgtggccccagctacttggaggtcggaggatcgtttgcacccgggagaatgaggctgcagtgagctgtgatggcaccactgcactccatcctgggcgacagagtgagacccccatctcacagaaaagatagcactgcttaattaactccctgggtgctgttagactctgtgtaaattgctcccctttgagctgtgtgctctttgcatacgtacagttatgatgtggccctcacgggtttttattataatcatgtgtggatcttacatg

SEQ ID NO: 87591 - DNA, 1175 bp, Homo sapiens
aagataaaattgattgactgattttatttttacaacttttttcgagacatggcctcgctctgtcatgcaggtcagagtgcagtggtgcaatcatagctcattgtaacctgacactcctgaactcaagcagtcctcctgtctcagcctcctgagtagctaggtgccaccgtgcctggctaatttttaaaaatatttttagaggcggggccttgctatgttgcccaggctggtctggaacccaagccatcctcccacctcagcctccaaagtgctgggattacagacatgagccacagtgcctggcgaagactttttgttcatttgcttaactattcacagccctcatgcatgagattttttttttttatttggcatataacctagctgcctgtagatgggtctaagtgtaagtctgtagccacctactttgtactttgcagatctctcctttttggaaaaaagattggatttaaagtagaagtagtgtaacaacagttttctgagaacttaacatatggtggacatttgtcctacatttgtgctctattaaatatcttatgaaggttttgtagcagctctgatttacagatgaataaactcaagctctgatattttaagcagtttgccaaaaattgtgtggatggtttggttctagaccctaatactctttgttatactcagttttaagaggaagacagtgattcaggacttgtctgggccagttatatctgtttatatattcaatattttgtgtatactcgctgtttttcctaacgtgaaaaatttaccaaaatgctaattgtgacttatatggtatttgacagactcccgagaaaaagcagaatgaccagcgaaatcggaaaagaaaagctgaaccatatgaaactagccaaggtagtaataatttcgtatcaacaaaagtactcaattctaatgtacttagatagaattttctaactcatactaaataattagtttgtacacagggattcctgataaaggaggtttgtgtatcttaagggaatatcagactgtttattacagacttgccatttggtatacacctgacagaacagtgttagttcttcggggactcttttgttttccctgttgtaagctaacaatcttcttaaccacaggtttttctttacaccaaatatatattgtacaaaaaa

SEQ ID NO: 87592 - DNA, 1107 bp, Homo sapiens
gttagatcagtgatttgttaatgacagccagctaaaagtgcttcatttacattactgtcctttctgcctactgttcttccgtggcagttgtttagttgaatattggaacccattgggataaatctgtaaacatgatggttataatgccaaatatctttatataatcaaagaaagaaaaaatggcttggctttttttcctcccattctaaggaatagaaagcccagtcttgttgcatccttcttatcttttaaaatctacagataattcattttgtctttgggagcaaaattctcccaaagtgacaagaaaaattacagaatcttaaagctgtgaaaaattcttcctttcactgcttgttcagtcctttattttatggaggaaatagtctgttcttgggctaaggtattttggctcatttgttacaagtaaagctgacacttgggtttatagcaatgtatgtagttactgaatgtatagtacattttagtgaatgatggtttatatgtgtattggaaaaactgtatttactttggtttcattttcagggaaaggcactcctaggggacataaaattagtgattactttgaggtaagttacattttttgaaaaaacaaacaaacaaaacaaaacaaaaaaactctatagtgattttttttaaaaaaccctaaatccttgtgttcatttgaggctttagaaagtaatattttggccaggcgaggtggcttatgcttgtaatcccagcactttgggaggccaagatgggaggatcgcttgaacccatgagttcgaggccaacctgggcaacatggggaaaccctgtctctacaaaaaacagaaaaaattagccaggtgtggtggcacacacttatagtcctggctacttgggaggctgaggtgggaggatcacttgagcctgagaagtcgaggctgcagtgagccatgatctactgcactccagcctgggtgacagtgagaccctgtctccaaaaaaaagaaagaaagaaagaaagtaatgttttgcctttactgtactcttcttccctttctccccatcttcatcagttaatgctgccccatctctcaataagagaaaactgctgctgcc

SEQ ID NO: 87593 - DNA, 1071 bp, Homo sapiens
aaaaacgcttttgctatagggtctttgtacttgttattccctcttccaggaacattcttttctcagataccagcaatctcttcatcaggttgttgctcaaaaatgaccttagctaagcggtctcccttagccaacttctctaaaatagcagtccctcataccttgtcaatttgttcctaactgtactttattttaattctaagttattggcacttgacacacccatgtacatacattttaatatatatttaaatttttttgttgattcatatttatacgtacagaagagtacacattgtaagtctacagttcgcatgaattttcacaaactctacaagcacaagaaatattaccagtgctgcagaagtccccctgagttccctttcagttactaaccccctccctgccgctgtggctagccactagcctgacctctaacaacatagatgaatttttttttgtatcttgtgtaaaagacattcagtgtatactcttgtgtctagctccttttgttgcacgttacttttgtgaggtttatccatttcattgtgtattttataggtcatttattttcattggtgtgttataagtttaattttcatttaataatttatatattttaattttgtactatataattagttaattgcccatcttccgactagattttttttttttgagacggagtttcgcttttgttgcccaggctggagtgcagtggtgcgatcttggttcaccgcaacctccgccttccagtttcaagcgattctcctgcctcagcctcccaagtagctgggactacagacacgcgccaccacgcccagctaatttttgtatttttagtagagacggggtttcaccatgttggccaggatggtctcgatctcttgacctcgtgatccgcccgcctcggcctcccaaagtgttgggattacaggcatgagtcaccgtgcccagcctagaatgttaatctcataagaatggggattttgctttgctttgtttactgctgtctcttgttacataaaggtgtaatttttaaactaatttcccccacttgacatgtaagca

SEQ ID NO: 87594 - DNA, 1008 bp, Homo sapiens
ttggtacttcttttacctgtcttatgttcctaatttcccttagattttgctctggcagatccctaatactttatcaactcttcagtgcttttaatgtttttttgttgttgttgttgttgttgttcgcccatattttatcctatctgtatagtttttttccccccccagggagacgttggttcaaacaggaaaggctgtagcctacatagtgtatttacagaaatgtttttaaatctttcaatccttggcaggtatttattgaatatatggcagaaggtttaattttactgttgcagctcgttctcccatgcagtgagaatgttgtcatcaatgggtatcacaggtgttctggagcctgggtttaaactgttacatttgctggggtaggactctactcatagattcaaaaactaatttctttgtcaggatcattttacttttattttttttgacatgaaaacgttaaagaactattcctgattaaggaaaattatttcctttattcatgcagattatgaaagttcaacaattcagaaatggtgaaatagaaagttccctccaaaagaactgttattagagagtatggtgggcaaatatttctagactttttgagatatacatgtatgtttatataataggttttcttatttccattgtattagtttatttaaccagtatcttgtaagcatttatatctataaatagtgctgcaatgaacatccttatacatacttattaacttacgcatttttcctagataaatcccctaatagtaattcccaggtcagaatatgatcatttaaaaatgtcatcacataaattgctagaaggttattagcagtttgagagtaccaattttttcacaccctgctaataatactgaattttatcattgtaacctttggcataaagaaaaataccttgttttaacttgcatttgttcattagttatgtatattaaacatcatatgtttaatggccttttggatttctcttttaatgcttgtt

SEQ ID NO: 87595 - DNA, 1026 bp, Homo sapiens
tgccaccatgcccagctaatttttgtatttttagtagaggcagggttttgccacgttggccaggctggtctcaaactcctgacctcaagtgatttgcccatcgcggcctcccaaagtgctgggattacaggcatgagccactgtgccccgcccatggtttatatttttaatgtcatgtttaaaaagtcctttaccactagaaaattctaaaagcatttgtttattttttcttcttgtaattttttatatatgataaaaggtaggaatcttcttttccctttttttctaatatctgcacaaacgtcctaccatctttttaataagttcccgctaatatgaaatgcacattaatcacaacttatatatctatattatatagatctgtttctgaattctgtattctgtgccactggtcaatctgtctgcttctgtatctgtatgatactgttttagttaatgtaacattgtagtatgtttcactatccggtcaagtttccctgatactttttctcaaaaattatgtggctgattatgattatttttttaagtgaaccttagaatttattgtgaaattctacaaaaacaactgcccaagaaagcatgagagagaacctagatgaccactataccaccataagactaccccttggaagagaaaaaggccaaacacaaaatttaaaacattaaacttgggttttagagaaatttgatgtttgtagaatctgaacccaggaacatgatattaccgtttaacttagatcatcttttatattcatctgtgaagctgtatagtttttcttcaaaggtgttctgcatgtttcttaagtttgctttcaagtattttacagatttttgtttgctactttgaatctgcttttccttctgttacatgctctgattaaaatcagttggggaagctatcaattttagtgtatttattttgtatttggccatcttactgagctccttttaattgttatagtaatttttccattgatttgcttggtttcctttgtgaatggttat

SEQ ID NO: 87596 - DNA, 1081 bp, Homo sapiens
atgtattatccttttagtatactgtggaacttgttttgcttgcatttattttagatttttgcatctaaatatagtacagcaagaacagaattgagagtgaaataagcttcacctataaagtcacgtgacaggccaggcacggtggctcatgcctgtaatcccagcactttgggaggctgaggcgggcagatcacctgaggtcaggagttcgagaccagcctggccaacatggtgaaaccccgtctctactaaaaatacaaaaaaattagccaggcgtggtggcaggcacctgtaatcccagctacttgggaggctgagacaggagaatcgcttgaacccaggagacagaggttgcatgcagtgagagcagagactctccattgcactccagcctgggcaacaagaatgaaactccatctcaaaaaaaaaagaaaaaagaaaaaagaaaaaaaagtcatgggacaatgtcttaattttcatttacctacaggatagaaataatatttcctgtgtagggttgagggcattatgaagttgatttgtagaattctacaaagtaacatgtaaattcagactctcataaatatagaaccattaaaatataatgtcaaagaatttgagtaagatagtcacatttttagataggttataatacaatgataatgttggtatgctctccataattatttttagagaggcctttttaaataaaccattcatcttatatttgataactgtttttaacccgttgcatgtttgggcagtatcagattatctttctcatgtcatttgtgtgtttctttactgttttccagcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagtgagtacaaagcctaagttaattcatatcctttccattgccctagtgctccttgatgaggttggattaattattttgatagagagatagggacattt

SEQ ID NO: 87597 - DNA, 1031 bp, Homo sapiens
gatgctatagccgtgttgttctcatgtggaaagaggtggcagagactagtaacaaaatgatcatgtatgaagaaggaacatggaaacagtatgaaaaccaaaagtctaaatgctctggtacagttttgtttctctttgcttctcagcagtaccagccagcatataagcttagtagtataaggaaagaaaatagtaaaagggttagtattaatatacaagtgtaaatcagcaaaggaaagcagattcttagaaaagtaggcaaagactgtttttgaaaagaaggcaagtggctaataacatgaaataatgctcaattttggccatagagaagtgcaaaataaaacaagataacatttttgacctagcaaattggcaaggattaataagtttgatagttcttggtgtaggtgatagtttagagatatattcagttttattctgtctataaattgttgaagtcatgtggacaacttggtaatgtatctcaatgttaagtttacatatccttgggtccagaaattccattcccataaaattacacaaagatatttattgaggtattgtttattgttgcaaaaaatctggaagcagtttcccttccagtatttcagaggatatgaccttcgcatcagacctcatctgacgtaattcattagcaactattgatcacttctttcttctctaagcatacggtctttcactcggcttccactcttgatttttcctcacattctctatctctgaacattagagtgttccagggctctgtcttcagactcatttatctaccttcattttcttcttaacctccctctctttttttttttttttttttcaattgagacagggtctcactctgttgcccaggctggagtgcagtggtgcaatctcagctcactccaacctccatctcctgggctcaagcgatttccccacctcagcctcccaagtagctgggagtacaggcgttggctaccacgcctggctgatttttgtttttagtagagacagagtattgccatgttggccag

SEQ ID NO: 87598 - DNA, 1517 bp, Homo sapiens
ccacagccttctacatctcaataactgtcaacttttctccttctaattgttacagctaaaatccttggagtcattcttgtctttctcttctttttatattatatgccaaatccaaatctatcagtaaagcttattgattttaccttcaaaatatgttcagaatttttttttttttttttttttttgagacagagtcttgcgttgttacccaggctggagtgcaatctgggctcactgcaacttccacctcccaggttcaagccggttctcctgcctcagcctcccaagtaactgggattacaggcgcgtaccaccatacccagctgatttttgtatttttagtagagatagggtttcaccatgttggccaggctggtcttgaactcctaacctcaggtgatccacccgccttggcctcccaaagtgctgggattacaggcatgagccactgcatctggcctgtgttcagaattttaccacttctaattctcttcactactgccactccaacttaaaccattgtctcccactgagataactggacccattgctttgatctttgttttcttttaatctgttcttaacaaagcagagtgattgtgttgaaacgtaagtccagtcatgccactcccctgtcgaaaagtccttaaagtggccctgcatggtttgttttcctccaccctgacatgttttactaccatctacctttctcatcagattccatgcacgctagccaccttgttttctcaaatactctctctcagtgatgctctcacctcggggcctttgcgttggctgttgcctttgccctaacattcttcacccatatatcatcatgccctgctctctcagttccctctggtttctgcttatatttaccctattagagaggcctaccctggccacactataaaatagcaacttctccccacccatcccacctgttactgagctcctaggccctgcgttgtttttctccttagtctacaccagctgacgtactatgatggacttttgtctgacttccccccactggaatgtaagctccatcaggtcaaggactttgctttgttcacttgtgtatctctaatgcccagaacgggacctgctctaataggcactcagtgtaattatatgttgcatgagttagtaaaagcattctttatagaaggactggttaaatgaatcgtaatatatttgtacagtggaatgctatacagctggcaaaagaagtgaggtagctgtatatacaccaatgaaagatttctaaatatgtgttgataaaaatagcaggtggcagaatattaagaatttgatcttttaaatgtttaaaattattacataattctatgttttaacataggaaatttgaggttttatttttaagagagaggtctcgctatgttgcccaggctggggtacggtggctatttacaggtgcaatcatagcattatagcatactatagccttggaacttctgggttcaagcaattctcttgcctcagtttccagagta

SEQ ID NO: 87599 - DNA, 1002 bp, Homo sapiens
taaggattaccattttaatgtcaaataatgtgttccttatttaatcttatttatttattggtggagacagggtcccactgtgttgcctaggctggtcttgaaccatcctcctaccttggcctctcaaagtgtggggattagaggcttgagccactgtacctggccttatttaatcaactttaagtaagatctgtttactcctcgttatgaaagacaaatttaacataactttcacccagtctttctttctttttcagttgtttagttattgttacagtatgagtgtttgatatttagtttgttattttaactacaattgagtcttttctgctttgtaaattattctaagacttgaaaagaaggaacatttacaatattatgattgtttcattgtttggcattgcaaaaccaaatgattttattggactcactgaaaagaagagagacattgaattagtttagattgaaacagttctggttgtcaaggtctactggatctttttttcccttaatggcaagtctgttgtttccttaaaacttgtgtcttttaacattatgcagatgttcttcaaaacttgattttttaaaaaggtagtttgctttttttatgccaaagtattttaaaatacaattcagaaatcttgacctcctatctctaaatagttaaataggcatttttaaaaaacatgttaacattttgctagatagcgaaattagcattataacatgtctattagcatctataaaatagaactttcttatcatctgtgcctgttgctctacactgacatacatttctagaaagacaggctaaatgcttagttctttccttttaattactaatgaggcttttaaatttttttttaacttttaaagtagggagttgtttgatagctgtgacaaatagctttctctttgattatcatggcttcatggattttcatgggtgtacatcagtaaatagaatcgttcttttttggtgccagttggtcacggctttat

SEQ ID NO: 87600 - DNA, 1019 bp, Homo sapiens
acagtcctttacatgcatcccctgtgcattggatgcttcactagccttttctgactaaagcatatgaaaatacaagtgaaaaaggcaagttattacaggaataacttttcattttctctaattttcatattttaaaaattcatttgtaagcatttgatactttaaacctgtttacaggaacttggtataaaccaccatgtccagccctttgtctcatatttgaattgttttactttcttcttggccacgtggccctgacttctcactttcataagaaggggtttgtattgtggagatacaaattatggagttgtttgcattaatacaagtgtttgtggaaaaagatgccaaactttcctgtgattggtaatgcacctttattgtaggctcagcaaaacagtccctcatctacgggatctggcaacacagagcattcctgcagctcccaaaaacagatctccatccagcacagacagacccaggtaggttggtgatcgataatcaattgaggggcatacctgctgtgtaggaataagggctaacctgtgtagtctgtcattcttctctgacttctctgtatttctctgaccacctcattatttgtgtgtattatattcataacttgcattatgggtatttaaagtcctttggaaggtgctttaactttttgaggcttttctttactcttccggtgtattgtagcagaaatgcttatgctaaagcatggtgttaaggaaactgcacaccttttttttttttttttccctacagtattccacagaagaaaagtacctacgctttgaaggcctctaagttcagattctggcctgggcctcagtttttcttagtacaaatcatctgtgaaaatatggttgattctcatgatctcagacagtgtatacaaaatgtttattagtagtgtacttgtagtaggctttcaataaatgttaattctctaatttatgaaagtagttaatgtattccttttcctgcttacttatttatacctggctaaactt

SEQ ID NO: 87601 - DNA, 1050 bp, Homo sapiens
aactccctggagcacatttgaattttatctaaatcaccagctcttgtacagttcagttagatagttgagcactcaggtagcttcttctcttcccttctgattgctctctgtttccaccagatggcgcatttgttccttagagagttgtgtgtcaagtctcctgtgagatccttttctattcaaagttagtttcatttctggagtaacgtgtttctacattgttcagtgcacagtagtgagaattcatacatttgattccagaattaacatgtgtttgaagtgtaggtgtagtgggacataaggaacccagcagaggacttgaagaatgagatgagacaagcagatttcatttcttaagccatgtgattctaggccatttgtgtgagcaagtgctttttcccacccccccgagaaaggtaatgagaagagtgtgatgacatataacatgttgagactaatcctaaatttgttttacctttgtctctgtagtccgacctcacaatagaaaaaatatctgcactagaaaacagtaagaattctgacttagagaagaaggagggaagaatagatgatttattaagagtaagtattaaaatgtaagagattttatagcaagcaccatttgttatatatatttggattatgtacatatcatagaagtaattactatagccaaataacaatgaaataataaacatttgggtatttttctttaattgagggaatctgagtaggaaccaggttcctgcattctaaacactacctttaaattggaaatcttatactgtagtgttttaatgattgaatttatattggagaaatagatatgtggagtgttatatttcatctagaactgtgggaataagtataaagtgttgttttcccattccagagaagttattttaatattgttgaattttataagctatttcaaaggacttattagcccattttgctttttgtaccttttataacctactcacccaaacttttttgtgcttacaaaagaaacctttaaaatgcttcatctggaattaaatagataccact

SEQ ID NO: 87602 - DNA, 1031 bp, Homo sapiens
ccatgtgtggctaatttttttatatttagtagagatggggtttgaccacgcaggccaggctggtcttgaactcctgacctcaagtcatctgcctgcctcggcctcccaaagtgctaggattgcacgcatgagccacgattcccagctttaacatttttttaattattattttgtgatagcttaggtgtttgtgattacaagagtagctgtaactggttattggcaggagcaaaatatgatcagtagaaaaacatgcccaaattagtaattcaatttatcatttacaaatagatgatatgttatgagagaataaaggaatgaattatttactttttctaagacatagttacttcttacctgtttgaactttaattttgcttttgataaaacaacatatagaaatgatttttttttctctccctagaaactgcttttccattaatcttcttccttggagctaattaaaaatttttttctcattgaaggccaactgtgatttgagacggcagattgatgaacagcaaaagatgctagagaaatacaaggaacgattaaatagatgtgtgacaatgagcaagaaactccttatagaaaaggttagtgaataatgttggtctaaactctgtatcccaagatactcaatgtgtgtcattgtgtggcttcttattccttacttgagatgaaaatatttaaaagtagagctttttaggaacatgatttgacaattagaattttttccttacatggacaccagaccaaccatccagagtgttaatttgggatatgctttgttgctgtgcattgctttgagtgtgatattgaacagagacagcttgtcctagttgagtttatttggggtattgctctcctatattcttatattcattctatcaattgaagtgagtatcctattactattagaatcattaacaatagttgcatttttgtttcagagatggcatttagaataacttatgtatataataatgtgataattaatgctttgtgcattaaaaaattaaagttgtcat

SEQ ID NO: 87603 - DNA, 1103 bp, Homo sapiens
catcttaaaaaataaaaataagtagaacttaagtcaccaagtgtaatccatacttaaagatgagaaccgaaccagatagataacctgatttttgtaaaaaatgtttccatgtctaaatgtatatgcacaaaacattcctgaaaacttatgtaagaaacttaatagtggttattacatctcaggagtgggcatggagaggagggaggaggagggtagggaacttttacttttcttactgaactcctctgtatggtttgaattttattattttctatgggctcatttttatgattaaaattcttaaagaaatctttcaatgcaaagcaccttcctttagcctttcataagataaatgtctgctattgtttttgaaataagatcccgaaaaggtaaagttccccctattttgtgctatttctttccttttcgctttaggaggaagcagagatccaggcagagctggagagactagaaagggttagaaatctacatatcagggaactaaaaaggatacataatgaagataattcacagtaagctacttcagggcatattgggttggagattgctaagcattttatgatatgaattgaatggtctagaataatgtgtttgcttaatgtaagttacataaatgattccatggtgtatttagctcttttgtagcatctaatacaattttgtgaacaaaattatgatttgccttggtttaaatatacaattgtattaaatttatatattaagtatatatgtgtatacatatagcatttttacatgaataaagattactaaaacaatatggctttgtaattgtaaatggttgagatatgttgcatattcagattttcctacagagccttaagaaagggaagatgggtcacagtgtggtgttgtggaaagagtattgggttgagatgacactcggtttctgaatgacctttaagggctattcaggtgttgagattttaagtaagactcttaagttcagtacattaattgtagatgaattgaaactgggaaaagtaggttgaaagtagaaaggggtttttataagtaatctgttttttccccatattttttggaccctgaaacattttttcata

SEQ ID NO: 87604 - DNA, 1036 bp, Homo sapiens
acttgtcatttctttatcatattattaagaaaatacccaaggtagagtctaatatggggaacacagttatatctgtcttaaagagagaataatgaatgcacatagaacatgtgactcactttaaaatcaaatctgtttttaaggaaatagcaagtgtcttggaattttactgtatgtagttttgaaatggtgggaacatgtggcccttgaatagtttggaggagccaaatagcacaatctaaaaatctctaatctaccctccctcattgtatagcagggcagaaaaaaggaggaggagcaagaaaggtctagtgtagctacactgagaccagcacccaagtcctgtggctctatagctggtgctgttcattgtaattacactgcctctttgaactgtgtaactttatactcagtatttgccatgttgatgttgattgtcaaactaccaacagcagctataattatatgtataatgtgttagatattctgggaattttgcaagcgtggaagactgtagtccatgatctcagggtgttacatgttccctgtttccacagatttaaagatcatccaacgctaaatgacagatatttgttgttacatcttttgggtagaggaggtttcagtgaagtttacaaggtaagtataaggaactggatacaaagactgggggttaaattatcggctcctaccaacttggagaacattaagaatactgataattgtaggttgatatccattggttgaaattcaaaaactttaaaaacctgtatctttgggaaaacagctttcaataaacctaagtgaccaagcagaatacagtattgccattttcaagtttgaaaaataaataattatagatttaaaaaacaagaaggaaatatactgggtcgtggaattatgatttttattctggttctgtacttcctgcctcatacatatttgttagaaaaaagtatgtgctatctttctttcttttacagaatagatgtgtcaaacctgtttccaataagaataggtttttttccattggaaa

SEQ ID NO: 87605 - DNA, 1478 bp, Homo sapiens
tcacgcctgtaatcccagcactttgggaggccgaagcggggcggatcgcctgaggtcaggagaccagcctgaccaacatggtgaaaccccatctctactaaaaatacaaaaattagccgggcgtgatggtgcgtgcctgtaatcccagctactcaggaagctgaggcaggagaatcacttgaacccgagagacagaggttgcagtgagccaagattgcaccgttgcactccagcctgggcgacagagcgagactccgtctcaaaaacaacaacaacaaaaccacttttcatttacccagcatatagagatgggactaaaggcagggctgttttttgttcttgtttctctttttattttaataaacaatatgccaaattacagggtggttttgtaaacaatcataccaaagaagtatattgtgaggggttattttctccaggaggcaggcagtgtgtgtccctggaatttcaaaagtgacaggatgtttgaagcttgtaaagtcccagtgtcaactgaaggataagagacaacctaaggcagacgggtcccagacaggaatagatggtgtccagaaagagaatggttgggaaatgattctgaaggcaggggctatctttctgtttgtggtgttggcctggttttatgttctaaatcccttggtgccagtgtgtctggagacttctaaattatctaatcacaagtttcaagaaggtgcttgcaacactgatataagtatgtgatgtatttaataatgtattttggactttgattatgttatatgttaaattaaagcttcacatcagttacctgtaatttttcttaacatttacccagtatataatttattctctttataggcatttgatctaacagagcaaagatacgtagctgtgaaaattcaccagttaaataaaaactggagagatgagaaaaaggagaattaccacaagtaagtgatacttgagtgtctgactttttaaaattaaataatacctgtagtttgagcattatgctacaagctttacgtgcattgttgttggttttgttttatgtaatcttcataactgccctgagagaataaatacattctcagtgttacgacgaggaaactgatgcttacagaattggagtaacaggaagtggctgagctggtatttaaatccagactttcctgaatccaaagccctaggtactcttaaccttcccttcctttgtggctagaaatagctatagtaaataaagccttagaaatcatttttgctggccgggcacggtggctcacacctgtaatcccagcactttgggaggctgaggcaggcagatcacgaagtcaggagatcgagaccatcctggctaacacggtgaaaccccgtctctactaaaaatacaaaaaattagttgggcgtggtggcaggcatctgtagtcccagctactcgggaggctgaggtaggagaatggcgtgaactcgggaggcag

SEQ ID NO: 87606 - DNA, 1416 bp, Homo sapiens
ttacatcaagcacataacggacattgatgagtgctttaaaaattcagtattaaactaaaaagtagtacacttcagtgttgtgacattataaaatatgaaaatgctataaccctgctagtaaggtctgttaattgcgtttccattcatggggatgacttcccagtcccatctggaatcaagacatttattctggtaaaaaagaaggcagatttcaaaagaaaataaaaggtgtttgttttgttgtattttgaattttgttctgtcacttcattcctctcctcctcctaccataagcaaacaaaaagtaaactgattgttttatttatattataaaaacaaattttattaaaaatttttattttaaaaatttagtattacgactgctttaactccctcaaataacatattaaaaattctgccgtaggaaaaatttcacttaaaattatttgcagaagtaatttgtatcggagttagtatgcttttgtatgatactctattctaattttttaaagataaaagtaagcattttgaaaaatctaaatatatgttaacttataagagagtaaaagacattttggtggatgagtttcttccagtttctcattaaattctctgtatttgtagtgcatggatctcttggattataagttgaaagttgaacatggctcagtcattgccttgctgatgaagtaagagatgcggttttagagctgggcacaggttcagcgacactctgcaaattcccttaattggcgagaactttgaatgacattttgattcttaaatttttgctgccttttgtttcctgtgttttctgtacctcaacaagagaaattggtttctgctgtaaaatgcacaaaatcaagaagttaaaaccaaagggtagagcgctatacatttatagcatgctagagtgaaaaataacttagaacagtgatctgtttagtccctagatttttaaactttttgtttgttttttgtttttttgagacagagtctcactctgttgcccagactggagtgcagtggcgcgatctccactcactgcaagctccgcctcctgggttcacgccattctcctgcctcagcctcccgagtagctgggactacatgtgcctgccaccaagcctggctaacttttttgtatttttagtagagacggggtttcaccgtgttagccaggatggtctcgatctcctgacctcgtgatccatccgcctcagcctcccaaagtgctgggattacaggcatgagccaccgtgcccggcctttaaccttgaaaaaaaaaacaaaaaaaacaaacagcagcaccggctgggcacggtggctcacgcctgtaatcccagcactttgggaggcggaggtgggtggattgcctgaggtcaggagttcaagaccagcctgaccaacatggtg

SEQ ID NO: 87607 - DNA, 1597 bp, Homo sapiens
ctacctcagcctcccgagtagctgggaccacaggtgcgcaccactacgcccagctaagttttatatttttagtagagacggggtttcaccatgttggccaggatggtctccatctcttgacctcgtgatccacctgcctcggcctcccaaagtgctgggattacaggcgtgagccactacgcccagccagagcacctattattttctcaatggcttggtagattccagtggagaaaataggatgagcaaagagaaaagtcagatgagggaccagatggacctgaatggaattaacatgtggagacaatagagaaatgattgaatatttaggaggatctttgaagagttctaaaaggcaggccaatataccttcttgttaattttcccttttgtttacaggcatgcatgtagggaataccggattcataaagagctggatcatcccagaatagttaagctgtatgattacttttcactggatactgactcgtaagtgctgtgctgttttaccttaacagttatattattttcttgcaatgctgattgttcatggaatagagctgaactctgggtccaggacataccctctgagggaaccaagtaatttgtgacaaatgatcaaacataaattcagatttggatcagcaagaaacctctaggccaaaggacatgtgcacttgtgtgccagtaaatgtttaacagccagcttggtatgaagagagacagggctaatttatagtgtttgccagtttccgtggtgtagatattcctcctgtgtctaattttgatgtaccacctgtttatttttgtttttttttaaacatcttaattataattcacatactgtatgattcacacatgtaaaatatacagtttagtggtttgtagcatattcatagatacatgcaaccaccagaggcaattttagaattttttcaccatctcaaaccccatcataccttttactactattcatctattccaccattccatccctctgccctagccctaatctgtctgttttatctttatagatttcctattctggaccctcatatgcatggaatcatatagtatgtggacttttattactggcttctttcacttaccatggtgttgtcaaatttcatccttgtagcctgtgtcagtacttcattcctttttatggcaaaataatattccattgtgtggatataccacattttgcttataacggtttgataaccagctcacaaaattcttgaaaatttaagtcagctcttggaaactggcatgagttggtgccagcatgccactgacgtgcactagtgagtgtagactgttcaagagagtttctgctcaccccagagactcttatgaacattgacagacctttttaaaaagtactggccgtgtgattttatcctagactgagataagaaatgtggcactaatgaagacaaggctcagtgctacatgttgaaatacaggctcataggcttataggatgttagaataggaagggatctcagagtccagccttttcattttataggtggattttgaggaccagagaagttaaataacttgtctgagatagttattaattgtgggcatt

SEQ ID NO: 87608 - DNA, 1232 bp, Homo sapiens
ctcccttctggcctgcttgcctgagggtgctaatggcttcctgctgtagatgatctctagggtgcctcactgaccagtttgtcttctcagctcttccatcatctgtatgatcagttccctgaattaaagtctctctgttttaaatgttcaggtggtttttttttccaggctaaactgactgatacacccacattgtcacaacttagaaaacttcaaaacgtattcatccctcaggaatattcaaacagttcaggacaccttacttcagagtataatgccttggaagatagacacgtgacctgtgatgccaccaatggcatatggttttatgtatgggtctgtatgacatattgacataagggaaggaaagagaacccacatacttttgttagaaccatagatactatactttacaagctcttttacaccttgtgtttaagagaaattgtagtgcagtattgtgccaagctgtcagaagacgtagtatgcagtcagtttttgggacgtgggcaaactctagattcttactcattgccagcactcagggttatataaaatgtttgcagtgcgaattgtgtacctagccaaaattgcgccactgcactccagcctaggcagcagagtgagacggagtctcaaaaaaaaaaagagagaattgtgtacttgatcacattctggttgtttagacgtggatgtgtggcatgggtgtgtaaaggagccccttccaagaagatacctagcttaaatacattatagttcttatcagtattcttatagtctagactcaagaagaggtctgccatgggtgaacttgagcacaacagattccaacattgagggtgtggaaactcttcaagagaataagcagtttcttaccagaaacccctcagctaatactgaataaacaattgaagagtattttaaggaacaaagaagaaaggagtgagaagctgatgacctgaagttttcacatgggactaatttaggtagtgttaatctgcttgctcttattccatggttaaatattggtttatttgtctttaggttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtatgtctaacttttagg

SEQ ID NO: 87609 - DNA, 2375 bp, Homo sapiens
ccttctggtgttgcaaaattgtaaactttgctttactcttctggtaggtgcatattgcgtctcattgactattctctaatgttctaatacaattcagatgactaaaacattaattatgatgaagaaattttttaaaagatggctattttgtgaatgaattttccataactgaattcaacactttcctgcaatgggagctgtaggcggtgctgtggtgctagctttggtttccttacatggtttctttgattcctcccccacaccccaagtgctgttctaaacagggtagtttagagatcctcactgaaagttcagatgaaagtttcccatcagttttgaccaagtgaacaagggtattttactttggccagttatttttatttccagagctcatcatagtggtggttttggcacattaagcaggtgattcttggaaaatagaagtttcagcagatgctgaggactctccctgagtatccagagtccagattgcttgattcccaggatttggatgtttgcttttgcaagagtttgagttcagttgtccccttcttatctgctattactttgggtttttctcttaaatcagtaagtctctgcttattcatgaaggtttttattttttaggtaatattcttttagtaaatggtacagcgtgtggagagataaaaattacagattttggtctttcgaagatcatggatgatgatagctacaattcagtggatggcatggagctaacatcacaaggtgctggtacttattggtaggtatccaggagctctgccaggttggctatagagatgtggctctgctatgctgaagtgttgataatgaattaattgctgtatgctatctgctaggcaaaaatgccataaaccaaagcagactttctccccaaatcattactgtcttttcaacagtttgactcttggtatttatattaatttgtcttaatttttctttcctttcttgaaaatccttaagaaagagagcttatatgtgtccaggtatttgaaatgtatgttttttgtacagagttggccttgcaagtcagtagagaacaaggttgctcatgtgtatataaagaatggccccaaaatctttccgtccaaatacaggtctctcttcatgggttaatgggataagggatttgtctcaagagttgcctgaggatgttggactgtagggagttatgaagatcaggatgaaacataactatagcgcatatgaaatctatacaggaaaaagtgactacaatttaccagaagtttatccatgtctgttagccatgatctaaaagtttttgaggcacatttcttcacatctcttgtcacctgtcttcccctagccacccgcacccaagctacctctgcctgccagttttatgcttctatttctgcctactattacctttggccattagaaccataaaagatacctgaaactcaggcctttaactctatggttgtaaaagtgtgttaataaagcttcctcttccattttgaggtggtcacacaagccacatattggtgtatataaagaatggcccccagttttttttagtccaaatacaagtctctcttcctggcttaatgggatgagggatttgcttcaagagttgcaagagaaggctctatagcaccaacggaggggcaacacatgttatttgtaccctagggaaggtggtcaaatcactttatctttggaactgaaaggtcctaggccttagcagagagtactgactgtctgggaatcagaggtagaggaggaagcagaggggcatggcgttcacaacacagcatcagccctgtgctcatcgtgaagcctgccaataacaccatggacacaatgccccggtttctgttgctccttactgcttgtggaaatggtacctgttgtaaaaagtcagtccctaaattaaaactttgaaattacagatttaaaatagaagctgcatttacaatgtttattcactgtggtggttattgtgggctagtgttcctgtcactaagtgatacaaaaatatctgctgctggaaattctagaaacaggtctatacctctgctatataaattcactggaatttggatttgagctttgtgtttgatctttttttttttaaggcacagtttttttgcatttaaaatagttactgctgtagttgcttacctacaaaaattcagtgattagaatttaagtaaaaattatgtgatgctagggattttgcttcaaagtagtctgttgggagaaatggtggagattggccacatgttgataattcttgaagctggatggtgcttacttagggggtcattttactgttctttctgctttagattatagttgagatttttaataatttaagacagggc

SEQ ID NO: 87610 - DNA, 1121 bp, Homo sapiens
ggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgcagtcctcttggattctctgaatgtagtaactatgaagctatgccaaaggtaggcagaa

SEQ ID NO: 87611 - DNA, 1049 bp, Homo sapiens
tgaattttgtgggtgtgtggtggtgtgtgtctgtgtgtgcatgtacacacacactttgtctagctcactttaaaagattcatcaaatggaattttaaaaataatctgaaaagaaatagatatttcaggccgggcctggtggttcacgcctgtaatcccagcactttgggaggccgaggtgggtggatcacgaggtcgggagttcgagatcagtctggtcaacatggtgaaacgccatctctactaaaaatataaaaattagcctggcgtggtggcgtgtgcctctagtcccagctacccgggaggctgaggcaggagaatttctggaacccaggaggcggaggttgcagtgagccgagatggcaccactgcaatccagcctaggcaacagaatgagactctgtctcagaaaaaaaaaaaaaaaaaaaaggagaaatagatgtttcaaatatgaacattcttttggcaccaattttcttttttaatttggttgtttctgagatgtatgatcaactgaagatggagctgaaatgggagacgggtggccccaccgtgcccttgaaacagcagagcactcctcagtagagagggagggagccaagagcctgaacatgtggtcgccagcttggaatgttactgacatatgtggcgagggcttagccagaaatatttaaagatgtagtattccggcctgtgagttgtctgggcagggagggggagtcagaaagggtagagagctctcaaataactcatgactctagtgttcctttcacatgtgaacagtgtcactgatgacacattttctaggaccttcgtttgttttgtggacctgcctcagtctcctcagtatcaggcgatcttaagggaagatggagtgtttcaaattggagagaagttcatgggtaggtatcgtcctgtggaattctgaatgcaaggaagtcaaccccagaggccttggtacccccagctttctaaaactactttattacaatttatatgtatatacacatgcacatataaacgtgtgcatttatgtatgtgtgtatagta

SEQ ID NO: 87612 - DNA, 1048 bp, Homo sapiens
gattagctgtggcagttgtcctaggggtactttaggaagctcactttgtcctgcccagagaggaaccccatccaagtgctgttagaggacagaggggcagggtccctgccccaacctacattcccatggtggtgttttgagcatcagtgacaggagctgtgggtactatgttttaggaaaattaatctggctgttggaacaaggagcagaaagataggctggttgtttgtgattattatctaggcatgaaattcgttcattcatgcatgtgttcatttgttccttcagtatttaagcatcactgtgtgtcaggcagaactgtaggtgctggggttacagtggtggagaagacagaaaacaagagtgtcagatagcgagttctggttctggaagtggcagagtagcttgtgtcagtctaactctctggccaagaatgcttttagactaagggaaaattataaaatatggtgattatggtgatttgaaggcaatgaacagcaattaaaaccagacagaggtagagaggaaaaaatccttgaaagtaaaaagtaaacctggcacatttaaccagcttttccctgaacacactacctggtttgaggagctcatacagaaagtggcagttttaccggttagagcttggggccactagaaaggctaacattgagaggaaatgttaggaaagcaaggagccatagaaattccttctacagattctccttaaatccttggtgactcctgaactgtgcatttgcagggtagggttctaagcagcccagcaagaaacagcagctgggaggtagaggtttcagttgctatctggtgctgaggaaacagagtttaaaatttaagttccaccaagtttgaggggcttagtaatcacctaaggttttcttttgaaatcccagaagggcctcaccttatgattaaatccaaggttaagagccacatctgaagactaaaggcaaaactcaaacaaccccaccctagcaaagcttaaaaccaaacctccacaagagcaaggtaatccactggtaatttaactgcc

SEQ ID NO: 87613 - DNA, 1067 bp, Homo sapiens
gccccttcctgcccccgccttatccgcaccctatcctgactattcccttcctcccaccccatggccccccatgcccagggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtggtgagtgcccacctgccagggcgggggcatgggcaagctgtcggtggccccggggagggtgctgagccacttcttaatcctgtacccccacagggccccctcctccccgaagaataagctaccatggcagctgtccccagggactggcagactccgcgtggattcccttccgggagcactgctattctttccacatggagctgctgctgggccacaaggaggcgcgacagcgctgccagagaggtgggtgaccaggccagagcccacacatggcgggcaggtggcacctcctctcgtgggcactcagacccatgagtacatccccacactgctctctacccataggcagcacttacacaagatgccctcgtgctctcacatgtggagaccatacatgacactatatgtgcatatgctgcccccccacacacttgcacatgtgcacacacacacacatgaatccacagactccacaccatcctctactcaggctgcagagaagagggctggagcagctctgggggactctgccccccccggagacccatccgccctgacgtgggccttctttgcatccagcgggtggggccgtcctgtctatcctggatgagatggagaatgtgtttgtctgggagcacctgcagagctatgagggccagagtcggggcgcctggctgggcatgaacttcaaccccaaaggtgggtgccctgtgtgtggggtggagaggtcaagcctcaggctgtaaggggctgccctccactttgccctgagccttgtcctggggcttgtcgggggacagggagtcggttctagaacaca

SEQ ID NO: 87614 - DNA, 1018 bp, Homo sapiens
actccaaggaacctcatggactccaaggaaaagctgagcgatcaggcctcaggaagagtgggaaccagcagctgtcactcttggggagggatgtggtagagaaaagagacagaaacacctagaagggtgtgcatgcatgggcaatgattagattctttgatacaggaagacaaagaggaaaatatagaagaggaatagaaggtggggaaagaagtacaataataggaatcaaagagaaatggaagagatgcataacctgaggagtcatgacatgtcatcacaatggcttcagcaagcagtcagcagctcactggtgctaggcatttgctgtccctgacatagaaccaacctgcataatacacagaggttgcaaataccaagcccttctgatttacctgaattggtcattctggtttacatggaattatggactattttcaaaaagacaaagttgtattggttgacaggatgtgcatggtctcaatgaagatcttgatgaaaaagtctgggtgactttttatacttaagctttaacagaaataattcataattgtattttgggggcttggatatggacatcagtttgtttcaccaggcttatttttacatttgtggtagacattcttcgtcccaagatatatgtcttaaactttaataaactcattctgaaattccacttcaatttttgtcagaaatgtttcttcaatatgcatgacttttggccagccgtggtggctcacacctgtaatcccagcactttgggaggccaaggcaggtggatcacttgagaccaggagttcaagaccagcctggccaatatggtgaaaccccatctctactaaaagcacacaaattagccaggtgtggtggcaggtgcctgtaatcccagctacttgggaggctgaggcatgagaatcacttgaacccaggaggcagaggtcacagtgagctgagattgcgccactgcaccccagcctgggcaacagagtgagactccatctaaaaaaaaaaaaaaaaa

SEQ ID NO: 87615 - DNA, 1016 bp, Homo sapiens
tataatagttattttcttctcttagccaaattgcttctgccattctttttcaacagaaacctttccttattgtgctgcgaattgcatatctcatgtaaccaaacacttccctttttatatacatttgttgatatgggaattcaatataatctactgcttatggctaaaacttattcagcatatatgcttacgtaatttaatatatttaataaattgtcatacactcagactatgctttgtatttgtattggttactggttggtagttcattttagcatacttcacttgtaaaacttaatttggtttgcaaattaggattttactaacattgttaaacattaatagattatttccctcttccatcatgaattcttgactgtcccacgctagctctgttttttcttcttttccccataactgcctttgctctttatttcttaagtgagtatgaattattttgaatggagagggaaggagaccctagaaaggagtatactaatccagtcatttcaaaggggactattagggtagttggtactgattgaatatatggtagaacaagtgtgcataaaagaaatgcatgaaaatcctctccttgtcatatttcttccttttacagtagaattaaaatgagatctgagacactctgattgggcacactagctgaatattgttggattgaacttacccagaatcaccaatgttagctgggatatttttgctgacagtacaatatgcagattttaattcagggagctagaacaagctgttgcagagggctgtttactcttctagtactagtctaatcaaggcaccaaatattataaaatagtttggaagctagttcaattatttggactttttttttctttctgaatgacttgagactcagcattgttatatttgcttaatgtgcctgtagtcatcaaatgctgtgattattttgagggaaaggcactctgtaaatatactatacaaataaatagtttagacttcgttgtaataccgtgagaata

SEQ ID NO: 87616 - DNA, 1056 bp, Homo sapiens
actcctccaggtgggcttgggcatgatgttctctatctattctccccttgcacttggtgtatatagtagttgccgcatttttttttttttttttacacggcgtctcactctgttgcctaggctagagtgtaatggcggccatcttgactcactgcaacttctgtctcctgggttcaagtgattctcctgcctcagcctcctgagtagctgggatcacaggcatgtgccaccatgcccagctaattttgttatatttttagcagagatggggttttgccatgttggccagcctggtcttgaacttctgacctcgaatgatcggcccgtctcagcctcccagagtgctgggattacgggcatgagccaccatacccggccgtaacatattttaaatatttaatatgactggttcatcactaatgtgtgagcttttaagcaggcactgtgacttttcatcttttcagcatcagtatagttagtacatagtaggtgctcattatctacttattgagtgaggattgttgaccgttatctcagttatgcctttgaaacctcatctcttattgtggaattagaggaaactttaggcaccaggaggtaggtttagagaaatatacacaccatctaaaatattactcagagtaagtcctggactgtaactaaaactaaccctaaagataaaccagattttgttcttttttatgtttgctggtggcaagaggaagatgagaagattctctgaactttagccaaatgattttctttgtacaatgcaagagttgccaaactatagcccatagaccaaatccagcccattgtctgtttttgtatgacctgcaaactaagaatggtttttacaattttaagcagttgaaaagatatcaaaggaggaatgatacttcatgacatatgaaaattaaaggagattcaaatttcattgtccataaagaaagttccattggaacttagccatattcacttatttacatattgggtattgggtgcagcagcagagttgactactagttgctgtcgagaccatacggcctgcaaagc

SEQ ID NO: 87617 - DNA, 1072 bp, Homo sapiens
tggctaggaagataagggcttgtcttacaaggttggttggttcagatttgcctcaactccccatctcgggtgataagaatatttcttttctccaggtacaggaaggacagcttttacattggagtttcatctccacttttcaggaagaaaaaggaaagtcagagtgcccttcttggatctgctggttttcaagtgcctttagttcaaaataatccttatgccaaagttacatgttttggggtagcatattctgccatctttcatatggtaactccatggctcaataactttctactgaaatgtcttttataaaactacttcatatgttctcaggccagtgttgttgttaaaagaaaaaaagggaaaaaggaaaacaattacttcatgtagtcagtaggatatatcagtgaaataatattgataaaaagatatatgataaagatataatactaattttatttatacaaaaaatggttttactattttacaggagcctatggtattgaagtatccttatgtatttgaagatttaaacttggaaaaaaatactttgttcatctcttcatacagttgattcagattcagcatacatttattaaatgtttattatgcaccatgttaagtactttaaccagagttatcctcatatattacacagcctacgttagcttgaaatgtgtataaaaatttgaaaattttgggattatttcctttttgttcactaaagattttatttttggactccatagttttgattaggaaagaacttggtaaataatatttataattattgtaaagctgcttagccagtagtctgtgccagaccaagagtgttacttggaacagaaatatctcttatccattttgtatccttggtctatagcataatgttttataatacatatttgttaaatggcataaattttctgagaaagtcataattattctggtcttatgttttgtgatttaaaaaaattagatataactagttttcaatcattttgaaataatttacaaaccctttagaacagtgctgttcagtacaactttctctgatgataggtatatttta

SEQ ID NO: 87618 - DNA, 1048 bp, Homo sapiens
cacttcgaagatcttaaatgacatggttcttgactgcaaagctgaggactgggccccaaactataggattttagtatcagaggcctgcctgggaaaccaaccagcagatcatcccagaagatagatttctatgattgttcttgaccaggggaattctcttctggaataggagtggatgggagatttgctcctatttaatttctttcctaaatgtataattttaatgacataaatcttttttgtacctgaaagaggtcaggtttttccaaactcaagtattagaaacatatttgtctacttttttgttgtcacctttcatcctaaccacagaaggcttggctggggaatgttctttgggagaaagagaatattgaagaaaaaatgatttttttcaaagtaaagcctggctatactatttgcttcaaaaatttacatcacacttcatgatcttagctctggtattattcatatactagtcactatagtcacttctttactcagaatattgtgttactttgctgttctactttgtttccattttaaaaaatggtcagaccattcagttttcctttctgttaagcttccagtggattcatgctctaaggatgaggtattattagatacttctttccttcctttctgtgttatttttccatccctgattatagggtgagcacttaatgtggaccaagtagagtattgggggacacagcttacttagaaataaaagagatagtctttgccagattatactgcctgtaataaataaaccagtattactaaaatatagtatgagaagtattgtgatgaaccttctacatggagtactaagggagttccaagggaaggactcaatctcagactggagggaaatggaacaattcttggaggaggtggtgactatcaccaagcctacatagcagttagccactttgagaaatggggaagaggatgtttcaggcacagagtacagcaagtgtaaagacgaagttgtgagaaaacttgacacattttgtgaactatatataggtagtttggtactgtggtg

SEQ ID NO: 87619 - DNA, 1067 bp, Homo sapiens
gtgccaccatatccaactaatttttttttttttttttttttgagacagagtctcgctctgtcgcccaggctggagtgtagtggtgcgaactcagctcactgctgcaagctctgcctcccgggttcacaccatactcctgcctcagcctcctgagtagctaggactacaggcgcccaccaccacgcccggctaatttttgtatttttagtagagatggggtttcaccatgttagccagggatggtctcgatctcctgaccccgtgatccgcccaccccagcctcccaaagtgctgggattacaggagtgagccaccacacccggccctccaactaatttttttaaaacatttttatagagatgaagtctcatgttgcctaggctgatctcaaacttgggctcaagcagtcctcccaccttggcctccccaagtgctgggattacaggtatgagctgtggctcccagtctgagttgctcttctgaaatgcactttatttggaaaatatatacgtcagtgatatgactaggttattttaatttacacaattagcaaaagaagatttttgttattttgtcattataccattcaatttctattccttcttccatttttgagactttgcctatctgtttatacaagtgcctttgcccaatgtttagaaagcctttaaatagggagaattaatatgttaagggataatgaaagggttaatcatttgtattaacagttatatatgtcattaataacaagattttgcttccgtcatctataacggatcaaataaatattcacattttaactattgctctgcaagtaaataaaataggaattttaaattttatgtatatttaataattgtgtacattataagttaatgcttctttatgactatcctcacacatgtatgtatagaaacaaaggattttatatatccattatctctgaaactataatttttattaacagtagcaaagaggccgggtgccatggctcacacctgtaattccagcactttgtgaggctgagatgggaagatcccttgaggccaggagttcaagactagcct

SEQ ID NO: 87620 - DNA, 1062 bp, Homo sapiens
aaaaacatggtctatcagaaaaaaaattgacaaattgacctcaccaaaatttgacatttttatatttcctaatataccagtaagaaaacaaaaagacaagcaacagactgaagtatttgcaaatacatgtctgatgtgacttgtatccagaatatacaacaagttcgtacaaatccaaagaaaataacccaatatgaaaatgtgctaaagtttgaatagatatttcactaaagaataaatgaatagataacaatacacaaaataagctcaacattagcagtcattaggaaaatgcaaattaaaacctcatgagatatcatttcacaccagctaaaggtaagacagtaacaaaggagatgtagagaaacaggaatccttgtacactgccggtgggaatgcaaaacagtacagctacttttagaaaaacatttttgcatttcttaaaaagttaaatataagcttaccataagattcagcaattctactcctaggtatctatctatccaagagaaatgaaaacatatgtctacccaaacacttgcaaacaaatgttcacagcagcactattcacaatagaccaaaattggaaacaatgtctatcaaatggtaaatgaatagacataatatggtacagtcatacagtggaatcctacttgaaataaaaaggaagaaactactgatatatatacgtcataaacctcaaaaacattatgctgagtgaaagaagccagatacaagagacgacataccatatgactccatttatgtgacatttccagaaaatacaaatatatagactctgtcaattagtggttgcctgggaactgggagagggaatgggattaatgttaaatagatgcagaaatctttctgaggtaatgaaaatgtcctaaagctgattcatggtgagggttacacaacttgctacatttactaaacattactgaattgtacacttgaaatgggtgaattttataatatataaaataagactcaatatacttgtttttaaaaaaatttttttaaaaatccacacacagactgctgctttagaaaaaaaaa

SEQ ID NO: 87621 - DNA, 1050 bp, Homo sapiens
ttgcttgtctttttgttttcttactggtatattaggaaatataaaaatgtcaaattttggtgaggtcaatttgtcaattttttttctgatagaccatgtttttcatgtcactttcctctttatctttttaatagaaaacatactgtttatatcatgtattataaaactgatttctttacgacattggggtttgttttaactcaagtattggaaaatacttcctgaaatacttaatattttttccctcttgtccctcctcttcccctactcatgttaaaaaaaaaatagaaacaattacatcatcctaaattgttacatctgtagactagaccttaattgttacatctgtagactagaccttaattgtgaatgatttttttatttaccacaattgtcttcccataatgttagtctttctggctagcagagtgctttagattcttaagcagtacttatcactcatccttaaaggaagggtaaaaggtaaatataccatcagagatcagatagctctgtcctggagaacaagattatatgctactggagtagtacatattgactgtgttgaacaaaatacttcatcagaaaattatttcttgtcagtgttgaacataatacaaacagacctactttggcctacagggcaagtcatatgtcagggaatagtttgtattaggttgttttttgtatctggaaaccatggtttcaggatgctcagaaagaggcagaaaaggaagctataaaccaaatgactcagttattttcaacacttagtagattgtagattgaaaatttttccagaacgtagagaaataaaattactttcacagggaattgccctgctaaatgtataatgtatgtaaatatttgataaaaccacaacctctggtagcttaaatgattacgtatctaaaccatttttaaattaaattttctcgtctcaggagggtctgctcttttcatttagctctagatacacatactttcctttcctttctaatgggtacatagaagtggttccctaaactggggagactccgatgctaaatc

SEQ ID NO: 87622 - DNA, 1054 bp, Homo sapiens
taatagatgttatactacatagaaaacaaaattatttgacagatttcagcagtgaaatttttgggaaacctttatattgagttctgttgatatgtggtagtacctatctgcttgtagtatctgaagatttaataaggtctttaacagatacattctggtgagcttgatgtttacaaataccagttttatctggaatgcaacaaagatcttttccattgcattgatcttcagccgaagcattcagtgaaacaacaaaagcacattcaaagattttcccaaagctcacctaaatctttaggaagggctctgactgaatattgaatttctaaaaatactaatttcatattccttgcaaatagtgtcttaacttattgtttacattaatacttaggctggagtttgtccattgatgaagatgctatgatgttagtatttcagttccttgaagtcatctttatttttcaagagctttccttttagcagtctaaacggttagaacatgccatccagctgggtacattgatccataaaaagcaaggtgtttacttagcagtgtaaagtatactaaaactagtaataactttaattcagaattttcagaatttagagtccctgaacaataatcctctctcaaaaagtaacatgttatcttaattattgtttacagatgaattgtatggcttaggatacgacttaaaacacattatcaagaaaggaaagcaaacttgggcagataaactttccttatgtttcttcagacctgcttggcaagcctttataatatgtgattattatatccacaatgttgtactttatttcagaaaaaatcagatttgttttcctggaataatttttaaaaacatgtcacatcatgctttctaattttatttaaaggaatgtacaaattacagtcatatttcagtttgacatatttttcttctgattatgattaaaatgaaactacccccaaaaaagtaatgaaatgattgaaaatcttttttagtctgcattaaggtatatctttccactttagaatagaggtgtatctttcata

SEQ ID NO: 87623 - DNA, 1744 bp, Homo sapiens
tgaaaattaaccttgactgtaatatatggacatggtatgaagagaagaagaggggcatttcaggtcaaagggacaacctgccctaaggcacaggaactggattggagcagtttgtcagggtactctgtgaagactgccttgtctgcctcagatagcacatggtggcagggtgtgaggcgtggacaggacagaattgagccatgttacagaaagccgtcagaacctggggaggagcttagcttagatttgatacagcagaaaactgcacctttggacgcgctagaagggaatgacgtaatgtggtcattgtaataaagaattggtctggcataatatccaaaacggagtgactgaggcaggaagtaagggaagccaggcaggaagcaaggagagtaaatgtagcaaaagtctgagctaggtgggagcagttggaaacgaacagaggtaactgatacaagagatctttctaaggaaaaattcataagacttgaagacagactgggattgcttggttaagtttacttcttaaatagcaggaactttcattttaattatactcaggatgtttgtgatataatgacaccctgatataataacaaaatacttcactcatctcctctactaatacataaaaattattttaataaaactctcttgattcccttcttcaatattcattcattcaacaaatatttactgagcctttactatgtaccccagactatgtactgatacagtgatggttcctgccttcatagagcttgcattctagttaagaagacaggaataagcaagaaaacaaaagaataaatattgttagattgtaatacgtgataagaacataaaataattagtatttatgataaattctccaagagaaacaaataagccctctggctaaaagaaaattatgggggccgggcatggtggctcacgcatgtaatcccagcactttgggaggccaaggtaagatcacttgaggccaggagttcaaaaccagcctaggcaacatagcaagaccccatttctacacaaagttttttaaaaatagtcacgtatggtgggacatgcctatagtcccagctacttgggaggctaaggcaggaggattgcttgagcccaggaatttgaggctgcagtgagctatgattgcctctccagcctgtgcaacagaacaagaccatgtctcttaaaaaaaaatgatgagcagtagggaaaccaacttgaaaagcttatcaggggaagccccgctaacatagtagcatttacgctgaaacaagaaactggaaggccagaagagctggggcatagactgagggggaagtgatgtgagatgcctgcaggggtaggtaggcagggtccaaatcatctagagccttgagcactatgggagggagttttgattttattctaaatgcaataaagaaccactggagggttttgcgtaggggagtgatatggtccttttatcatcagacaggcccagttccagcactggtcattccagcctcagtccgggtagcaataggagtagtcgataagaaggaccctttcttttctagaaaactaccattactttgttaattcttattttatgagctccttactcttctcaccctgctgccctttcctatgttagcaggtgcttatatcaattcatgtaagtttccttcccccgatgtaatctaaaaataattatcagctaacttgtctaagatattcagaccttcatcctacacatatt

SEQ ID NO: 87624 - DNA, 1094 bp, Homo sapiens
tctttttcctcccctcaccctgcagtaatagacccttctggtgtatcttagttaaatcctgtggctaatcggatagcgacagccatcttctgctgttatcattttggagcacaagattttaaaaagaaacaataaaaacaatccaagtcccttctgtgaattgtatgatgttcccaaaaggattttactataaatcctactagagctgttgtcaatatttaatacaaagaactggcaactatgtatataggaaaaagaaactaatgtagaattgcctaataaacgctttgagatcagttcccagagaaactttgctagctgatctgggaccttagatcctgggacatctcagaggattgaaagctgaggtccaaggcaaccagactaccactgaattaatagtatccttacaacagatgaaatcctcaggggctctcagaggagaaaatacggcttttatacagccatatcatgactatacaggctttgccttctcaacatcgcattttaactaggagttttgcagcaaccgactgatgcactgggacaagaggagcaggtacttccaacttcaaatcctgtataatccgttccctgatgattgaatagcatggctgctgagagatcatcttatttcacttaatggcagagagtaaaattgtaaacaggaccaggagttatcaaaaaaagctttcttagatttcatttcagttggaactcagccccctccccagcaatggctggcaccaaccttgttactaaagtactgaagtattgatctcagtgcttaaggctccctaggtcaatgagatggaaattcactaagaatttaatgctattggcaaagcccaagctggtctttcaaagcagctggctgcacttgttttccatttcaggcaggtctgattagcaggactctctccaggcatggtttgtctttgtggccttcagcctccacttcttgcacattgtttctccttctgttctccactttctctccttctctctaaagcatctttcagtagatcaaagaagaccaattcagtgcctctgaaatcacaccaggtaagccagtgcctgacatgtacatctct

SEQ ID NO: 87625 - DNA, 1029 bp, Homo sapiens
aacaacttcccgaagggcctggctggactgacaaaatggggcatttctccactattcccagagaggccagaaggaagatggaggccgaatgggttagggaatcattcggactcttccagaatgagtcttcctgtttccttccctataaatccaactaaaccgaaataccccagactcccacagacgccaccacagctctctgagatagtgaccatgttctcagctcttggtgatttctctggattcagaataactccagttcctgtgttcacattttgtcaagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagc

SEQ ID NO: 87626 - DNA, 1029 bp, Homo sapiens
tggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttggaaaaccatggtgttgtgatgcttttctccttccattacagcctcttcagggagctggcttttaagcttaccctcctgaggatgcagtgatgggggcaccctccctcaggaggaattgggcaggttagggctaaggccaaattcccgatgatttgcttggtctcttgtgggacattcagagccacccctttgtgca

SEQ ID NO: 87627 - DNA, 1040 bp, Homo sapiens
cgggggagggtggcggggccgccgtgggaggagccgcgccgcatctcaggcgcagtctctaggggctgtgcgcatccgtgggggggacatgcgcatctcaggggggctgctcgcatctgggggtgctgtgtgcatctcgggggggctgtgcccatctagcggggtggctgtgcgcatctggagggggctgtgcgcaacccggggggggtgttgcgcgcatctagcaggggcggctgtgcgcatttcggggggggctgtgcatatctggggggaccgtgcttatctccgggggcggctgtgcgcatcttgaggggtgtgtacatctcggggggcctgtgcgcatcttggggggctgtgtgcatccgcgggggctgtgcgcatctcggggtgctgtgcgctgctcctctgagctctgctctttcttgcagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatggtgagtcccatgggccgctcctcttttcccgggcttgtgggggtccctgagaggcagtttgcaggggtcttgtcacccctgcggtctcttctggttggacaaatctaagattctagaaaagacagagacagaagctggttcagagcctggggagatggaatccaaacccaggctctgaggttggtgagtggcagctcctctccagcctggtccagcattttcacctcgtttccacacacagcatccaaggcgggcacttcttgcagcagagggaaaggaatgaggctccgagccaggccctgctgcaggggtggtttgaattgagggaaaaaaagtaatcatatgtgagagtttgtatgcgtgcgtgcgtgcgcgcgcatgtgtgttgttggtcttg

SEQ ID NO: 87628 - DNA, 1354 bp, Homo sapiens
agatggaaacgggcaggatcatgccatgcagttggcatttcactggcactcgggggcacttacgcaggggacagcatgatgttgggagctggctttgtccctggcatgtctgtcacgttgaagagggagaagctgcaggccctgacttgggtggggcagtgaggatgctcaggagggaagtgaggggaggggtgccagcatgcggcggcctgggcagccttctgtggaggagctgaggtgtcacctgggcccggaagaagggcagccctgctagctagtggggagggcatgagagaacttggcgacgatgggagagaaggtgacttgggacgagctgggtttgaagcgtctgtgggatgtccaggtagagatgagtagtgaaccgtcagaaatggggcttgaatttggggtggcggggacagaactgatacccgtgtaggtgacagataaggacagaggcaggagttccaaaaataggatttattgttggctggggcttctggaatcccgtattcccgtccaccctgggaatgtggattggagctatgtttctgggagatgatttgatggaatgtgtcagaagtctaaaacagaacctagcccttgtttcaggattccctgcagagaagtttgcagatgaccacatcctgttgtttatttggtggaaaactgaaatcgaaagctagctaaatgctgaacaatgggaactagttggctaaaaaatggccgtgcaatgcaagagtgtgaggttacgaaaatgatgatgtgggcgcgtatccattgacacaaacatccatgtgtgctacgccctcagttaaaaagcaggttagaaaatggaataaatgatcctgcttctataaaaggatgcatatgtgttttaggaagaaggtgtgtgaggatatagatcaaattctgatggcctgtcattttaccttttttgctgatccatattctactgcagtgcgtgtggattattagcacacacacacacccttttttttttaattaaaaaaaattttttttgagacagagtctcattctgtcacccaggctggaatgcagtggtgcgatcttggcccactgcaaactctgcctcctgagctcaagggattctagtgcctcagcctcccaagtagctgggattacaggtgtgagccaccatgcccggctaatttttatatttttagtagagatagggtttcaccatgttgtggctggtcttgaactcctggcctcaggtgatccactcgccttggcctccccaggtgctgggattataggtgtgagccatcgcacccggcccacacacacaccccccctttaatggtggagttgccaacagttgtccgatgtg

SEQ ID NO: 87629 - DNA, 1451 bp, Homo sapiens
cccggagacaccgcccagcccgccgcccggttgccatggcgacgccgtcgcgccacggcccgcagaaccggccaagcgacccgggcgcggcgcggggaggctgaagggacgctcgggtaggcaaggtaggaggccgggctgggggtgggagcggagcgcgcaggggtgcggggcgggggcggcccaggtgagccctgactgcgcagggagggacagcgcggggctcccgagtagcagccggcctcgcacctgccccttgcggccgcgcactggactgcggcgccgacccgcaccctgggcccgagggctgcagggctcgcccgccctctcggagccgagcctctcccggtccaggcggcccctgccctggcctgcccgggtgccgggtctctgctgaagttagaaccgagacccccgcttgctggtgaccccgagtttggatctttgctcctgcgccgcgttctagagcaaggtagggtgcaaatggaccaaccagcctttgccacggctgccctcttgaaatctgaaaccggagccaccgcctcttgccccgagcagggcccgggctgcaacgtggagccgcaggtccccgcctgtgtctcccgacgcccccagcttctgagcgcgagggtgggagtttcccgagtgggaaagccccatggcttcggtggcctcggtggccctgtggtgggtcaggccggtgccaactgcgctgagggcggagctgccgccaccttgacacctgggagatggcagggccaccctccctccctccctccctgccctgtccccgactgtatcacggagcgaggatcatccgtgtggatctggggtccccttcccagacttctcctttctggtcgtcctcctctcattcattccaccttggcagcctttgtggattttctgactccgtaaatgaagttacatctagggcgcctagattctgcccctttggtttaatagctaatgaaaaaaaaaaaaaaaaagctttgccacctcctctaggtgcctggatttctcccggtgaaatttgatggaggcaggaaaatacgaggcggtggcagccccacctccttgcatgagggagcctcctagagctggaggtggaaccaccctgcttgtcccactccttttctttcttgctttattgctttcttgctttccttactttccttccttcttttttttttgagatggagtcttgctctgttgccaggaggctggagtgcagagggcaatatcagctcactgcaacctccatcttccgggttcaagcgattctcctgttccagcctccctagtagctgggattacaggtgtgtgccacaacacgcagctaatttttgcatttttaggagagacggggtttcaccatgttggccaggctggtctcgaactcctaacctcaagtgatctgcccgccttggcatcccaaagtgctaggatta

SEQ ID NO: 87630 - DNA, 1070 bp, Homo sapiens
gtagggggtgggggacaggctctattgagaagggtcaggcctgtggaaccagctaggcccagctgagacttccctttccctcctgcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggtgtgtgtgctgtggtcagggctgggggctggtcatgggtagcccctcctagtggctcagacacatcacagggtgccaggtgggttttagaatggggcaggccatttagctgcaggtctccccatacctgtcattaagcacaattcccccaatgacttcccctagcaaactctggaacatgccaagggagcttctcgggggaggggcacaaccatgtgcagaaacaaattccataggtcctgggaaagggagtgtgtcctgtggatggcagggctatggtggcagagcgagggcttagaggcagaacagtccaggttcaaattctggctctgttccctaccagcaagagtgtgggcaagttactaaacagctctgaacctagtttgcccttttgtgaaatggggataattggaacatccacatcaaagcatcttggggactgaatcttgtatgcttggtgcctgctcactggtgttgttaagagtcaggggtgtaccagggggattctgggccggggctgtggatcccagtaaggaaatagcttcaggtaggccccaggccgccattccatctagcaggaacagcacgcaggctacaagattgacagctgccctcaggaactacttttgccagccctgaccctgactgtggggttctgtctggcaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcc

SEQ ID NO: 87631 - DNA, 1965 bp, Homo sapiens
gcaaacggaaggagatctacaagtatgaagcgccctggacagtctacgcgatgaactggagtgtgcggcccgataagcgctttcgcttggcgctgggcagcttcgtggaggagtacaacaacaaggtgggccgggcaggggctcggaacccagctggcggggagcgggccccgggagcgccctttccgggccggagcccaggcctcagaaccctcttgcggactcgccctagggccacggagcggttcctctgtctggccctgtgctgaaggtttcgtactcgttgtctgtctcctttaatccaggcagcattcttgtgtagtcggcagtgtagtggggaaactgaggcacggttttgtgacttgcctgggtcaggcagctatttcggggtggaaacaggtcttaaaaccgggtttacgccccaaagatactccatttattcatcccgtgctctccactcctgccgcattgctttcgttggtgggcggggaagggaagagagagtgatagctgtgaaggaaaatgcaggcgcttctattggtggtcgtgcactcctggccacactagatttctattaagacgatctattgtacaagcttccccgccccctactcccaccccccccgggtactcatggatcctagcccttctgccagaattactgttgctcttgcttcctgatatccattctctctaaagcaatctctttggaaatcttggcctgtggcatgatcccgccgttgtttcctgaacacagaaggatgacagggccttatctcttggcttgtttcgtgctagtacagttgtgtgacctttagtagtaagtcttgctggacatacatcaatttgagaatcctttatagaagcacggtgtagtaggggagcttttaaactggcattgcaacaaactcatttttgaaagttgaataagtcagttggaagaattttctttcttccttttactcaaagttgtgaatgatagcgatcagagcaactgaaagctgtggctagtgatatttaaagccactactcctgctttatgccatgaacatcagatttaagaagagtaaaactggccgggcgcggtggctcacgcctgtaatcccaggactttgggaggccgaggcgggcggattacctgagctcaggagttcgcgaccagcctgggtaacacggtgaaaccccgtctctactaaaatacaaaaaaaaaaaaaaaaaaaaaaaaaaaaaaaaaaaaaaaagccgggcgtagcttagtgcgcctgtagtcccagctactcggaagtctgaggctggagaattgcttgaacctgggaggcggaggttgcagtgagccgagatggcgccactgcactccagcctgggcgacagagtgagactctgtctcagaaaaaaaaagaagaataaaactgttcagtgacaaggctgatgcaggggggaagaaaccaggtggtcctgtctggttattgactagctgtgagatgttgcacaggcctgttttattatctgtgacccacagtttgtacggaaggggttctggtttacatgtgagggtcttgtaaaaaagaaatttgaacatttcacagtttgtttacagtttttcaggagcacatttgtttctctagagtaggtcctctttggagtccactttgagaagctgatgaaagctatggattctcattgtccagacattacacatacatgaacaatttacaaacaaatccaaggaatatgcactgatctttaagtccacccattgcccgggcgagatagagctttctttcctctgttgcttctttcttccttatggcccatagtggacagcagaactggaaatgggattcacgattctgatgtggacaccgtgttaataaaattaagaccactagaactattgtttaaagatacacgtggaaaataaaaaagtatgtctttcaaagggcttaagtctttttacacaaatta

SEQ ID NO: 87632 - DNA, 1065 bp, Homo sapiens
tcgagggagaccctatctctacagacaattcaaaaattagctaggtgtggtgtctgtgtacctgtggtcccagctccttaagaggctgaaggatcgcctgagcaggaggatcgcctgagcctgggaggtcaaggctgcagtgagctgtgatcatgccaccgctctacagtttgggtgacagaatgagaccttgtctcaaaaaaaagttgcagaatacattttatgatgcaagtctatttaagcttttttctttctttctttcttttttaaacagatgaggtctcattatgttgcccaggctggtctcaaactactgggctcaagtgatactcccttctcagtctcccaaagtgctgggattacaggtgtgagccactgcacctagcacctatttatgcttttttaaaaaaagaaaaaaccacacacaaatacatggagaagtatttggaaagatgcacaccaaatagcatcagtaaggatttttgagggtcagtaagcagatgggaggctttactcttttactctgtattatatgcatattcagagagaacttatattttctttcatcattaaatttaaatggatatctgaacaaaaaaaaattgaacaacatgagagccaattgtaattcctctcaatatttggttggcaacttggagcagaagagccagtgtcagtttggctgaggctaaaacacacacttgtgcaaacacaatgtagtctttggaaagagaaactaggctgtgtgattagaacattcaggtgggccaggactgtctattgtaagtagtacaatcttgaaatgttgaagaaaacacaatcaattttggaaagagatgaatttctggtcagaaatattataaagcacacaacatgctaaactctagtcgtaggcaaagcttacattgttttgtaacagtacatgagattttatttggcgtccttcttttttttcccccctaagacaaggtctcactttgttgcccaggctggagtgcggtggcacaatcacagctcactacagccttgactttctgggttcgggtggtcctcccatctcagcct

SEQ ID NO: 87633 - DNA, 1068 bp, Homo sapiens
ccaggctggtcttgaactcctgacctcaggtgatccgcctgcctcagccttccaaagtgttgggattacaggtgtgagccaccatgcctggccaggaaagaattttttaacagcacatatcagcactactttatcagtcttctatataacacctcactgaagcataaatgtccatcaaacagggaagaaacgctctcattatattgaatgatcagagaatgatctttgtaaccactcaagtattttaagtggctgcaaatgacatgtttggtatccccttgtccactcctgatacctgacccagatgagaaggactcattagtgcagtggatagagcctggggacatctgggagatggagtcagggcctagatttgagttctggctctgccactcacttggctgaatagctgtgtgatttggaacaagtgccttaacatttctgaatctcgatttcctcatcgataaaatgggggcttaaaatagaaccgccatcacgggggtgctttgtaaactgtgacttgctcctgaaatgcagggatcatcatccgcattgcctcacttgtgaccttgcttgctggctttctttgtccctagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgt

SEQ ID NO: 87634 - DNA, 1078 bp, Homo sapiens
ggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttcccttt

SEQ ID NO: 87635 - DNA, 1078 bp, Homo sapiens
ccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgtatagattgactgaatttctttttgtgacgaattcagttcttcccattttgtcactttggtcatgttccatagacagtggcagtgccccagcccgagccgggcagtctactcatcaccttt

SEQ ID NO: 87636 - DNA, 1050 bp, Homo sapiens
tttagtagagaccaggtttggccatgttggccaggctggtctcgaactcctgaccttaggtgatccgtccatcttggcctcccaaagtgctgggattacaggcatgagccatggcgcccagcctctgtctttcaaaaaaaaaaaaagggacttactagggcctgctttgcctgggtccctatgcatcctgggattggtcagagtgaaccaatgagaagactgagctgctctcaagaagggctaccacaagctggttttgaaagcttcttggttctgagaacaaccagccctagatccttttcatctctgatgccaaatgatgtggcactgagaactgaagaggaaacgtgaacagaaagaagagtgagggctgaataagaagcctcgccagtgggaaatagggcccttggtaccttttgctcctaatagtcacatctgtgtttagaagggccaggaactcccacctcctgcgtcagagcctgtcaagcatgtcaggcctagagtggctttctgatccctgttatacacctatttataagttatctaagctaattctgagctcagagtaattttcctgaaggagcttcaggtaaataaggatgacaaagaactaaaaccaaatttactgtaaatgataacttcagcttctaagaaaagaattactgactccacactgatgtcaatagctggagagcaagggctacgaggaagaaaaccagtgaaataatccatggtcatgccacttgcccaaatatctgaattgcttatcattaaaaaagagcaaatttacgtttatatgtggcttcataatttgtaagatacgtttacatgttatttatttgattttcccaacaaacctataaaacactttggccaagtattttatgcacaaatgatctcataccaagcaggaaagaacaggtcttacactgatagaccttggtgtttataaaatagctctgttttggaaattaatttggaggaatcttatttataatctgagaaatctgtactaagggagtctgctcttaaagggaacatggctagtca

SEQ ID NO: 87637 - DNA, 1051 bp, Homo sapiens
ggcgggaccgagggcccgtgctccgcggggcagcctggtccgaacgagccggaccgcgagcccgagggcgggggagcaagagcgcagtgtggggcccgggctggaggctgccgcaggcccagctgctgttgtgtcttttccttgatttgcttttttttcctgcctgtgtcatttccttccctttgctcacacaggccggcctgtgagagttcccggggcttgctctccagccctgtgcgcgccccagcgcaggggggagggcgtgcggggctcggctaggaggcgattaaactggagctgtgatcaagcgcgcggttgacaaatgcgtgctgcacgcagattgctgggggtcaggagttggtcggatgctgccagttagaattcacatcctactttttgaaaaatcccgttgcaggggtttaatccattatttttttcttgcggtatccctgaaattatgtaacttttgaaagaaacatttgctacacaaaagaatttctctgaaatcacttcctttttgtcagtatttacaatttctactgtgaagatgtaatctaaggaaagcttttaatgtcttccgcacgtagcatttgagttgaattatattccatatcctttttggtagtttagcaaatgactactggactagactaagaaataacattttaaacgttctttacttctcctgcccagacaggtgttgtgatactgttgtcacaagttttgcaaaatatttggtattgccctaaataataataaaagggtaaacttcagtgagaggatcgtttgcaaaacgttccgttgcttctgtgaagtgccccatgtgaagagggagccttaatgtttgccttgccctatagcaaggtcaagtcctttttgtaggaggttaactgtacgctatgtcaaattcgccagatattgttttgtgacccatctctacaccctggctttgaatgaattgccttgttctagttcatgctgtccctcatacagtatgagaagggtttgttcatttgctgggcttactgtttccttctcatgctttccttca

SEQ ID NO: 87638 - DNA, 1047 bp, Homo sapiens
ccattaaaggccaggcatggtggcccacacctgtatgtaatcttagcactttgggaggccgaggcaggaggatcactggagtccaggagttggagaccagcctgggcaacatggggagaccccgtctctacaaaaaataaaaaaatcatccaggcatggtggtgcatgcctgtgttcccagctactcaggaggctgatgtgggaaggtcacttgagccccagagttggaggctgcagtgagctatgatcacgccactgcactccagcctgagtgacagagcaagaccttgtctcgaagaaaaaaaagaatccattaaaattcaaattgccatagtctgaccttttgggctgcatctgattatagttacagggtctgtcattttacctgggcagaactccctgagtattagttatacagtttgtgaaagagctttgctggtctgtatttaagtgtcttagtccatgtgctctctttcattgcagacgaacaggaggcattgaactcaatcatgaacgatctggtggccctccagatgaaccgacgtcaccggatgcctggatatgagaccatgaagaacaaagacacaggtcactcaaataggcaggtgtgtgtgaccctggcagagctaagtgagatttgttggggaggggttttcaaatgggaaatatacgaaaagccaaggagactacattaccagggttgaatgcttttgaccccttcctttcacagtctgttaaatgggaagtaatacataccaaccaggtatggttaaatggtaagtgatattgggaggccgaggcaggcggatcacctgaagtcagtagtttgagaccagcctggccaacatggtgaaaccctgtccctactaaaaaacacaaaattagccaggtgtggtggtccatgcctgtagtcccagctactcaggaagctgagacaggagaatcgcttgaacctggaaggcaaaggctgcagtgagccgagatagcaccactgcactccagcctgggcaagacagagtgaaactctgtctcaaaaaaaaaaaaaaa

SEQ ID NO: 87639 - DNA, 1012 bp, Homo sapiens
acagtatatagtcaggaaaaactaattaatttggtattagcttatgtaaaatataattaagaaggtaaatttattaattaaaatgtcacctagtatattctgaaggcaataatgagtgattttgttattactgtttacagttattttaccttattaaccttattgatagtgcctgttttattgagagttgtatgcttctttaggaaaacattgcctattttccttaacatttaaacttgtgtgtcattgacaatcttcttctcacctgtagtgccacttacctgtttcctgggtactttgttctgcagagaggagtgaatgatggggagctttcctacctagtgggtatccagtgctgtgtcagctagctatattgggcatgtttgatgaaaatttgtgtatgacattctcccttttggttctgtttgttatcagctaacctcctttcttctcatttgcaccttgtttaccaattcttcagaattggttcctagagatagtataaggccctaaaacttttcctgtctgtggtctgctagatagagccttccagagtatttcctgcctttaggaatcctagggaccccaagggaagaggagtccttttgtttcatgttaaaacagaaggattagtttaaaaagctgcttttgttgttgttaccttatagtactggaggtataaacagataagggcccattcttacactattttcatatgttattcagtctgactgtgtgagttctcccttgctataactcatttgtattcaaagccacttttcgaaggagcattttaccagaagtgagtcccctcccccttgcttgagcctaatgacctcactttccttcctgtcttcctatgtagtgtgtgcttgctaacattgctccagttagctgatctttctccagactggactattagcatgaatatcagttagtgggtgaaaaggggaagctttcttgaattggaaggcccaaaaggacgaggctgggaaaaggaggggcggaatgg

SEQ ID NO: 87640 - DNA, 1029 bp, Homo sapiens
aatgttgtcaaacttatgttgcacgaaggatacaaattattaacctcagtttttttgtttttaaagaaaaaacacaacagcagcagctcagcccttctgaacagccccacagtaacaacaagctcatgtgcaggggccagtgagaaaaagaaatttttggtaaggatccagattacctgttaaagccaaaatgtacttttaaatctgctactcatgctgcaacagcagaattcacttcccagacaagttgttttagtggatttgtaaaaagcattggttacccgtgacctgtgttcagtgcttctagtcaccatttctcacaacagtattattcataaacagcctctatcagtgctgtccaataaaccttctgtgatgacagaaatgttttatatctctgctgtccaatgtggttttgtagccactagctacatgtggctgttgagcaactaaggaactaaattttaaattttatatcattttaattaatttagacagccacatgtggctagtggctattgtattggacagcatgactttatgcactatgtaagggactgttgatttattgggcaagaaattatgtatatgcttggagatgtgtagatattcattggtatgttcattccttacacacgtcatgagtttctgtacattgtgataagctaataatgggaatcctacctaagatttctgttttaggaagaatgtgaagatgtggaactagaacagctgtttagaaattgaagctcaaagttttatgttaatatgggcaaaaggggaaataaaatgctaagatagcttttcctcttaatgaagtcaaggttatagaatggcctgtcctgggaagtgtagcagatgttttgcttctgaccaagagggatattcttcagcaaaattctgaaagcagaaaaagacaaagtctcagcaaatgcatttctaggaaagatagggtaagaggtagtgcggggaagatgttggggagaggtatttatagcctagtataatgaaaggagcctggtgatatta

SEQ ID NO: 87641 - DNA, 1006 bp, Homo sapiens
ctactcatgatggtcattttggaaaaggctgggaacagtgtataagatcctactttacccccagtggggtagctttgggagggttttgggaaatcaatgatagtggtaccagtggcagcagcagcaaaaaccaaatattgcatgtctattatgtgtcaggtattttacttacatttagttgttgtaagaactctgcaaggtatgtttaggcttactctacagatggaaaaactaagactcacagaggataagtaacttgcctgtggtcatatagctagaaagcatcagcagcaaaatttcttttttgtcttcagtcacatcagccaacaaggaaatgtatcctggtcaggaggtgatagagtgggagaaacttccagagccaattgtagaaatagggtgtgtatgaagctagaaacagcatgtcacagcatagcaactgagctgggcagccacctagggatcttaccctaagagctttgttgtccctgatgttagaactggaagttttaactcattggaaaggaatgcccatgcccatctgggaagagaagctggaccaggagccatcagggatgtatgcctaatgttgctaacgaactgcccaaggcttacttggcaatggcaggagtgacacattccagagaattctctaacctgtctatcattctttttggcagagtgacgtcagaatcaagttcgagcacaacggggagaggcggtaagtctgccttctgatgagtagctgtgttcatgtatgccaaagttctcagatagcattgagttcatggaagtcattcccctgtcctgatccctgtggggccactggctgggtaatagggtggattgggcataaagggaggaaagtttcacccttgtcttggcctactaattgaaccttgttcctatcttagcattggaagccatttcaactgctgatgttttactgttctgctctattctgctgctgtgaggtctgacattttattaggaagtgaggactctggcc

SEQ ID NO: 87642 - DNA, 1052 bp, Homo sapiens
aggatgtgcaggtttgttacatagttaaacatgtgccatggtggtttgctgcacagattaatccatcacctatatattaagcccagtatgcattagctattcttcctgatactctctcttccccaagtcccaacagccccagtgtgtattgttccccctccatgtgtctgtgtgttctcatcgttggaacatagtttttaaatctagtggcctcttctgtcattggcagaagagtctaagctgaagtggtagatgaatggttgggattgagcaatagttgtgggtactgttgtcaaacctgatagatgctcagagggtgaaaggtaacggtagagaagaggaaaaaaggaaacaatcgggaaaaggcaaattgagtgaaagaaaacagaatcctatgttgagaagaaaggaagaatatactcagaccattgctttttaaaccctacgttttaagtatacaattaaccaacctttctttctgtttcttttcagaattatagcgttcagccggcctgtgaaatatgaagatgtggagcacaaggtgacaacagtatttggacaacctcttgatctacattacatgaacaatgaggtgagaaggcagatggatggggcagggacaagaggggcagatgcctaccttttttctctctgtttaccagagcctttaaagtttgttcctctaatatcatctgcaggttttcattttctagacccccttttcttaattccaacaactgtgggatctctgttttttactacatgggagattactcagccatctcagccatctccattccccctactcattcagtgcagatagctctaatattccatggtggaatcaggtatggtaccagggctagggcttatactgtctcctttacattttgtaggagtatcttatttttttccccccagcacagccttaacaagaagcagagggtttagcaggggctagggaggtgtgaaaaaccagtgagtaggtcatctattacagtcataaatgcaggattcttctcttagagtttcttctgattggagcttatttg

SEQ ID NO: 87643 - DNA, 1487 bp, Homo sapiens
ttttcagggagtgattattgttgggaaaaagaagcaaattgagctacttttaaacatacatatataagctgggcatggtagcatgtacctatagtctcagctaacccggaggctgaggtgggaggatcccttgagcccaggagtttgagtccagcctgggcaacatagcaagactctgtatcaatcaatcagtcaataagataaatacatatatagcaaccagaattttgttggggagggaagttgccatcattcactctccatcctgacttcctcctctgcagaaataattttctgctactcttcctaaactctctggagaattttatgagagggtatttacagctctcttttctgttttgcagattattacaggaatgcctgttattcctccatgtctggatcatcacctgttaaactggggcactaggtctcagcgctcatacatcattgaagctataaaactacattgagcgaatagtggtttgctgagacaaatagaagagtgagatttgggggaaagctgggtagctcatgtattaaaagcatgaaggtggctgagcctgcagggagtccttaggaaaagggtgagaagaccttgataggcctgactgtgtaaagatgtagcttggcctttttcctcttcttttacagaacagttcctctccccactctggggtgtccagacaggtgcggatcaaggcttcccagtccgcaggggatataaatactatctaccagccccccgagcccagaagcaggcacctctctgtcagtgagtatttcaacccttttttctccccctctattttatctgcccacattttaaaaaagcaacaagtatttgttaattaaataatcatcaaatatttattaactattactctgtgtagagtaatcctttatgcctttattttatttagagaggaagggcaaagaaataactgggatggtatcctgactctcaaggaacttaaaatataatgatatagtagtgtgattaaattccttttaaacatccctgaaaaagtgattgcctcagacatctgcttgaagacttccagctgtgtttacactcacttttgaccattcttgtgaagaatagagacttgtaaagttaggaatcgggtctaagtttgaattttgaccttaaacctcttgcttatgattcctgagaagtctttatacttcagggaagatagtgaccaatgaaacttttgagagagtcaagctaagttgtctggaaggaaaggagactattgacatagtacagtcatttctctgtgtttgtaggggattggttccaggacccctgtggatgccaaggtctgtggatgctcaagtccctgaaataaaatagtgtagtatttgcatataacctacccacatcctccttcatagtttaaatcatctccgggttatttataatatgatgtaaatactatgtaaatagttcttatgctatatttttatttgtatttttttgc

SEQ ID NO: 87644 - DNA, 1904 bp, Homo sapiens
tggtatgactcctgacctcagatgaccacctgcctcggcctcccaaagtgttgggattacaggcgtgagccaccacgcctcaacctatcatgttgtcttatctttcttccatcatactacgtttttgttcattcattcaaaagataattactggctgggcatggtggcttatgcctataatcccagcactttaggaggccgagttgggtggattgcttgagcctcaggagtttgagactagcctgggcaacatggcaaaaccccgtctctacaaaaaatacaaaaattagccaagtgtggtggtgcaagcttgtagtcccaggtacttgggaagctgaggtgggaggatcacttgagcctgggaggcagaggtttcagtgagccatgaatgtgccatggtactccagcctgggcaacagatcaagaccctgtctcaaaaaaaaaaaaagtaattaccaaagtatctactatgtgccagaaatatgggaagcaaaaaagacacaggccctgtccctgtggcctttacaatccatggaaagacagacatttacttcttatgatgtgattaatgtataattacaaactgtgactgaaaggtgtgtggtgctgcaggtgggctataactaagaaatgggctgggcatggtggctcacgcctgtaaccccagcacttggtgaggccgaggtgagtggattgcttgaggccaggagtttgagaccagcctgaccaacacagtaaaaccccgtcactaataaaaatgcaaaaattagctgggcatgatggtgagtgcctctagtcccagctactcagggggctgaggcaggaggatcacttgaacctgagagatcgaggctgcagtgagtggagattgcaccactgtactccagcctgggtgacagagtgagtgagactctgtctcaaaaaaaaaaaaaaaaaaaaaagaaagaaagaaagaaatggtgggctataactaagggatgggacctgatcctgatcttggggccaggaaagccttaggcatgaatgggatttgggaattaggcaaaagggatgcaaggaagagggttccaggcaggggatgttacaagagcagagacttgatggcaagaggaagtgtggtatgtcagaaatggaaagaagtccagatagctggagagctgggagcaaggggaaggggagggcaggatgaagctggggagggaggcagagccttgtggaccctggttaagattctgatcattgcatggaaagtagtgaaaagctactttagagtttttaagtgaagaggagtgggtgatgttacatattcgtatttgtattttgaaaagattgatctggctacagtgtggataacagattggagggggcaagaatgcatgcaagggaactgcattaggctaatgcagtggtccaggtaaagaaaactgggcttggagtaggctgatgaagtggagagaggaaggagcaggtgaacttgtgacatttagaggtaaaactgacagaacatggcgttttggtggttctcaaagtgtgttctggggatcctggggagtcccttggatcctttgaccctgtgagttcaaaattattttcttttttttttttttgtgacggagtcttgctctgtcaccaggccgaagtgcagtggtgtgatctcggctcactgcaacctccgcctcccgggttcaaacgattctcttgcctcagcctcccaagtagctgggactacaggcatgcgccaccacacccagctaaattttgtatttttagtagagacggggtttcaccacgttggccaggatggtctcgatctcttgaccttgtgatccacctgcctcagcctcccaaagtgctgggattacaggagtgagccaccacgcctggccctcaaaattattttcata

SEQ ID NO: 87645 - DNA, 1378 bp, Homo sapiens
tgaattttcataattctgatactttgtttccctatgtaattttttaaaattaattaaaaaaatatttaaacagaaacaagatctcactatgttgcccaggctggtcttgaactcctgagtgcaagtgatccttccctctcggctcccaaagtgctaggattacaggcatgagccaccaagtctggcccctatgtaatgtttaatgttggagctcggataatgaatattctgaaattgaagaccccaccccaacttttgtgcagagaaaatgaaagggaggaccttcaggacattgattggagaaaaagggattccaaaggccttttgttgctgcatttgaccaggggccagagaaatattttattatatttagatatctattacctctgcattggaccaggaactgggacatttttgttctggtatcagctgtgcactaactagttttatgactttagacaagtctcctaacctttctaggcctgtagtgctcatctgtgaaatgaggcaatccttgtctttgtaaattataaattatggagtgtaaacagaagcattaaggtcccacccgaactcactggaaggctcagcagggtagtaccatctccagcgccaggctccagtgttaatgagccaagaacatgccaacaagaaaagcagagcctctgctttgctctcctgccagagctccttgggatgccagccaagcatttttctccctcctggaaacttgcctttcaaactaagggggaggatggtacctttctaactattcttcccattgcatggggagaaaaaggacactttcatgttttgacaaaaaggcccatttgctggcccttgccataaagcctgggtcactggggggaattggggctgggggtgtggcttcattgtttgacttgccttacagatgctggatcccctgagcagtgcagaaaattccttgtctggaagctgccaatccttggacaggtcagcagacaggtatgggactgtgggtggtttggagggtaatgcataggcatttttggaattgatgggttgaggaagaagagttagctctggaggcccagggttaaaacatcatgcttctaggaaaagccttctccttaatttccccaacaccacgagaatgttatgatggcataattaaatgaatgtaataatagctcataaaatagcagctcatttattaagtacttgctttgttgttctaagtgctttacatgttttgactttccatataatatatgccgctctcgtacttttggcctcactgctgtgatctgaactgagaaggagtggactgtcagtgttttagggggagaactgaattctcatccattgctttaccatcattttttattccaagtgt

SEQ ID NO: 87646 - DNA, 1043 bp, Homo sapiens
caaaaaaaaaaaaagtctggccctgtcttcctagctttatctttgagcatatacataggactgtgtgtgcctaatctgtaggggtgtctgtgaagacagaaacagcctagctgctcatcaagtggatctgctattatgctatttttattatatggtgtatttgctacctcacagcgttctgaggattaaatgagaaaaacctcactttagaaaataggtaagaaagcagcagcctatcaacgatgatgctgtggctgtttttattactgccctgggcaaaggattctcttggagctctttgcctgttacagaggtgggaagaaaggccaaggagggagagggctgtgcagccaggctggagttgggtcagatgggggagatttaccactcagggtgctgtcaaatttgggtcacagactagtgaagggagggtggagaaagcaggagctgggctcagaaaagggctatttcccgcaaaatctgcttcccccacctaatgctgtggcaggggttagaaagggagactgcctggacgccctgcttggttgctgtggaagtgtgcgggagtctgttttttctttttgttttctccagcccatccttccggaaatcacgaatgtcccgtgcccagagcttccctgacaacagacaggaatactcaggtgagttccacagagcctgggtgggtaatgcagggtgtctgggtggggcctcaggtggctctgcttcgacttttctgagtcagtagctctccttgggcttgctgctttgaggtctcaggtgccttggggacttgggggcttaagtggctcacattgacctacccagaagccagtgattcccctgtcttactcagatcgggaaactcagctttatgacaaaggggtcaaaggtggaacctacccccggcgctaccacgtgtctgtgcaccacaaggactacagtgatggtgagttcttcttcacctgctccctgctggctgcctcaagaaaggacaagttgccatggggagggtgggttcgtccatgcagtgcctgtatttt

SEQ ID NO: 87647 - DNA, 1020 bp, Homo sapiens
gctaataggaggtgagacaatgaaagcaagaggttggagtaatacaaggaggggaccatgagccacgaaatgcaggtggcctctagaacccaggaaaggcaaggaaacaggttctcccctcagagcctctgacaggaaccagccctgccgccaccttgactttagccctgtgagactgattttagacctctgaccttcagaactgtaagatgatacatttgtgttgttttcctgcctctaagtttgtggtcatttgttaagagcagctatgggtagctaatacagttattgtagagttctttctgtcaagtctaagtgattctctttttccttatttcaagaagtacccaggtgtgtggtgagtgtaggtccatgaagcccacgtggacagacatccaagctgaggtatccctcagcttggcctgtcctgcacctcagcttgctgtgagaaaggcgcctctttctgcagtggtgggcaggacagctgggagtccagggctggctgaggggtgacacggggttctctctttccaggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggct

SEQ ID NO: 87648 - DNA, 1067 bp, Homo sapiens
cccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaagccagtgcccagggatgggcatctccagggagctggggattagtgccaggcagccctgccagccatgcctacatccccatgggcacagaacaagccaaagccttcgttgtatgttgacgatgcacttttatgaatgtagtttctatcgctgtttttagccttttcacatcatgtaatgtgaggccttgtacttgttaatttatatctcagatcatatttgatggtttttatatatatcaattctagactgttacaggtgacggacgcctcaagagagagaagagaaaatgaaagcagctggttttgcagaagtgtgtgtcgcatgcgccagttgggcctggaccctcctgtgtccatccctgttcccccaggggctctatcagcccctgtaccccacactgccctctgaagacaacacaggctcctgcttccacctcggcccttgcccagggtggggcctggccctcatcttgaccaaagctgctgtgtggcagctcggcctctctacgaccccatcttggtggctgcacactcttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttgaagacaagccaacaaaccctgcactccaaaaaagcaaaacagaccctaatttttttgtgccaaaaactgtggacatgctggctcagcatcctcaggaccaagttgttgcttaatttattgttttttaataactaa

SEQ ID NO: 87649 - DNA, 1045 bp, Homo sapiens
aggggcaactggaggaaaggggcagacacctctggactgacaatggtatcagccagatcaccccaggacccctctacttggagtcaagttctcttctgcttgaaaggcccaggctcgttgccaggcaccatacctggcccctgctaagcaaaaacctacctccaccccccacaactgaaagcactgccacaggacccctctgatataaatgatcccttttattgtaagtaatgcgcaacactggcctggctttgcactgcaagccctcggtcaagatatagtcaaataactatggctgcaggttccacagttccacaataaccatggctgcacgatccacaattcagacacagacatagagctggggtgggtggaaggggcaggagggtggcagagtgcggactgtccccagccctggcctctccatgcagagttggcccaggcagacacaccccatggaatgatgagaaagtgacggcacggccccttcccacagcaagcctggggctgccaggaactgcccttcagaacctttgggcccaggtcaccctgaagccccacaactttttatctggattagttattaaaaaacaataaattaagcaacaacttggtcctgaggatgctgagccagcatgtccacagtttttggcacaaaaaaattagggtctgttttgcttttttggagtgcagggtttgttggcttgtcttcaaattcattttcaaaacacattcccagtgaggtaagaccccagggggtggagctctgtaagaccctgaacctgggacgcacagttgagtcagccagcaccgtgctctgtatcctcttggggaacagggactggggatgggggtgcgggccaggaagagtgtgcagccaccaagatggggtcgtagagaggccgagctgccacacagcagctttggtcaagatgagggccaggccccaccctgggcaagggccgaggtggaagcaggagcctgtgttgtcttcagagggcagtgtggggtacaggggctgatagagcccctgggggaacaggga

SEQ ID NO: 87650 - DNA, 1064 bp, Homo sapiens
cttacttccaggtcaaagggctgggaagaagggagggagctagacagctggaaccagccagggaacgcggcagcttgcaccccaggcactgaagtgcagcgaggacaggcgccatcacccactggcagcctggccctcccgctctcaggcctcttcacaatggggtgcatatggtaagttggtgggtctgaaccaacccagaactgaggggtgaggtggagtttcagttccaaaaccactgtgggtgtgacagcatgaagccctcgctgtgaagaggagccctcccatttctcaatggtgtgtcagggaactgacacccacttctagctccctgcccccatcagggccgaggtagtcggggctggccctgtccccccatgcccgccccatggtgagtctgcacccttcctgtgacagatcccccagcaggccacacaatagagaatctggatctattgaaacatgtttaaaacggggttggtcacaacaggatgggcacaaatgggagcgggggaggggagtggggccgcaccagcccctgccagtgcctgaggctgcagcctggcgagtgcttttgcttctgcttctccacgctggtggttcgagatggtcccaagccccactggggcaggccctgccttgccctgcagaggcagggtggctccacttccccatctcctcccccatgggctgcaggggcatttatgatgcccaacaggtggcactgtcgcgctccttcctccctgtctccgtggctcagaaacaggttaagggtagaggtagatggggagacgtgggggccacacagtctccggtggcagtgagggagcttgggaccctgaggggggcatgctgactccttgctggagaaaaggcacctagataggggagctgggcttgggggcctcccagggggtcctggggtgaggtggggagggaggctgaacgaagcaggaagcagggtggtgggcagaccccaatcctggtttccaaaccctcaccggctgcgggagaaggaagaaggaaggagtcctggagcagagccctgccctggtcccctacgc

SEQ ID NO: 87651 - DNA, 1762 bp, Homo sapiens
ccacccagcctggcctccccttgggcatcttgctcccgtgtggcctgctgcagcgacagcccaggctgtggcactgcagggactgcctctcagacctcatcggatccacctgagcatggcagacggctgggcttcaaagcaggttcatctgactgctccttccctctagggtgaagactctacggtaaaaggaatttgatgccttggaaagggagagcggaaactgtgagccctgctttccagccatggcgaaagcgggtacttttgtgcaacccctctcctttcacgttggcctggctagggcggagctgccacgccagtgaccagcgtttctttgggaaaattggacttactccacttccaccttttccactcttcaaatgatcacatttgcatattgggaacagtgtatttgtgaagagactctcaggccttccagggaccaccccccccccccacccgctacagcccaggtcctggttctgtcctccccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggtatccctgctggcctgggcctgggcttcgggagagcagagggtgctcaggagggtaaggccagggtgtgaagggacttacctcccaaaggttctgcaggggaatctggagctacacacaggagggatcagctcctgggtgtgtcagaggccagcctggggagctctggccactgcttcccatgagctgagggagagggagaggggacccgaggctgaggcataagtggcaggatttcgggaagctggggacacggcagtgatgctgcggtctctcctcccctttccctccaggcccagtgccagcaccctcctgaaccactctttcttcaagcaggtatcgtagccccttcgttctggttctggttctagttctggttctaacaactcacaatccctttagctttctctcccctccctttgaatgagagaaactaccccgcttccgaagcccctgaaagacactgctccttcctctcatggagttggctccgacagcccgtctgccaccaggccatggttccttgccccatggtgtcctgggacccagagcaacaggatctgtcacccacctctctcttctcccccagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagaga

SEQ ID NO: 87652 - DNA, 1042 bp, Homo sapiens
cttggcctcccaaagtgctgccactgcatccagctataactatgttttaatgaaaaacttcaaatctacataaaatagcatgactccatttacatatcaccagattaaaagcttatttagctctgtcatccaggctggagtgcaatggcacgatctcagctcactgcagcctccacctcccaggttcaagtgattatcttgcctcagcctcctgagtagctgggattacaggcacctgccaccatgcccggctaatttttgtatgtttagtagagacagggttttgcgatgttggccaggctggtctcgaactcctgacctcaggtgatccacccaccttggcctcccagagtgctgggactgttcagtgctcttgtatgctctagaacacctcttgccctacctcctacgaatgcttttaatctgtacttcttatctgtaggactcttgtaaagtgtacctaggggtactgtgttccgcatcccattcttcctttttcactcagggctgtagtttccagacacatctgtattgctagctgtgtacctttcatcttttcttctaattgtcaccttggttctgggaagagatctaacacttttactcatccatccttctggggacagacactcacactacccctaaccaacacacgtgtgaatggtgacatccaaacatgtcccctgatgggtctgcacgagggtttctttagggtgtacatccagaagtggcattgatggttctggttctgtgaccctgactggcagcaccgggcatcttccaccacctggacaggaggctccccgtccttgccacactgggactcgtccagcctcccaaccgctgccagtctcatgtgtataaggtgacatcttgtttttcatttgcttttctctgattgcgagatttgagtggctcttcctatgatgggtttgtcttggggtttcctcttttgtaaacttcatatctttggcccatttttcttgctttgctgtccatttcttgttgatttgcaagatttccctgttactaatctcctgtg

SEQ ID NO: 87653 - DNA, 1033 bp, Homo sapiens
tagctttgtcaccacaggagattagtaacagggaaatcttgcaaatcaacaagaaatggacagcaaagcaagaaaaatgggccaaagatatgaagtttacaaaagaggaaaccccaagacaaacccatcataggaagagccactcaaatctcgcaatcagagaaaagcaaatgaaaaacaagatgtcaccttatacacatgagactggcagcggttgggaggctggacgagtcccagtgtggcaaggacggggagcctcctgtccaggtggtggaagatgcccggtgctgccagtcagggtcacagaaccagaaccatcaatgccacttctggatgtacaccctaaagaaaccctcgtgcagacccatcaggggacatgtttggatgtcaccattcacacgtgtgttggttaggggtagtgtgagtgtctgtccccagaaggatggatgagtaaaagtgttagatctcttcccagaaccaaggtgacaattagaagaaaagatgaaaggtacacagctagcaatacagatgtgtctggaaactacagccctgagtgaaaaaggaagaatgggatgcggaacacagtacccctaggtacactttacaagagtcctacagataagaagtacagattaaaagcattcgtaggaggtagggcaagaggtgttctagagcatacaagagcactgaacagtcccagcactctgggaggccaaggtgggtggatcacctgaggtcaggagttcgagaccagcctggccaacatcgcaaaaccctgtctctactaaacatacaaaaattagccgggcatggtggcaggtgcctgtaatcccagctactcaggaggctgaggcaagataatcacttgaacctgggaggtggaggctgcagtgagctgagatcgtgccattgcactccagcctggatgacagagctaaataagcttttaatctggtgatatgtaaatggagtcatgctattttatgtagatttgaagtttttcattaaaacatagttatagctggatgcagtg

SEQ ID NO: 87654 - DNA, 1099 bp, Homo sapiens
caggagtttgagaccagcctgggcaacacagtgagaccttgtctctacaaataacaacaacaaaatattttttgttttcttatcttaaagaggaattctatacgttggcccttgaaattgagataagcttataacttcagaagtcttcagtcaacagtttgccttcatcatctctgagtcggtgtgctggcaccctttgttgttggcagtttccctatctggcagaggcaaagcagtgctgggtccctgcagaggcagcagggccttgtttttcctatgttggcaggcacctgcttaggctgttcccatgactctgagaacacccagaaagtgccaggtccccctattgtccatgctgccatctttgtgttgagcggcatccttcagtgccatttggttctgacttcagcttcatcattgcttccagggcgagctgcatgtctccaaactcttcaaccatcccaatatcgtgccatatcgagccacttttattgcagacaatgagctgtgggttgtcacatcattcatggcatacggtgagtgggaaagggttcttggtagaaaggggttattgggactctgttgtcagattgcctgtgttttcctcctccattacctttcactgcctccatgcaatccttttctgcaggttctgcaaaagatctcatctgtacacacttcatggatggcatgaatgagctggcgattgcttacatcctgcagggggtgctgaaggccctcgactacatccaccacatgggatatgtacacaggtgcgttcttaggcggcctttcccatgattacagtgggtagctatgcccctgagccttcaggtaaagtgaagtttgactgaagttaatgaagccagagtttaaaatcaaggatctggattcttgctgaagatctctttgctctgaaaagaaacagggcccagcgcgatggctcacgcctgtaatcacagcgcttgggaggccaaggcaggtggatcacaaggtcaggagtttgagaccagcctggccaacatagtgaaaccctgtctctactaaaaatacaaaaattagccgggtgtggtggcacatgcttgtagtcccagtagct

SEQ ID NO: 87655 - DNA, 1031 bp, Homo sapiens
ttgtaacagtgtataagtgctatgagatattatgagtataccactttctttacatattaaagcataatttatgttttttgatgcagtgcatataatttttatgaagttttcaatttaggatattacttcttttttgatttggaaaaaatagttataggtaagggcagaagatgctatagttccaattcacagtctgtatcatgcaacttatttctgaatgttacttaatcttttttctaatgtttatgcatataagaacaatttatattagaaagagtaaacttcactgttaattaagaggaaaaaaggaatctctccatagcctgaactctgcccagtggaaagaatgcccccaagccaaagtgtaacaccagtccttaagggaaatacaatcttgattccattgcttttaaatatgagctccttgtctgcttcaacgtagcctaattcaggtgaaacgaaaccactgatcagaatgacagaaatctaatactcgtttgaaataggccagtaaagtgagccatagattgatcctgctagtttggtcttactagtttggcccttgtgaacttggcagaaaatgtaagcagccatgtctttagaacccctagtggataaagaatatgcaacttgttgtgtgccattttacaaactaacagggtcttgtgaataactactgtttcatctctgttttctgtgttatgaattccagtaatagttttcaaattgacatcagtgatccaaggcatctgtaatgtagaacgagtaagatggaaccaatatagggaaggcaaaaacagtcttcattattacagccagtactatctatttctcatctgtcaaatttaagaattattcatcaaataggcaaagaggagtggagaaaggaatcttgtttttagttcaagattctgttaaaaacttttccatagaaatgattcctaactgtactgcatgattctgttttcatagttgggattttgtttgtctgtctaaaggctgatagctaatttgttgcggcttggaagaaa

SEQ ID NO: 87656 - DNA, 2644 bp, Homo sapiens
aggtatggtgtctgtgctaataagaaatttgcaatgaataacctgatggaacaagattcttaaaatttattgaactgaagtagaatgtatcttctggcagttatacatttatgatataatgccatcatgaatggtatggtgaacatcaggctaagtgttccctgggtacagaaaaaaatcaaaccagaataacaaaggctggttaattatagtagtttctttcaaaactgagattttagtttacctttgcttcatttgaagttgatttaatttttattcactaatgtagatattggcaattatttttataactatcttctagaatgttatggtgcaagcctaagtttttgaataatactataggcagtattctaatttggatttttttttaacatatgtttcaagcttaatttgaattctctcgtccccactccctttctctatttattaccccttctttctctaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaatctcagagtgccgccttgactttgtggagttatcctacaagagtataagctcagaggaaaattctttctgttcgataaaagtcagcactgaaatgcttttccttcaaaagagttcatctgaatattccttttgttattaccattcaatcattttaaaaacattttatatttttagagccccatatgttatttatgggctcctccctgcattccacctcttaagactccattaactctcctgtgaatgcgaggacaaagagaggaggatgttgtttagtgtcacaaactggaaaaccactaagtctccaatctcatttgcattgcctggatgtttagcaatgccaaaataagcactggactgtaagacaaagacctggcttttagtgccagcagaactaattactaatcctttgactttcggcaagttattaacctaatgtgaagtgaggatagtaattatttgccctgcct

SEQ ID NO: 87657 - DNA, 1826 bp, Homo sapiens
gacagaactaaattatatatgctgtagtagattatccctaaatttactctgagcctaactcaaaaataagataataagatgccttgttataggaagatagaataggagttggaaataaaacataaaaatgcatcaaaataagcaaaaatgtatctaaaatatgggcctcatacttaaatataggctcatttctggctccccaggtgagatggaatatacccttgcctggagggaacatcactggaggtgttcaaatataggataaagatcacttgagaatgcatccatcagatagacgagtggaccagatgacctgtaaagctccttcattatatttgacttgggtatgccaagccaaatactgtgctgattatgtgcaggtatctgttcatctaagtgtattgggtgacttgtgtacatggaaaacatctttcttgtattccttcttaattgccttttcttttatgacagggaaggtcagcctttaaagctacctgacactaagaggacactgttgtttacatttaatggtaagtattctgggtcctttctgggttcttagtcttctctgagatgaccttaaggagagtattgtttcctcctaaatgatagctttaaaactacgtcaaaactataagcctgtgcttgcttactgatttccagatttcttcaagaagaaattacctattatatattttaatttatattttctgctgcattttaactgcctaacaaacttagagaaatgagtctcttaagattaaaaaaaaaaaagagttgggtgacctggaaatattaatgctaccattaactcagtaggaaaaatggctttgttttccagtgcctggctcaggtaacacttacccaaaggatatggaggcactgctacccctgatgaacatggtgatttattctattgataaagccaaaaagttccgactcaacagagaagtaagacccaatgcctgtattatataaattggcacctttttttgtttcttctcaagggggagggcagctatcaatgatttcagtgactgaatttttgctagttgatttagaagtgccaaatgggagtagttttatgaaagaatgctaaacgggattttgttgctgttgactagaaatggatttcttatgaaatactttgtttcttggggaagggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggttagacaaacttatcactggggtaaaactacgatttgtaaggatgactgcttgtgttctgttggttgttaaggtaatctttgtaggctaaaagtttagcattttctcaacatttgggacattgtatcaattgataacactataaagaagaataaataatccttcctgttcaagccgtgccacactgagtctgtgaacgtgaaaaattatcagtattatcctgttcccccagcacaatttcattttgaaaattccattatcagttttcgagccaaacactttggtagaaagaagttagaaattttaatagaaggcagcacatgcgccctattatctaaataaacttgctatgtaaaatttaaaatctgattatagaattagagatttccaatatttttgtttgtatttttgttttctgttttttacctaactagaatctcaaactcaaaagctttttgggtatagtatgttatatttgaaagctcggtatgatct

SEQ ID NO: 87658 - DNA, 1073 bp, Homo sapiens
tcccttttaaggacttgcttgattaagttggatacacccaagataatgtcccttttggttaattcacagtcagctgattagggaccttctgccataaaacagcctgattatgggggtaatattccatcatatttgcaaatcccaatcacttaaagggagagtatatgcaccagcggggagggaatcttaagggtcatttagaaatctgcctatcacagaacctaacaggtgaattttgttgttttttacatttttttaaaagcaaataaaagtaaccatgaatgatgaagacatggatacctacgtatttgctgttggcacacggaaagccttggtgcgactacagaaagagatgcaggatttggtatgtcaggttgctccaactcaaatatacgtagaactgtgtctccttagcacacacatattcagcttcattgcataataaaaggtcatatcttactttcaattacttcttcctctagagtgagttttgtagtgataaacctaagtctggagcaaagtatggactgccggactctttggccatcctgtcagagatgggagaagtcacagacggaatgatggatacaaaggtaaatgcgacagaagacatacatttgccaggccttggcatttacaggacactctccctaaaagtctcattgtacaagttcatcattttatggcaatgtattagttttacattcctttcccacacaaatattaaaataccttctttaagcaataaattagcttgtcaaaaggacaatttgattagtcaagaagttctctaaatcaagagcaaattgttcctgggattgctaatgactttcaggtttttttttgaaaaaggaatatagcttctaatctttttcgtcatgtcatttagtcttttttttttttttttttgagctccagtttgtgtgggagaagagggatgtgtagagagccctcctcctttgtttttaaaaagatggggtcttgagatgttgcccaggctggagtgcagtggctattcatgtgtgtgatagatctcactgcagcatcaaaaacttctgggctcaagtgttcct

SEQ ID NO: 87659 - DNA, 1154 bp, Homo sapiens
atggtgaaaccccatctctactaaaaatacaaaaattagccaggcgtggtggcacatgcctgtaatcccagctactcgggaggctgaggcaggagaatcgcttgaacccaggaggcagaggttgcagtgagccaagatcacaccattgtgctccaacctgggcgacaagagcaaaactccgtctcaaaaaaaaagaaattaaataaatgacttgatgacttgttgaagattttacagatatgtagtgccaggatccagactagaacccaagcctcttgaccttacttcattgttctttatataatgtggtctgaatctaatagtaccaaataagagaaaagcaggagaggtttatagatttttactgtttataaaatctgatcagtatgtatagaatggcaatccattttggggttctctttttttttaagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggtgaggctctttttattaatttattggaaaaatttgtaactagcacctttcccaaacattaaaattaatcctcaggctcaagagacctttactgtctggagtcttcattttcattcactaggtagagctcttctaaatgttctgtggtaagtttccaccttttacattaacagaatgaattgtgttcttctattgaaaccctgactggaagaggggttagagaatagatactgtttgtgggtgagaattgtattatttagaactttgcaattggctgggcacggtggctcatgcctgtaatcccagcactttgggaggccaaggcaggcagatcacccaaggtcaggagtttgagaccagcctggccaacatggtgaaaccctgtctctactaaaaatacaaaattagctgggcgtggtggtgcgtgcctgtcatgtcag

SEQ ID NO: 87660 - DNA, 1032 bp, Homo sapiens
cgcctgaccttaaagctccagaacgcctcacaggctcctcagatactctgacgggaaactgcagttgggtggacagtgttcatgacccatctagaaagtgggtctgcgaatgaagaaaaagtggcgtcaaggggctagccaaaaatcccaagagaaaacgggttggacagaaaccatatttacatgaacatgcctatagtttaaactgttgcatatactactagagcgacactcttgcctctggccacgtggtcccacacagcatggccacctttagcttccggagcaccggttccgtgtgacgtcaacttgacggaatcctaggtaggaggattgggataggcgagggcagttccggcccaggggcggggattatgtaattttcccaaaagccccacctcgcctcagccgggcgggagagagggaggtctcgcgctttccccggggttgcgtcccgccccgcaggctgcgcgcaggcgctgacgagccgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacaggtaaggagcgggccaggacgcgctcgtcggcgtggccgggccaggccgagcggtgactccgagttgcttggcctgtagcccggtccggttgagataattgtaatggtttgggggaactttcccacggagctgtgagcaaatgatagccaaaagggcagagttagaggaaatgtacagtgtgtgccggaggatgacattaggatgtattgattctcttgggtggggagaaactaggcaaaggggtttaatagaagcaaaaacctctgtggccagtctcttctggaggtttctaaaatgaaacgtgtttgtatccaacacatataaagagacagaggaaagtctgc

SEQ ID NO: 87661 - DNA, 1046 bp, Homo sapiens
ttggggatatcatattcatgtctttaggagttggtatttgagatatgctttgaaggataggactttggtaggtactcacagtttataggaaagagatttgatgtgaaggggatccagttagagggaagaggattcactagagtgcttgttttcctggaaaactgagtacgtgtggagagaccctgggaaatatgaatggtaaagtagtttgatgccacaatggagggtctcattccagcatgattaactgtggagagctatggaattgaggagagtgacataatcagaaatgtgtgttctggaagaacctggaaagggttttcgataagcatctgaatactgacctcccttctgtgagactttttctggttccacggtattaacacacactatgctactctaccaaaggaggtaaaacttgcttttctcttttcactgtgtgtctcactattacttcatcattttatgctttactaaacagaatcacttctcatagactatggaagatttgctggttttagatgaagcatctggatgtacatccacattacttttccaataaaacagacattcttgggacagtagtcaggggaggattacctgtcaaatgtcattcatctcagagaggccttgcctgacttaagtctgcaatagcttgcctcttaccctcttgcttgcttttcatagcacttttgctacctggaattacatgatttagtttttctttctcctgggccagactgtgaactctgagtatggctgcatctgattccattactgtatccttagcaccttagagcagttactggcacaaaataggcactcagtatattttgacttagtgatcactctagtagtgctgtgagagcttgataataaagttttttttttttttaagacagcatctcgctctgttatccaggctggagtgcagtggcacgatctcggctcactgcagcctccgtgtcctgggttcaagagattctcctgcctcagcctcctaagtagctggaactatgggtgcgcgccatcacgcctggctaatt

SEQ ID NO: 87662 - DNA, 1038 bp, Homo sapiens
gctaaattcttttgcttggccttttttctttttggagggaggaatggagcttcacccttgttgcccaggctggaatgcaatggctcagtctcagctcaccacaacctctgcctcccgggtcccgggttcaagcgattctcctgcctcagcttcccgagtagctgagattacaggcatgtgccaccatgcttggctaattttgtatttttagtagagacagggtttctccatattggtcaggctgccctcgaactcctgacctcaggtgatctgcccgccttggcctcccaaggtgctgggattacgggcgtgagccaccgcacccggcccagatgtcaaattttatagaaagtataaacttttctagtgcttgaactagatgaagatttatttttagccagtgttctgaaaaaggatttatgtaggcttaaacaatatgttctaccacttttggtgacctgtttcttatgttacattgcttatgtcatcttcagtttatagtcttaaatatatcttatagctggttcagtcctccgaaaagtaggttgtttgtatgcattgcttctctttaaaacaatttctcttcatcaggaacatttggtttgatagaacacccgatcatgccacagtatatatagtggcatttttaaaaatctgagattgccagaaaaactcacggtgctttatagtgagaaaaagttgtgcagaatgtgtataaagccttgggaaaaatcatttaactcttctgaccttgattttcaaatgtataatgcaaatgattaattttgatcagtgatcatcaatttgcagtatataaaaattgcctaggccgggcgcggtggatcacctgaggtcacgagctcgagaccagcctgaccaacatggagaaaccccgtctctactaaaaatacaaaattagctggatgtggtggctcatacctgtaatcccagcttactcaggaggctgaggcaggagaatcgcttgaacctgggaggaggaggttgtggtgagccaagatggtgccattgcactccagc

SEQ ID NO: 87663 - DNA, 1050 bp, Homo sapiens
attaaaaatgtctccagacattgccagatgttgcctaggggcaaaattgtcccagattgagagcaacctttccagagtcagatgtatgtggtcttaagctatactttgaggaaggcctatctgcctgaattgaaagcactttatatctgtaattttatcattaacttaaagcaacttaaggttatgtatttgtgaagcaagcatttttgttcatttttccatgtgtggcacattattacagataaaattgtgcagtccatatacagccaatttatacagcatttagttatttctctttgaaaaataattgtcaaaatgcaatttgatggcatcaaaatgcacttgtcaaatacatagctaaagctattatggcacttgttccaatctaaaaattgtttctttcagtgtttttagttgatgtcattctatacagccttttgtttcattaggatcaggcagctagagacatgaagaggcttgaagaaaaggacaaggaaagaaaaaacgtaaagtaagttgttttcttctccctcacaaaggttacgtgaaaactgctgaagtattgcaaagtctattcccccaaagtttatagagaaaaaatattgacgtacacttgtgtactttacttgaagttattcctgtatcttgaatactttaagaatagagatggcaacagtctttgcatttgcaataattaaaaagcattcagtttggtagaatagtatttggtctttgactataaatagttgtttagtaaacacaaggaatgaattatagtagagtttaggggagcataattattaaagtttaggctcattgttctgagtttgtcgcataattaatataaaataggtttatgcctatatggttgattatgagaagtaatggcaactgtatcatgaaaactatgtatagttgaacctttgaacaacacaggtttgaactgcgtgagtccactcatggggatttttttcaaccaacacaggtggaaaaataatattcacagtataaaaacctgtgtataaggagggctgtaataatacctaattt

SEQ ID NO: 87664 - DNA, 1214 bp, Homo sapiens
acatatatataatggggtggatagtttatagtgtgctcattgctgctttgttattattagtgttgagagttcctgtgctgtgtggaattcaacactaatctgctgtaagtatggagctgggtatgtggaacatttgcagggaagtttgtttctccgcttgtttttccaggggtattcgagatgacattgaagaggaagatgaccaagtgagttcctatgcagtatttctatcttttatttttatccacaaagtctatactggggacaagctagagcttgccttcactcaaaatggccattcctgacattcagcagggaatgtcatttgatttgctccttttgtacctgtgtgaccaattggtaatacatagattcacatggctttcccccatattgaagatggaatttttgatcaactgtgacatccaaagcaaatacgagctttattcagcttgcttctttttaaatccaaaattaatgtttattctgataaatcaagtggtagagtagtgtgggatctattgatggcctctggtaacatctaacctctgtctcttagtaagtgtcctgtttgtggttcttgtatttcaagctggaacattaattactgtccattagtctcttttcccccattgttcagttgtggagtgatgagaatcagagtgagtggtagccgtttccaggtttgtgacctttctaattagcgttaacttccaaacttggattgttaaagccacagcatgtgttctatggctctgggcagggttgatagacaccccactccaggaaggctgtggaacagacagatttgtaagtcttctattaaacaagttgcaacatttaatagtactaactgtttaattcatttcttctgattgttcttctgaatattgctattattaaaggaatcattgctagtaaggatcttgccttacttggtaggtatgttaactgtgcaattatctggtacactatgtgcgctaattacaggagcagaaacattctcaattgtacttgggtgtgattatgttcttgtgctttcctgcaggaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagaggtatggtgtttcttgc

SEQ ID NO: 87665 - DNA, 1703 bp, Homo sapiens
tcagtcagttttatatgttctgtgctggatgggctagtgatgaagggtgggagtccccatctaaaggaagaggaaacaaaaggaatagatgttaacagatgatatcttagaatattttgaaatgaagataaacttgtctgtcaaattacatatagtatgctttattttaaaaattagaataaactaataccttttaaaaatatgcatgtactaatttcagaatggtttaaactgcctaccagaaagttttgggctgcacattggctacattggtttaaggtgctgatagatggtaaatgaaacacacagaaaaaatatgctatgctatctactctaatatagacaactttctcgcctgtgtgcaccttatcagttgctacacgatgtttaaactcctgttttccaggaggggtgtgtatttgtgtgtgtacacttgtctgttttccaagaggttactcatctccccagtgacccaagaaaaattttaagtaaaacccctgaaatcctgattggaaatatcaacatcaccagagaagcattgaaaggttaccactttgggggacaaaatggagattataagccccattcttcacctaggtgcagtttgaacagggcttgacagtggctggaccatcactaagtgagactttaattcatcaagcataactgaaaatggaggcagtagattatatcttggtagccagcatgtgtagacttgtcttatttggagcccacttggaattttcatttcaagagtaagatacattaatttttttctaccatctggttaatacttaatgcaaaatggcaaaagaacagttatggcttcccaattcattgaacaattttttttccgttttatttgttatgagaaaattaattttgagttaagaaatttttaatcatttaaaattgtatgacaattatcttgggaatatttatcatggagtttttaatatgaggtttatatttgttaccatttgaggtttttccttttcattgtatgattttggcttacagacttgtatttttacttcatactccagctaaaatgctagatccaggtaagtattgttgaacttcaaatgctgttaatgttgaagtacaagtcattctggggagttgtctctatctctaggtctctggtgctgcacctcctagaccaggaagtagctttgctcattttgggtttgacgaacaacttatgcaccagattcggaaatctgaatacacacagcccactccaatacagtgccaggtaagtaaaacataatgaaagaaaaataaagtagggtagtctttcatgactatattaatttaaaaacaaatcacagcagtaaaacagtgtttagtgtagaaccttgttgataaggatagaggtatttatcactcttaagaagtcactaaatggctgacaaatattcttttgtatctgatacgtatgttgaaaatatgatatgaagaaaataatttattaggcctaaacctaaccaaaaaggttcgtatatagacaaatttagcactgtcaatgactagaattccttcgttcgtcacttgaaaattctcattcattactgaaagttttagcttctttttcccatttatatatgggatttatttattcttatgcagaacattctcattttctgtatatgaatgagatagtctgtaccttcttaaggggggaaaatttttaaaatttt

SEQ ID NO: 87666 - DNA, 1088 bp, Homo sapiens
aaaaactgcttctggccactttcccacagaatttaaatcacagtgtaaatgaagatgccgattgagttttcaaaatttctgttcctttgagctaagtagtgcataaggtatgtggctgttggaccagtatctattacagtctgagactagagaattagcacttttgccaggagtgcaactgcttagaaagtccctgtgaatgcctttaattatacttactgttcattttgttgatcttatagggtcgactgatagatcatgtgaaaaagaaagctaccaatcttcaaagagtctcttaccttgtgtttgatgaagcagatcgaatgtttgacatgggatttggtatgccttgaataccagtttcttctgtccccatcctcatgatactagttttttttccatgtctttctagactgttttttcagcatgagagaagctaaaaatactcctggatggggttagactatagaaatatagctaagatgaacatttttaggagttttctctggaaaagtatgttaggttttattgggttgaggaaatttcaaagtgcctttgtatataaggggaatattttctctgtcttcatttttatccatatgcctttgatcatagaggttaaggtctgtgttcttgggtagatgaatgtcagatcattcgaggccctttgctttcctatcctcgtagctgtctttactgattggaacactgctagacctagcccagttggatggagggaaaatttttcacttttatgctgaatgatatgtttaggagcttcttttttcttgagacagagttttgcttttgttgcccaggctgcagtgcagcggtgcgatctcactgcaacttcctccttccagtttcaagcgattcttctgcctcagcctcctgagtagttggggtgataggcacctaccccacagcctggctatttttttttttttttttttttggtatttttagtagagatagctgtgttgaccaggctgcgaactcctgacctcaagtgatccgcctgcttcggcctccgaaagtgctaggattacaggcatgagccactgtgcctggcctggggtttctaattt

SEQ ID NO: 87667 - DNA, 1029 bp, Homo sapiens
ttgggaggtggaggcgggcggatcacctgaggtcaggagatcgagaccatcctggccaacatagtgaaaccccgtctctactaaaaatacaaaaattagctgggtgtggtggcgcgtgcctataatcccagctacttggaaagctgaggcaggagaattgcttgaaccagggagtcggaggttgcagtgagccgagatcatggcactgcactcccgtctggcaacagagcaagactccgtctctaaaaaataaaagtcccttacactagaaggcctaacatcatagaatctgtggtggtgacttaacatgcctgtatctcagctcaccaaacccatgcgctttgcctagataaaggaaatgtggcttattagcactagcatttctggttactttgatcttctgactacagatgaagaataaaagaatttggttgctttttatttcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcaggtgaggggctgggcacactttcaattgctcctggttataagaccaagacattttagcagtcctggaacagataacataaaaacttgacaagaaagttgggtggctaggaggatgtggggcttatgaggtacagataggaattgtgagatactaaaattcatctagtcttatctggtcttcttctttcaacagcatctgttttgaaaagctattcctttgtgctaaaatctgtcgctgtaatttctaccccatagcacacttaggagtaaatttaatctcaaagatggttactattctccttactgctcttcccccacaaaatttttcttctgggaggctaaaaatgtgtgatgcc

SEQ ID NO: 87668 - DNA, 2069 bp, Homo sapiens
cagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccgggacctgtggatcgtttgtcatttctgtctatgaattggtacatattaagaatagtgccgcacacagtgtagggacagatagggaagtgcttattaaaactgtcagaaaagacaactcttccattatcctggttttattcaggaataggatgggggtggggagggcttaagtggcccacacgtccaggtgtagactgactacattgagtatcgctccaacaccgaacttccctttaacggtttaaaaaaagggtcatgagtgtcaacacagttcagcagtgttttcatgggagaccttcaggcaggcaggaggacatcctcctctctgctcaggaccaccacgggagttctaggcactccacctcactgttcttcagacagctgtgatgtgagcaggggctaggccggtaatcaagggggccagactgagccatgccacacccttcctcctagtccccatgctctcctgggag

SEQ ID NO: 87669 - DNA, 1474 bp, Homo sapiens
caaccaccacgcccagctaatttttgtatttttagtagagatggggtttcaccatgttggccaggctggtcaaactcctgacctcaggtgatctgcccacctcagcctcccaaagtgcagggattacaggcgtgagccaccgtgcccagtctggtaatttctttagaaagcctggaatgttggatattagacagatgtcctttccactcaggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggagggtaagtgatggggcctccagagattgggtggggtgggggtggggggatggggaagaggtcacctgacaggttcctttgcagatgctgaagaggctggagcagaccaggaagaaggcagaagccgtggtgaacacagtggacatctcagaacgagagaaagtggcacagctgcgaaggtaatgggaggacaccacaaaggtacacagggctaaaagtgcagcagaaagcaagcctctaacctcttctcttcccccctgtagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctgaataaaaccaggataatggaagagttgtcttttctgacagttttaataagcacttccctatctgtccctacactgtgtgcggcactattcttaatatgtaccaattcatagacagaaatgacaaacgatccacaggtcccggtagtaaaacatttactagagagcaagcagaaaggaatgcacatcttaaagaaaccttcacaaagtcacaaaagtcaaagtttgtatatttcttttcctttttataaacgataaacaaaaatcatcaaaatcatttc

SEQ ID NO: 87670 - DNA, 1419 bp, Homo sapiens
cagtggaaacaaactgtgtagacggtattctcaggagatgattgagatgctgtctgagaataatttttaaaggaaaaccagtgttgtagaatatgttaagatttggtgctatgtgggctgtaggtaccttccttaagacctatttgtgataccactgagacaagacagctgagtgggatagatcagtaacccagcctagaacgggatgttgtaaacaggccattcactaccctggatctgagctttcccatctgtgaaaggataatggatttgccagtgttctttctagtgttgctgagcatagactgaggtgagggacacagaaaaaaaaacagtatatttccttttaaatagtttacctttgtttctgttacacttcagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcggtaaggggcacgtgtgcaccaaagggaatgctgccactctgaggaagtgttagggtgggtactaccagagcctgagtagggcagcaagggctccaggcaatctgggtctctgagccccctactttcctttgggtctacagtatgcgacttactgaagtgcaagatgataaagaggaggaggaggaggagaatccactgctggtaccactggaggaaaaggcagtactgcaggaagaacaagccaacctgtggttctcaaaggtaaggagaggccgggggcaagactgcggggagatgagtcttccttgggagaagggcagctgatgttctcctatcacagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagaggtgagtagttgcagctgagagaagggatggaaaggaagcggtggcttgaaccatttctctaaattgggggttcttaatcttggctgcacatggggagggttaaaaatactgtactgacgatcctgatttaactggtctggggtacagcctgcatggcaggatttttgcaaattccgtgggagtgcggtctgagtagtacagagtggtggaatcactcagagtc

SEQ ID NO: 87671 - DNA, 4102 bp, Homo sapiens
cagagaagaattccgggtcaatgggcggggtgtgcggcgagaccacactaagggaaccatgatgggaggggcggctactcgagttcaggggctttggaaggggatgaggaaggagtagaactcctcctcagtgttgcctcattgaaactctgtttatagttcttgtgatatgccttcctagtctcaactttcaacttacaaaacccaaggacagagtattgagaacaatctagggccacactcaaaatggcggaaaacctcgagccagggacgcaggggacgcaagcggaagcggaagtagttagctgcatacttgtgcggttccaagtgtggagaaagcggctctgggtctaggtagtgtgcggagaggggcgcggggtggaattgctgcgggaagtgggaaactggaagtgggaaactggaagtggaatctggtgctccggaaagagacgttcccaacttctactttctccccagattgagggatactccccctttccaccatgggcaagaagggcaaagttggcaagagccgacgagacaagttttatcacttggcgaaggagacgggtgagtccggattcgctcagtctgcgagcgagcgagcgatctctgcccggttcgcctgctctttgcgaccattatgtacctctcctgcagaaggggtggtcggttgcgaggccggagaaatcctactagtgaagcagtttgcgcacttggttgttttgtccaggttaccgttcccgatctgctttcaagctgatccagctcaatcgccgctttcagttcctgcagaaagcccgagccttgctggacctgtgtgctgcgccagggggatggttcgtaacactcgccacaggttgctcctggtggccgctttctgggttctgagctgggatggcttccagtttcactgcgggaggggaacccgaatcccggtcctcttgggggccgtttcctttcttgattgcagagaaagggcttggaatacgtgcctatgatatgctttggccagtacacgtaacaccagggatgagagatcagttgccaagagggggaaaaggatggctctaggtttttaaatttctgttccttttataggctgcaggtagctgccaagtttatgcctgtatccagccttattgtgggtgagtaacggacagctctccttggtgttttaaggggtgggtgtataaggtattttgtcctgtatttctctcctccctgcttgaagcaaccttttagaatactctgacctgatttcttccaggagtggacctggttccaatcaagcctctccccaatgtggtgactctccagcaggacatcacaacagaacgttgtaggcaggtaataggagtctctctcttccttccccctttatacggaaacatctacatccctgaaatcctctaaaggcaagtttttcctttttaccgtgctttgagcacgttcttgcctgacatctgtacgacaagacctatggcattcgtagtgtccactccaggctttatttagagtcagggataaaggtgtttggaattgggagaagggcagagatctttagtgaagtcttctcctgtgaattcagtgtcagactgtaatctccatgaaggtagagacatactgtttttgtttactattgtatctcctgtgcctggtactgcatttggcccatgatgggcactcagcaaatgactagatggacaaatggctgaaccagggccattccagtgtttctgtttccatagttccttttcttctctttaggccctgaggaaggagctgaagacctggaaggttgatgttgtgctcaatgatggggcccccaacgttggggctagctgggtccatgatgcttactcacaaggtacagggagtgtggtgcttggagatcaggtgatggtggaggtgggcgcatgccctcctgggctgcagagtgcgtcaactaattgtctctatcctacagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggtgggcatcatttcctttctcttgatccaggctcccaactcccaaagcacactttttaatatatcctgtcatttttaggattcctggcccctgacaaggttgacagtaaattctttgaccccaaatttgcctttaaggaggttgaagttcaggctaagaccgttactgaattggttactaagaagaagccaaaggtgtgttttggggaatggggtcactcttgggtcctggaactctagggaggttgggcctggtgggtcctacaggtaccttagaagggcctgaccaagcttctctcttttccttcctaaggctgaaggctatgctgagggtgacctcactctctatcaccgtacctcagtcactgacttcctccgagctgccaaccctgttgacttcctctccaaggccagcgaagtgagtctccagccttgagggacatgaggtagccccagaaacatggcctgaggatctcccctgacacctttccatcctcccaaacagatcatggtagatgatgaagagttggcacagcatccagctaccactgaggacatacgggtgtgctgtcaggacatcagagtgttggggcgcaaggagctcaggtatggagtggggtaggcacgggggccaggagccctggaggcagggaaaggccatgatgttggacctctgggaagaggatattgctgtgctaaaggtttgggatgggggcctgagccttttgatttatgtagccgaagcccgaaaggtgggtagtgagcctaaaacagaagggggcggggacaaagagggagatggcaagatcagtaatagtatctctggggcaggtcgctactaaactggagaacaaaacttcggcgatatgtggccaagaagctgaaagaacaagcaaaggcactggacatcaggtgaggagagaacgcagcgaggcaggtgtggactgggtgtccaggggaaaagtctgggaaaataacccaactcttgggactgttttgccagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggtgaaaggagctggggtagagcttggagttccccaacgcagggactgtgtgaagatgggagaagaaaatgcaaggcatggatagaaactttggagctgggccggttttactccctcaatccaccccctcaggaagaaaaagaagctgttgcgtgagcagagaaagcagcgggagcgtgtggagctgaagatggatctgcctggggtttccattgcagacgagggggagactggcatgttctccttgagcaccatccggggtcaccaggtgaggcggcattgggggtgcaggtttaggagacagaaggatctgtttgggtgtttggaggtggggggtgttgaatgtctttttaggttgccgaacgataggctgtggttgctgtcttcaccacagggtgccttggtgagtataaggccacaaagaaacataaaccaaaaaggatgagttaggtagatagatgagtgtgatagatttattttttttttttttgagacggagtcttgctctgttgcccaggctggagtgcagtggcacgatctcggcccactgcaagctccaccttccaggttcacaccattctcctgcctcagcctcccgagtagctgggacaacaggcgcctaccaccacgcctggctaattttttgtatttttagtagagacggggtttcaccgtgttagccaggatggtctcgacctcctgacctcgtgatctgcccacctcggcctcccaaagtgctgggattacaggcgtgagccaccgcgcccggctgatagattta

SEQ ID NO: 87672 - DNA, 1025 bp, Homo sapiens
gtgagtcagggcaaggctgggagaggaagacgcggtagaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgaggtaggcggcgttcccattcttttattttagtcctgggaaaatggagggttccaagggagggagggattagaacccagatcctgagcctccgaagtccaaactttttctactacgcaaagctacctggtgtcaagccttattcaaagtgccctgcaagtggctttaccccctcggatgtttaacctgtcgtttaagactcactctgtgtcttcagatggagctggaggaggggaaggcaggcagcggactccgccaatattatctgtccaagattgaagaactccaggtgaggacggactccagagggagctaggaagggtgatgatgggggatggaaacggacttccacaaatccatctaattcctttgggagtgcagtggaagaagctgctgcttctcctttcttgtttgtttcttagctagtagggtgtatgtatcagaagtaagcaatctcttgttctcctccagtcccatctctttgagggtcttagtgttcacagtttgttacacatcttcgagtcaaatcttaatagtaaaggtacctctagccaaaggtcaacccttttggaagaagcccgaatgaaaaggattcttataaaagggaaacataagctcaggagttgaaatttatcaccaagaggttgggtgagggtgaagtgagaatgtgaggaagggcatcattgagggatctggacaatgctaattccatagagactgaatgaaagaaattgggcaacccagagccctagcctaaagcgctaaaccatagaaaaaggaccgtttatg

SEQ ID NO: 87673 - DNA, 1966 bp, Homo sapiens
tagtttaccatttttgaatgctttttcatgtgtttttattcgttcaccttagtagtcttgaagcagggtagctgatgctatacccatgtgccgtttggtaacagatctagatttttaaaaatagattgtcttacctttactttgcttttgattgacagcggctgggctagaactcaggtttctcacctaacaatctttccaccaggtgttgttgccttcctgcaagaaatttggtgttacatgagccagctgtaacttttctccattagattctgttactcctggaccagtattggacaagcagccttctttgatggctgctgtaaggtccagagggactcttgaaggacagggcagggtcattaggatcatactggagaatctgaaacaacatgcaggtgccctgtgcccttccctcagctcattcagacctgtgaggtcttggccaagatcctacctcctcctgtctcctgcccttgaataatggaatttgtctcttgtctgccacagctgattgtgaatgataagagccaaaacctccggaggctgcaggcacagaggaacgaactaaatgctaaaggtgagtggagaaagatgggaagccgcatgtgggcagtttgtctgaggtctgtccttatctccctgcactgtgtcttcacagcagtgcttactgttttctccctgtcatcatctagtagtttcacatgcatctctttttcctgagccctattgtagcctccttaaatacatgaattttgacctttggccttcctttaataagagtgatgcttagctcatgcacgtagaattgggtcctggagactccaaaggagtagctaggtgaccactgtgtctgtttgccatctagttcgcctattgcgggaggagctacagctgctgcaggagcagggctcctatgtgggggaagtagtccgggccatggataagaagaaagtgttggtcaaggtaaaagcagcatgaccccagggaccagctcggtctccactgcattcccacccctttgtgtgtagcctcgggagacagggttctgtgttctgtcaaggtattgtgggattctcataggtcttcctgggtaggattagtgatttggtggctgtcaaggaaggtcatgagcccttgtttctttaggtacatcctgaaggtaaatttgttgtagacgtggacaaaaacattgacatcaatgatgtgagtgtagcaggtgaggtggtggtggtggtggggtcagctcttactgtaccacttctgaaactcgcccccttcacccaggtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaaggtgaggagcagggcttctctgagagggccaagctgtacttactcctcctgccccagccagccctactgcaggggttggggaggcaccgggataggctgcatcttgcttgggctggccctccccctgaaaagagtggctggggaagtgttcctagggcggtgaggtggtttggatagaagggaccttgatgttccttttttttttttgtatccctaacatctagcaagggacccagcactcggtaaatgttcactgaatgaaatgaggggtgtagctttctgccctgagtcctgctgttcccctgtagggagtgctgctgtatggacctccaggcactgggaagacactgttggcccgggctgtggctcatcatacggactgtacctttattcgtgtctctggctctgaactggtacagaaattcataggggaaggtaaccatggctag

SEQ ID NO: 87674 - DNA, 1047 bp, Homo sapiens
tccctaacaccagctcggcctccacacaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggtaaggtggtagcatccttgggatgggcccagggaaggcctgggtgccacgcaggctgaggaagaggtttagctgatccccacttgctttctctgctcaggttatcatggctactaataggattgatatcctggactcggcactgcttcgcccagggcgcattgacagaaaaattgaattcccaccccccaatgaggaggtttgtgatggacactgtgcaaagtggctctggctgtgggggtggggtgtggggctcaggcttttccttgccatctccaggcccggctggacattttgaagattcattctcggaagatgaacctgacccgggggatcaacctgagaaaaattgctgagctcatgccaggagcatcaggggctgaagtgaaggtaattggagtacccactgaaaacagggcagaggcaggaagctctgggctcaagggccacagatgaggggcacagcagtggggcctcaatttccttttcctgttcagggcgtgtgcacagaagctggcatgtatgccctgcgagaacggcgagtccatgtcactcaggaggactttgagatggcagtagccaaggtataggcctccatctttgtgcctttgccagtggtggctctggggcagtgggctagggcatgtgtgtgttcgtaacttaatgttcattctctctcccacccctaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgc

SEQ ID NO: 87675 - DNA, 1028 bp, Homo sapiens
agttttagcaccgacccccaggacttcatccaggaatggctccgttcccagcgccgagacctcaaggtgtagtcctctttcccgaggggactcctatgtaaagctctgggtgatttttacccacagcagttcccagggtggattagcccaggggtggggattatgctatggctttcctcctggctctttgcagatcatcactgatgtgattggaaatcctgaggaggagagacgagctgctttctaccaccagccctgggcccaggaagcagtaggcaggcacatctttgccaaggtgaggctctgccctgttttccctcctttggccgtgagtagcaaaggcctgagccacttggtttctcccttctccaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcgg

SEQ ID NO: 87676 - DNA, 1661 bp, Homo sapiens
caacatgttgaaataccatctttacaaaaacacaaaaaattagctgggcatggtggtgcgcacctgtagtcccagctacatgggagactgaggcaagagaatcgcttgaacctgggagtcagaggttgcaagtgagctgagatcgcgccactgcactccagcctgggtgacagagtgagaccatgtctaaaaaaaaaaaaggctgggactgggacttactacttctgattcccagtacctgacaaggtgcctggctggctcatggtgctcagtactgattgttgaatggttcatatgagaagatgcggtagcactgtgtcccagcatcttggtccacctccagttgtgattgcctttctctctttagcaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatgtgagttggggagggaggttctggagggaaggaggcctgtgtgggtttaagactgagaccaaggagtttgatactagcctgagcagcagagccagaccccatctctacaaaaaatttaaaaattagctgggtgcggtggcatgcacctgtagtcccagctactcataaggctgatgcaggaggatggcttgagcccaggaggtcgagcttcagtgagttatgatcacaccactgcacttcagcctgggtgacagagtgagattgtgtctcagaaaaaaaaagactgggccagacacttgggcgctcccagagaagtcctgccatagggaggggggcgctgctccaagcccgttggaggttgatttgtgtggttattacagtgttcctgcagatggcagtcgagtgtctcgaggaagtccctcgtgggctgcaagagggcaccatttccctgcctccagtctgcccagagtcctgcttccatccttcagggcccaggaatcttcagtatccggagctccagggctgaaatggggcttctctttcttgggatttagcatagcttgagatttgagagctcagcagcaccatctcacacccctttccatccccagcctagcaaacagaagaggaagttttcttcattctttaagagcctcgtcattgagctggacaaggagctgtacgggcctgacaatcacctggtggaggtgagagtgggcctggggcaaaagcaggctgatgtgcaggtttggcagggaaatggcctcagggcccttgggaggccctgtgttcacgcccacccccttggtgataagccatgcttccctccctgccagtggcaccggatgcccaccacccaggagacagatggcttccaagtaaaacggcctggagacctcaacgtcaagtgcaccctcctgctcatgctggatcatcaggtgacagagaccctggggtcatttctgggcccacagggacccctcaggaggggagctggttcctagaaacccttcctgtccctgccctattttcccactgttctactataagaacccgttctgactcccctccatccaactccagcctccccagtacaaattggacccccgattggcaaggctgctgggagtgcacacgc

SEQ ID NO: 87677 - DNA, 1030 bp, Homo sapiens
gacttcctgttaccggagcacctgcccaggagggatgggtggtgctgcaggttttgtgaacactgcagcagggagcttcctggggaccacagggccctcgctcacctctgcaggacccactgcttcagttcttccctgtctttgtctcaggcactaggaaaaactagtctgggatgtctgggcctgggcttacagctgtagccacacttagtttttttctataatctcaggccagagaaagaacaatctttaaggcagagaaagaggctgtcttttgcctttcaacagctctgattaatctcttcctgatgcagagagactttggcaggactcccaaagccccagagccccccactttgaactttttattctcccaaacacttccgtcccaccctgctcctcctctccccatcctcacgtctgtgggtcatgtttctttccatctccgcatctggtcaagaatctgaccctctgtgttgggaacatgggtttagtgcgggatgaagaggttggggaagaatctcatctccatgatgctggggtgggggagggtcctttgatttggtacaagtctccaccctgccgggcttggttggctggttgtgctcgttgcataatctgggccctggggccagccctgtgaagctgccagggacagtgtgtgcaaggcagagctgccaaacaggccttgcaggcagcagccatggggaggcgggtgggggtggaggtgactcccagatgggctccacagaaatgtcagggagcaaggcctcaggtgggaaatccttctgcaggcatctaaagaagctatttctgtctcccactttcctgctgctcagcctgggcctctatccttgcctcccaggataatcttagcccccttctccagcttgggattgccagggctacacggagccagagccagtcctggctgccaggtggtgcctggaccactggcagagtccaggtgctagctgctctctttcccacaggccacccaggagccatagcttcccttctggggtcttct

SEQ ID NO: 87678 - DNA, 1084 bp, Homo sapiens
tttcaccatgttggccaggctggtctcgaacttctgacctcaggggatccgcccgcctcagcctcccaaagcgctgggattacaggcgtgagccacagctaccgactctgagttgagtctttaacgccgaagatgcagaaaggagacttgacaaaactattttcggggagtgtggccgcggaattcggtgagggtgctataccgggagagagtagtagcaacggctcattcactgtgaagcccctaagtgaccttagacctctgaccccgcgcctcactcggcgcttccgcgcgcagcttccgctcccgcccctccgacgaaaggctgggccaaaggtgggggggtggggctctgaggtcggcagttaggggcggtgcccgctgggggcgggtctcgcgaggggcaggattcgaggaggcactcgagcattgggcaccaggtagaggcggggcctagtgctgggctgggttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccaggtgagcaaggaggacgcgagcggacgggggcgagaggcgctgcgagggcgcccgggccggcggctgaaggggcctcgagtgag

SEQ ID NO: 87679 - DNA, 1073 bp, Homo sapiens
agccacaaagaacgtgactgcagtgagcctcccactggagcagccttaaccaacactttggccaaagcccccccacctcccctgtgtactgtgtgtgtgtttggtggatacagtattccttttcagtgtccctaaagctgtgatggggagtccccacttacctagaaagcattaccagtcacctactctgcattctcagatgtaaaccttgtgtagtgttctttttgcaatgacctatttatttaacctatttatatttatttaatttttactctgaaatgtatccagttacaattgtacttgcttaaagcacatcagatttgttttggacaacacccttgaccattttaaaactggaaaagtgatactgtatccttccatgggatggatgctttacagtagtcttattattaaagggtgattaatttggtcggggtaaaatgttaatttttaggtgatttttaagaattctgtgccattatgtcttctgtgtggatggttaattgtttaattagtacgtgttaattgtgtgatacagtcttctttgtggaacccaaaatcctctttttagctttatattttataaactgccagattgtacaacttttatgtgcatttttaaagcttgaagacatgagggtcattatctaagttaaacagcctatttttgtgcctcctgtacagttttataattctgctgatggcggcatcttatgtcgagccaaccacaataaaggtagttttagattttggagtcagtctcattttcttaaagattcaaataccattctcagataggctgtgctcactgtccttctgggtggccggggctggattatgaggcctttgcagctggctcggctggtgggggatgggtgtcctcatgtccacagcagggtccggggactggaacaccctccatggtggctgtgtgtcagaaaagcttctttgaaaccttgcaggaagttcccaaaagtactgatttgggctgaattccaggaaggtggccagctgggacagtcatgccacgtggtgagaattgggcttcaaagcagagtttggggcatgtgtac

SEQ ID NO: 87680 - DNA, 1695 bp, Homo sapiens
gtcctgaggactgtgtgccgtgaccttgctgtcatgtcttttgcagtatgtggagcagaaggactttgcgcatctcggcctggagcccatcaccttgctgcagcagaccacctcgggcctggcccacctccactccctcaacatcggtgagaggctgcactttaccaggccagcggcccgggtggggagaatcagtggcccaggtggggctaaccagtagctcgggtgggccttgcttctgttcaagctcttggctatatcaccagtagcaaagatgagtggtgtaagaatttgaggaggaatccgacatagttgaaaatcagaacatttggaggtggcggcaggcatattgggagtctgacgaggacacattccccattggaggaggcctggggttgctcctggtaagcattggactaatctggagttctctgttagttcacagagacctaaagccacacaacatcctcatatccatgcccaatgcacacggcaagatcaaggccatgatctccgactttggcctctgcaagaagctggcagtgggcagacacagtttcagccgccgatctggggtgcctggcacagaaggctggatcgctccagagatgctgagcgaagactgtaaggagaaccctgtgagtaataggctatggccctttgaaaactacagaaccagcccattgtatcttcaggagtagaacctttaaattccaggtttgggggctggtgcccgtgtagctggagaatggcattcctttcaccaagagcttctgtgtgaacattctgtgtcatctcatgttcagctgattaaaggggcaaatgtgggcaattatctattttttttccctattcttccaatcacttgttttttttttttgtttggttggttggctgtttttttgttttttttgtgtgacagagtcttactgtcacccaggctggagtgtagtggcatgatctcagctcactgcaatctccacctcccaggttcaagcgattctcctgcttcagcctcctgagtagctaggattacaggtacctgccaccacacccagctaaatcaatcactttttaacccctttttaattttggtaaactgggaagtcagggcttgcttagcgtgagcaaacttcaagttttcattatttttaaaattttgtttttgttttctcaacttattttgataatttttagacatagagaaaattaaaagaaaaaaattttttagaagtgcgatctcgctattttgcccaggctggtcttgaactcctgggctcaggcttagcctcccaaagtgctgggattgcagacatgagccacagcatctggctgaaagaatgttaacatgaatacctgtgtatctccacctagattcaacatttgttaatacttttgccacatttgctttatctttacctattactgaaccatttgaatataagtagcaggcatcctggcccttcatccctgaagacctcagcacgtgtctcctaaggaatacattgtgtttccaaccacaataccattatcccacctcaacagttaatactgtttctatccatcatctcatattcaatccatattcaaatttccccaattagtccccaaatgtcttttatagagttggtattttgctacctactgggttttgatacctactgggttttatataccaggatggaatcaggtgtc

SEQ ID NO: 87681 - DNA, 1042 bp, Homo sapiens
gacactagcctcccagaaaaggacaattttgttcctaaatcttagtgtttttcagctaagagctgatttataagccttgctcaaagatgattttgaatagttatctgtatttttaaagaataaggataatagatgaagacctttcctcccttaaaaactgccattagaacttctgctggggagaagaaccaaaaaaagaaaaaagaagctgcctgtgagatcagcttgtgtgaaaaaggcagtgtggccatccctttacttcctagttggaaatgagcaagttctgtagcagaacaggccatgggtgggatgaaatatgtgaggggcatggtccttcagcaggttgctcagagcatcgagatgctgttacctgagagctcaggaagctaatgacccgcccaggaatgggaatgacagactctttatggcactccccactggcacgtctgcacctgatagtttcacttttcacctcactcagtcctatgaggtcattattattgatcccttgtccacaaaagaaggaagtagaccctgagaagctaagtaactttccccacgggtacccagctagtagacggcatttctaggactccaccccatggtggagagaagaagagacgactccctggtgggttggtggctcacagaagtcccttcagtccacctcctgcacatgggtagggatgatcacagatcgctgctacttcagataatgacagaatgaatccttcagagtatttgagaggcatgtggcctcggggaaggcagtgggatgaaaggcggaagcaggacctcagccaggctcaccatgtgtcagccccactgccacctcctggctatgtgtatgcagatgtactctgcatacctagaatactagagcttcctcacctgcccctctggattactgagtgtctgtgcgctagcctctagccaacacacagacacggtgggtggcgaacctggggcttgctctcacccaccactggctcagccatgctacctgtgcttcctgtttggtttcacctttgcaacaactctc

SEQ ID NO: 87682 - DNA, 1004 bp, Homo sapiens
attcaggcctggcagcttcagcagccctgccatggagggcccagggacagagatgcacctgggctacatgagtagggtcagaagaagaagagaatggctgactgatgccgagaccaaaagcacaacaaactcagttgagagatttagattttatccagagacaaaggaaattgtagactttcaagattccagggcacagtatctgtttaccatcatctacggaagtagccaggttggagaaatacattgattcctaaaacagcaatcttaaacagcattgtcctataatcttattaaagtcctgcatattcattattgaacacttagaaaataaacacatacagaagaaaataagacagtgcccttaatttaacacccagaggtagccacgtgtcaaatctttgtatttaaccatctggtcttggataacggtctttgaaaaagtatgttttaaaatactctcaggtgcatctgtatggtgatgagacatacagatgtccctggccacatgcccaggtgcttcctatatactctgcaggctacaaacccccaaaaatgtgggaggcactgtgggagaggcatgaataagaggggtacacctggaggggagagaagaacattctaggcagccatctggggggaggggtgaaatggcgtgagcgtgtgggaggtttagcatgtgggaaattcagcatgtgccagggaggctgtgttagttttgttgggcaaatgataacggcatacctagaatactagatatttgaaagtgagtcaatgcatttttctaaatgcctgttccgtgaagtcttagagattctgaggaactctagggaagctccatttttatctgatttaattttgggcttctaaattttctttaacaaacgcttctgatgcttcttaaaaactttgaagaaatagtggactactggaataaattataattttgggattgcactgacagtttacaggcaacacgagaaaactgctttattgctttctag

SEQ ID NO: 87683 - DNA, 1050 bp, Homo sapiens
ctgaagtgggcagaccacaagtggagaaatcctgctcccaagcaaagcatgtctcagagctccttggtacacaagagaaactagtggtggctcaaaacaaaagtaggtttcccttaaagaatgatattatgttgtagatagagaactgacctaaagatgggaactcaaagaggaattttccagatcaagaaatgtacacagcttagactagttcctgtttgttgtcatcttggcatgtatgtcatgaaatctttgataggtttaggggaacaatggaaagatcataaggtgaaagagacgtgagtcagagtgagatctgctcatagccagagaacagaaaggaaagtcagccaggctactggcagcctaatctgaaacagtgacctggctctttggggcagtatgtggactcatttttagagctgaatggattatcaagccctatcaaatcccagttccctattctagtcagctttgtatctcttacagcaatttgcacacaatagatgctcaataaatgtgtaatgaatgctcagtagccatgcgatagttgtgtagtgaacagcaaatgaacgtggagcaagctatggccccatccatctagcaggtgtgtcctactgctttctcgcaagtaatgtaccactttccccgatggaagctcacatttagataatagtaggactggaactccacctgagcaatttaaataccaagatgggaattcggcggccatagaagagtgatgttacaggaaaaagcattgaaaggagaactccttgaacttttaatgaagcctcatcatacttcacctgtggatcgggcccatgcagccccacgagccttgcgtctggtgcctcccaaatgtcctgatccctgtcatgcaaggatacttcttcactcctcagtaggagacttggaatactgtattctgccatgaagtaataagggtcctgctttgatggaattttctggtaactgccactcattttctctaactcacagtcctgctgagagtttgcattgtggacccctcagtgggtagcacctgtt

SEQ ID NO: 87684 - DNA, 1046 bp, Homo sapiens
tcccttttttcctctttctcttgtttttgctgccatcactaatggccagggattgaactagaggccctgtcccaagagagataagttgagatgacacttcttgagttggcagtgagtgtgacaaacgaaggcggaagtgagaagagctgtgttcctggcaagtgtgccaagtcattagagcaggagggagttttcttgaaccccatctgcccttcctgtgccccatccctcactgttctgccacctcccagccccagtaggggcagagcagggcaggaggtcagtcgggtgctggagcacccaggggccggtgcagtttcttctctctgttctcttcctgtcgtgcttgctggtgacaggtactaggggagaaagaggtcagggctggggctctggaaaagagatgtggggcagctgggagcatgtggggaccaggaaacagcaggatctgccaggcagtgcggtgtaggtggggatgtgtgtaaccaggtattatggggggaaaccaggtatccttgagccctgctcgcttcctttatagattgtcaaggtccatttcttttttcatcctgtttccttgtagccatttttattttatttttaccaaataacgggtaaaggagatgacaaaataataatacgtttttattaacagaagtagttggaggagcatgtatgaataggcccatggtgagaaaaaaatagctaatgagaagaggtcattgcaattacaaggctgctcagcattatgtgccagttaaggggctcacagactgcccaccagtgattaagaagtggaattaaggaaatgtgtatatatgagaatacagaaaatatgggggcagggagtcttcatggttaacttgtaaaatgagatccctttaaaatggaaaggttgtccaagtaaggaaactgcgaaaacagcaaagtataaggaatctattaagtgtaaggatcccacaattcgaaagcctcttctgaggacctccaaagctcgtcatcttaaaatatggcactgagactatggcagtgtctcctgttgacga

SEQ ID NO: 87685 - DNA, 1161 bp, Homo sapiens
ttgcttacacttctgtgagccatgagtccaagggcatagcgagggtgggtcgtctctgcttccacatgctgtcagccagtttcactcatgtgtctgggccttcagttctcctcacattgcctttctctatcgacatggatagtctggactttttggcctacagtttagggaggatttgtttgttataattagataaggaccacacctcagtaggtactatggcccctccgtggtaatgggctggctggtctgtgttctttagaatacaccatcaccatgtacgacaccaaaacccgagagctccggtggaatgccacctactttgactatgcggcctcactgcctgaggacgacgtggactacagtaagtgctctctgctggatttcacaagcttgggccagtacttttgacctatgtggaaacagtggctccagaaagtaggattttcttttaagatactctttgtcaccaggttctttctttccatggacttttcatgggcttatcataaatacttcccacagtcaatgtgcaggggccttggtgaagtctgaagggaaaccgaagtaaaatggtgacaagcttagccagagaggaaggaggacatccctcgttgagtctttctatgtcacagaaggaatttactgcaagcccatggaaagtagaagtaaaatcagcataggacattaacaaccctgtcaagaaggccactctgcaaatgtgactcatccctagttatttctgcagttaacattcacccaactcaaatgaaaactaaaaaccaatttgccaccttaacattggtatcaaagttggactctgctttttcttgtcaaggacctagaatattttcgtttttctctgaggactcctttgtgaatctgatgggacagtgtcagtggttcaggtctgactttcagggtgtttttttgttgtttttttttttgaggcaagttctccctctgttccccaggatgtgtgcaggagtgcagtcagggctcactgcagcctgaaactcctaggctcaagcgatcttcccacctcagcctactgagtagctgggaccacaggcacgtaccgccactcccccacctacctggctaatttttttttttttttttttttgtagagacgggggtctcactatgttgcccaggctg

SEQ ID NO: 87686 - DNA, 1042 bp, Homo sapiens
agttgggtggatcacgaagtcaggagatggagaccatcctgactaacacggtgaaaccctgtctctactaaaaaaaaaaaaaaaaaaaaatttgctgggtgtggtggcacgcacctgtagtcccagctactcaggaggctgaggcaggagaatcgcttgaacctgggaggtggaggttgcagtgagccgagatcactccactgcactccagcctgggcggcagagcgagactccatcccaaaaaaaataaaaaaagagccaggcatagtggcacatgcctgtagtctcaactatggggaggctgaggcaaaaggatgacttgagtccaggagtttgaggctgcagtgagccgtgaccacacctctgtactcctccttgggcgacagagcaagactctgtctcaaaaaaaaaaaaaaaaaaatttcaaaggctctgtgaccttctccagcatctcaatattcttcttctaagagtctccaaaacaggagacttttccaataagttaggaagataaaaatgaccaccagagatcatgctttacaaaatggaaatacacgcatcacagtgactgtgttgaccttcacattggaggcccttgctacagactctccattcctaggatgctgttgggtatataccattgatacatatgctttgggttttcttaatatatagtgttatttactgtgctgtctgcctgtcataatcagctgaccaagattagggggtatggcccgaggccagggaattacttactggctgggaacagaggccgagacaactttgacatccttagcatcaggttgcaaccaactccactgaccagtcccaggtactagttaattatagtcataaacagtaactgtggatccttctcacatggtggctggttattagggaggttgagaaatgtgaatgatggttattagggagatgaacccctgggcacatttctgtatttctatagatcccagtccacgggaaaaggattgcccttcacaggcaagacttttcatatttaaagccactcatcaaagcaata

SEQ ID NO: 87687 - DNA, 1248 bp, Homo sapiens
cttcaagggaagctactgacggagggaccttgatctgtccccttggcgggttctctctgatgtcaagctgttagagtctgcttttattgcctccagttaaacaaaaaatatctcttgaaaactaaaagcagatttgttctacctgtttatgtaccatgccatcctatcaaatattaatggctggagttctatatacaattgatgtagaaattgaaaagtggacttactgggtccttttcacatattttgccttcatccagagtgctttgaccaaatgataatttgtcttctatggttttgtatgatttttcctttcaggccgcttttctccactcaaggatagtgtataccaccataggggtattttatttatctgtggttgaagtgagagagagtagtgggtggaattgtcttatatactcacttatacacctacacacaaccaccctccactctctattcctccatcatgggtttgcgtggctttggtatgttgttccatgccctgggctgtaatttatctttgatatttattatttaatctctaggcctgcctttctcccagatcctaatgatggcagcctgtatacgcttggaagcaagaataatgaaggcctgacggtgagtatatttagctgctttttgtactccaggggttctagaccagcggtccttaagtgtgtctgcacagtgtcttactgtgtctcccacctggagcttttaaaaacaacccctggggattctgattcaggtggtctagagaggagcctgggcatcagtcttttcagagagcttcctaaatgagcttttaaatgtggtgccagagttcagaaacacggatgcagaccagcaggttctcatggcccagcccatacactggaggatataatgttaagaacagggtttgctctaactggtgaccctcaccttaggagggagggatatagtttgaaatgctgtctccacctgccccaccttccgatgactccttaagggagtcatgtgatattctaccctcatttccatttgagaatctaaaccagtggttttcagccttaattatacattgtaataacctggaattcgaaaaaacagcattaggacctagaacatagggcccaatcccagaaggtcccgatttaattgatctaagtcatcaggactttttaaaagctccccagataagagaatttagaaacaggcccacacatatggtcatctgatatgtgacaaaggtgacactgcagt

SEQ ID NO: 87688 - DNA, 1021 bp, Homo sapiens
gaagtaggaaagaaactgcgctagtttgaatatttgaccctccaaacctcatgttgaaatttgattcccagtgatggaggtggagcctaatgggaagtgtttgggtcttgggggtggatccctcatgaatggcttggcgctgtcctcattgtagtgagtgaatcctcaccctattaattcctgtgagagatggttcttaaaaagagcctggcaccttctcccctctcgctgcttctctcgccctgtgagctctgtacactccggttcccctttgccttctgccactagtggaagcagccagaagccctcatcagaggcaaatgctaatgccatgcttcttgtacagcctgcagaaacgtgagccaaataaacctcttttctttataaattacccagcctcaggtattcctttataggaacacaaacagactaagacaggaaatgacacttaattactccattcagcaaatacgttggttaccacctgtgtgtcaggtattgttttagatccttgggaagatgcagacaacaaaaaataaatcccaaccctccgtggccagagttgggcattaagtaagcaataaaatatacagaactacagaggtggtaagtgacatggagaaaaattaagcagggaagaagggttggaaatcctgggcagtaggaggtgatcatggaagaccgctctgaggtggcaacagttgatcaaagacctaggcagaggaacagccagtgcaaaggtcctgaggcatgggcaggcctggcagtgcttgttgaatacttggaggccggcatggctggaatggagtgtgtgggaaatagtgggagattgttaaagggtgacaggttgaaagggagggactgcttgggatttatgaaccactgtgtaaacactggccttcactgagtgagatggggaaccaccaaaggattttgagtcacagagaagcttaatctgatttatgcctttaaaaggatcactcttctcagtgtcaaggcattgacttatagtcttgacaaa

SEQ ID NO: 87689 - DNA, 1414 bp, Homo sapiens
acgaaatgcaaactgagaatgttgccatcatgttttgttttagattagcttgctttggcctgatggagttgagaggactttctttagtatttccagggctggtgtagggcttcttgagctcaccttaaaatactagttaatgctgatatttaacactcaaatccccatcaaattacaggttattctatagcaaccctgctctattcttttctgtctcctttccaataatagtaggcatgaagagctgggtcaaattagaaccattctttactaatcatgaaaatctgctaaatatgcaatatgactactctcctagccagctgggcccagactccggagatgtcccttgagtggacatttagataaatgataaagctatccagatactactccaggttctgagtatacagcaggtgaacaaaacaggacataatactggagatttcttaggagggaagagtcagaacaaagttatttgaaatttgaagacaattttattctcacgtgagtgtctctttctaaacatgtgcctcttgccacagttcctccctgtgctgacagaatcacggccaagcagtatagaaactagagaaaatagaatgatgctgtgctacttcccccttgatgcccagtggtcaccaagccctgtcatgcagactgggaaggaccctgcaaacctgactcctctctggccccattgctggtgccttagccaggctcttggcacttatttcctaggtgaatgcagcagcctcctgaccaccatccatgccccccgcaccttagccctctcgttcactcatcacactgccctcagatacacccccaaaaagaccaattggacctagctgtacccctgcctgctgaaatgctcttggtgttgtctatagtggtggcgttgtgcctgcatcagtgtgtgtggtgtgttacctgtgaatgatgaggaaaggataaatagggagcgtgagcatcatccatgatgggttggccgtttcaacaactggcccttcaccactgctagtttgagaagtgctgctccacagggtcaagtctaagctccttagtgcatgtgcaaggccattcgtggtctctcaccgccgcccccccgccccaactccctgggctccctcccctgcccagcaggtgccctacttgcagccatgtaactccttaccaggccttggagacctctggcctttgctcatgctccctctctaccagcagcctgcaatgttagacaagctcctgttcatctgtgaagaccccatttacctccctggcttctcaagcagggtgagcccattttttctctgggttctggaggtgcttttctgaaccctctgttgtggcacttctggcttgtgttgtaaatttttgttctcatttgcttcctagtggatttctacctccttac

SEQ ID NO: 87690 - DNA, 1004 bp, Homo sapiens
atacaaagattaaagatggtaatgtgcagataccctgagttttcagtttaatcttgtggttataactgaagatttcaacatttttctaaattgttaaatatagataaatgataaaggtatccagatgctactctaggtcctgaggatacagcaagtgaacaaaacaggcaaacccttttatcataaagctttcattctagtgggaaaacaggaaatcagttacttagtagtgacgagaggtttgaagaaaaaatgaagtggggacatggaatgggcagtaccaggttggggtgggagtctgcagttttaaacagggagggctccacggagaaggtgtcatttgagcaagagctcaaggaggcaagggagtcttgtagacagccggcatagcgggtcaaaggtggagtgtccttaaaaaaaaaaaaaaaaagaaaggatgggagtgtccctggcacggtagaggaggagcacagagttgatgtggcgggaggagatcagctcagagagagatgggccagtcatacagggcaggagggacccagcgcttcctttacttcacatgtactataaagttgcttactgaaacaaaatttatagtcagtaaactacgtatacacagtttcaaaaagaaataaacatattaccgaactggtaatctaaaacaaataataggaaagtatttttttaatcacatagatatagcatgtaaatgctcggacacacgctgacactccccccaggaacaaatgctgtgcctgttgatgcagatggagacaagtgcaggatagtttaccaccatagccacggcaactggatttccaggacggtgaactgttcttggtagtgtttcaaacaaaagaagtacagccttacctgccttacacagtagttacgttccaagaaaattctgtatattatgaaaaagtacatttgtgcttatgtgtaaaacaggctatagcctcggataattagtaaagggttttggcccatgagaatgtctggca

SEQ ID NO: 87691 - DNA, 1848 bp, Homo sapiens
gtgggtattggcattcttttttatcataacgtcttatgagatgcccaggttttagagaatagaataggcccaagagaaggaagtcagaaagctgagcatactttgcccctctgtttcagtggaggttgcccatggattatttcagaattcttgtccttgtaatgttaggtcatgagcctgcctgtctgcaggcaggatcactgcttagagtgaggtgacctgggttctagtcctgactgagtgggaatttaggctctccaccttccatttcttcatctgtaaaatggagggttttagtaggataaccttgggagtggggggtctgtgattgtacatgcccaaggtgaagaatcatatcaacattaagagtcttctacatctcgttgcagatttttggaagtaccagcacagtgacgcttcctgaaaccttgttgtttgtgtcaacgctggatggaagtttgcatgctgtcagcaagaggacaggctcaatcaaatggactttaaaagaaggtaatttggatttggtccttgggcgacatggacatttgcttaactggttccacagaaacatattctggagaaagagaaaacattactcattatctaataaaataaataagaaataaagaagaatgggatcaagagaggaaaaggcattctgctcaaaggacgtttatagctttgctgtggttatccactaagtgcatcagttaaagaagcacgttttatcttcttttttgcttctgtttagacttcatgttaaaatggctctaggcttttctattaatagctctagctagttggtctttatgaagacatgctgcactaaatttgttctcatgattagaatcttgtaatcataattacaagaaggtatcttctcaacacctcaaattactcatttgtttttatagaggctgaaataatagagggctgtaagatttgacattcatccaagttaaccactttattgggttgttatggtgaggggaataaagactgagcttctttcttacttaacataccatgcgtccatgttatgatctgatcttcctggtggtaactagcagagtcaagccctacagctgggaaattgtatttgatttccaaagtaatctttccagataaagccatgcaaatcccaggatttgggactttcagagtcatctatattatttaatctgtctagtaataaatctcatttggcccgaggttcgggtctgaacagcatcgttctctttcgtcactactctgtgactcattactttcacgagcacagccaatgtttttccttccttaataaagtgttccaaaacagtatgctagatggaaaaatattggcatatgtcagaaggtcacacattgtcttgtgaattcagcagcaaacctcgttaccatccatagatgatggcagctgggttaccacaagccatcctgccccacctgcatgggccctgcttggatcagcaggaactttaagcagcccaaagaccagctctctcaggagtgtgtggccacaggaagactgtagagtgttttattacaggttccaagaacatcatctgtactgtatctccatcacatttaagccttttaatgtttttaaaatgaaacagagtccttcaaacttcaggatttcctattttgtccagagatgaaaatcaacaaatcacacaagaattgagagaaacactttggctgtggaatgttagggcatgtctttcagtttcattgttcccaggcagggcatcttcaccctgagccacttcattctgctttgcttttccctgcacataatgctttaagttggttttttccaagtcttcatttctgcaagtaatgtcatct

SEQ ID NO: 87692 - DNA, 1371 bp, Homo sapiens
gagcccaagggcaagaacttagctgggcctgaggagctgtggaagccagggtgggctctcccagtcctttcagtcatgtttcttctcaggctgctttctgtttctgtgtctttctcattcagctttttccatgtggcagaaaacacattcacagagctctctgaagttttatttccattttatttatttatttatttatttattgagacagagtctcactctgtcacccaggctagagtgcagtggtgtgaccttggctcagtgtaacctccctgcaaactctacctcccaggttcaagcaattctcctgcctcagccttctgaatagctgggaatacaggcacatgccaccatgcctggctaatttttgtgtgtttagtagagatgggttttcaccatgttggccaggctggtctcgaactcctgacctcaagtgatccgcctgccttggcctcccaaaatgttgggattacaggtgtgagccaccacgcctggccttatttccactttagccacccagagtttaactcactttcttgtgtggcctcccaagacctgttgtacagagtggttattcctgtggtaactttggggggtggaggagggctcagcagggatttccacttcttggccccaggtatgcataatttgccctttcatttattcatcctccaaactgtcacacctaacataatccagccatcccacaccaagctgcacacccattccccctcctcagtggcagacagccccaattcacttagcccctgtttactcatgaactcccagtggccttgtcatagggccacagttctccaggcccaggtacctgtggttcaggtggcttgtcaccatctggaccctctgggctgaaataattctaaccactcccaaacagtgacctttgcatccccggctagggcagataccacccttgaggcttatgttttcctggccgatttatactctgatattaatttcctagttccagaggtagaattaaaagcactcttcttcctcagacttcaggctttgcacagagtagactcggtaggtggcaacacagcttactgtcctttctcccattccagggagtgggcccaggccctggccctgggcaaagcgaagaggtgggatgtgcaaagttctagcagctgtttcactccctccgttggtgggtctccaccacagaaaaggaatacgggaccccagagtatttgtcctgccacctcaggctgccccagagagagcctgtggggccttccctttgaaggattaactaggcatcctggctcttaccgagagtagccgggccttctgggatcaggctcccatgcacaaataaccccaatccttttacatttaatgctc

SEQ ID NO: 87693 - DNA, 2027 bp, Homo sapiens
taatagtaggtttaactgcatatgagtagacatactcaaatggataaaatttgactttttgtaaggccaatggtgcacatacaaatttatagtctgtcaggcctgtattagtttagtttgtttaggatgtttctccattaaagtaaattagcctgatacgtttcttggttgttactagatatcagttgatgctgtttccctttagcaaagacaacaaaatagagtagtgacacctgcattctaaagctcagccactaaatgagcatgtaaccttgggtttcagttttcctaaagtgtgggatttggcttagctccccaggtatcctgagggaccttagggatttgataccaccctaagaaaaagggcttgttttcctaaccacgtcagggaaaacgatttcatgtagcaccattcatgtccagatatgtttcttcttccaatgatggcaatgtaagttgatggcagagcaaccatgaacataaacagaactgcaaatggttgaactcagacactcagcccaggccccaaaaccagtttggggggaactgtattcacctattatgaaattagcatacctttgcattcaggaatacagtggatttatgaggtacttttttttttttttaatcagatctattaaaggaggacagtagcctaaactgaagaagagtcctaactgtcttgggtggtggttaattacaccatacggcagacttgccacaaacactgaaagtttaactctctcagctgcttagtttggaaaccacacagtgctgttcagttaggccttggccttttctgcatcccagctagacacttgactcccatccaaagcaaatgtcatggttgcctttattgacttaatatcaggaaacataacagccgatagactggttagaaggaactgtatggttgatggattattgctgacctacacacaggtaaacgaagtataacagaatttggaatgatttactggtggactgaaatctttaaaacagtaagacttttgtttgtgtctatggctgatgttttaattcagttctgaatgttcttccacagacaggagactaaaagtagtgaaatatttgttactcactgttcaggtggctgtatagaaatctccatatttgggtataagtactttgctgcagtatgtgtaaatgagatgagggtcagggaacagggtttgatttgaataaaaatctgttttgtaggccagccgctcaagcctgtaatcccagcactttgagaggtgaggcgggaagattgcttgagcccaggagttcaacaccagcctgggcaacatagtaggaccccatctctacaaaaaatgaaataaaaagccaggcatagtggtgcatgcttgtagtcgcagctactcgggaggctgaggtgggagaatcgcttgagcccaggaggtcgaggctgcagtgagccatgatttgtgctgctgtactccagcctgggtgacagagcaagaccctgtctcaaagaaacaaaacaaaacaaattttttttgtatctgtcttaattaagtctttacttaacataacttcaaagatagtcctttgtgagcggagagttgagcccctcctgatcattgtgaggcttttactctgagggcttgctttaatcattgagagagttttatgtcatggacctttgcacttactgggcactgatttcagtgttctactgctttggtgaatttttgatgtctttttggccatgatcggacagtctcctactatgtgatgaaatggtattagaaagcggtactctgctggctgcctttataaagcagagaatcacaaatgcccaggctttgagtttatagtctgagacagataatattgctgcaagtagaagaattgtagacacagatgtccttgttttgaatatcctttagtgcctttcaagggtctgtgttatagaataccattttgaggtacttcttcctgttgttttgatgttactgcacaggttgagtgagagagagcttgtgtgtgtgtataagaaaccc

SEQ ID NO: 87694 - DNA, 1055 bp, Homo sapiens
gaaccttaaagtgagtcagattattactaatttctaatgttgcaatattttgagataagcggagacacttagatgttgcaagaccaggattggaaatgactatgttcaaaggcattaggacttctaaactctgtcaaattgttatgcggattttgggcatgttttgattggttggggctagaagaagctgcagcaaagcctgaggagagatgagggtctggtaagtcatggatcatcatgcttcagagctgcagccaccatccacctcaggcttcttactttcttggaaacccatgcctggaaaaatctaatgacttgcccagagctcaaaccagaccatgcatctgtgtgcccacctcatcttctgtcagcttcattcaccccaaaagcatctatatgttccagactcatgaggatacctgaggaactttggttttgtttttaaaccaaagagttttgagaggataaaataacaggttttgaagctatatggacacaggctagggcaaggagtgagaagacagctgagcagggtagggtgggaccagactcttggaactgctctgggcaggacctggatatgctgccaagtcagctttcgggaagttcggccatggaacttgccgtctttttttctgcattacacgactctcctgctagacggcaaaccccttgaagccaggagttttacaggccttggggcggcattgccttgtgtgtaacaggacccttctttctgcatatatgtaggataagagtccagcttaggggcagggttggagtaagtgaactagcacacaggagttgaaatagaagagtcagccaacaggaagaagtatgaggcagggagtgcctggaagagattggcaaatcctgaagtccttgccagcctacttgagtaatgtgagaccatgagccaatgacttaccttgtcctgtaagtttagtatccccaagatttctgcctcttgtaatgaaaatagtcctggcactgactgcaggtactgtggagatggggcgcctggaagattaaaaagacgggaaggtgcaggttta

SEQ ID NO: 87695 - DNA, 1081 bp, Homo sapiens
tgtctcaaaaagaaaaacaaaaaacaaaaaacattgagcttctgtgcccagccgtgggttggggactggggttataactgatcagggttgatgtggtaataagccgagctttgcctgccagtcatcttgctgtggccatagggatcataaagaaaggggtattttcattttttcaattattttatgtttggtgctttctgtatgataacaggggaagatatttttttttgaggcattatctcaaagtaatcatattcattgtagaaaagttagaaaggatagataagcctaaattaaaaaataaaaaacaagccttctattatcttattttccaaacattacctctatgaagattttaaacaattttattgagatataattcacctatcatcacaattcacccatttaaagtgtacaattcggtgggttttagtatattgacagaattctgcagtcatcaccacagtccattttagaacattttcatcatcccagaaataaacttcatacctattagctgttacacaccgtttccccccaaacctcctagtccttggcaaccacaaatctactttctgtctataaatttgcctattctggacctcttatataaatggaatcatacattatgtggtcttttgtaactggcctctttaacttagcatcatgttctcaaggttcatccatgttgtataataacatgtgtcagtactttgttcctttttattgctgaataatattccattatatgaatataccacattttatttatccattgtattagtccattttcatgctgctgataaagacatacccgagactgggcaatttacaaaagaagtaggtttaatggacttacagttccacgtggctggggaggcctcacaatcatgaaaaaaggtaaggaggagcaagtcacatcttacgttgatggcagcagggaaagagagagcttgtgcagggagcttcccatttttaataccatcaaatctcgtgagacttattcactatcacaagaacagcacgggaaagacccatccccatgattcagttgtctcccacggggtccctccaacagcac

SEQ ID NO: 87696 - DNA, 1048 bp, Homo sapiens
taataaatgtaaattctctttatgctccaaagatgctttttactctaagccatcattttttgaatgttatactatgcctctgcaagaaatagtttttgatatttctttttgattgatgtagtaactattgcattggaggcaatactgtgattttctttcagtgtgtgtcttattgagccagacattgactcattatgagttgagactttaggctaccagatccaaaacgcaataacattggtattattaagcacttgaggctgtcttttgttaatccagaatgtgcttatttagtcagtgagtttttcctttcttcctagacctatatcttgctcctagagttggttagggttacatcatcactgtcagcagtcctcattttatggttatttaggtgccacatctctcaattaccaaagagatcagtacaatgtgaggcaaagtacctttttttttaaaagctataagatatcagatttctttcatttagccaatattttggttttagagggaggtttttaaaaagtcaccgagaactgaggatcatgtgtgtatagaaacactgtaatctgatagatgagtcttaactagcaatgtctttgcttatcatttattctgacagtgatcacctgcattaattatcctaataggcgatatcaagtgtttatactgaggccataagtagaatgttcattgagtttgttatcagggctgctgatcatgaaattaaactgtagttgtgcacatgtgtattgtttcattaacttgcctgcctattcagccttctgcagtaatgtagcttctcagagcacaggagaaaaatgtatctgagagttattcgagagagagttcaacaatagcccatatttccgaacataaatctagtgagccgcattaaagtttcttcatgtctggatggaatagtgtcacttgcataggtctgagggtttcattatttgcctgccccagatttggactccgtttttcaggtgaaagaatccttggataactgtttcattttcataggaaacctctttggtttcgggat

SEQ ID NO: 87697 - DNA, 1474 bp, Homo sapiens
ctgaatctcagaaaggttaactgagcaaggtcacagagcgaacgcatcacaaagtcaggatgtggtgcagatcggtccattttcaatacaagctctttctaccacgacaggttattttgcacttggggacagtttttaactttccattctcaactcctatcctagctcctggcacagaacatgtcatccaagttaggcatcatcgtcgcctgctcttggtgaagttttcttttgcgtactgcggagagatgcgctcattaccagctggcggtggagtcgctgaaacgcaaatggatttgagactgagcgactcccatctctatggttggtatgtgacccatctatcctctggaggactcagcaaggactaccagtcaccagacaactttacgcgcacgtggtcgcaaggtgaacttgctattggttaatggcagtaaagcccgcccatcagcgctggtctgctcctttaaaagaacgccatcgacgctcccctgtctttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggagctgggagggggctggcgggcgggcgcgcgcacacccgctgatctatcactctcgttcttgtagctcccagccgaggacgtcggatgtcatcgtccttgctgctttgccaccccattcccgtcaataaagtggtttgaacccaaccctggtgtcggtgtgtgtcgttggcgacgcgctgtctttgagcccccgccgagcttcctcgtggcgccgggggtcaatctgcagcgctagagcatgtgcttgcgcataactggggccgcctggcctcccgcgggcggcctttttaaccgcgagcgacaagaagtaacctgactgtccggctgctaggctgggcaattttccagctgttttgccacgacaggcctcaatccgtaataccaaggctggaatggcgtgttaggggggcggtggctgacggggatacgcggactcttgatgcgtaaggagtgcccctctgctcccatacgttccccagcccagccttccctgagtgtatcgcgcgcgctgtgccttcgccgtgagttcgacataagtcccaggctgtcgcgtctgccatcagacgcgcagatttagttgaaggcagcgtggaatggcgtctgcagggctgttgtgtacttgacataaacagattcggtgtggaactgcattgagttaactcctgactaaagggtaatcgacctgtttacaaataaccatgcaggagtactgacaagcatgggactaaagctttgggcaggttaatctgtcactcctaaacagttcaaaattatagggcggtt

SEQ ID NO: 87698 - DNA, 1070 bp, Homo sapiens
tgcacgtatgcgttcactacatggacattcgatgaatgaaggtgtcccgaattaacattatactagacaatgaagggtgtaaactgcagcccaggagcaccactgccctaccccctcagttacgaactttcactggattctttaaatgtgggctgaagataatggcacatagtttgaaggatgtagtgaggatggctttgtagccttaggactgggcagtgatcaacgcagtaaatgaaagctgcgattgccaggtgagggccccggtgctctgtactcattttattgtgcccctatctgaacaggattccgtagaaatgacttagatgcttatctagtatttgacattgagatatttattttgtgaaacaatgcaagcgattttaaatccccacatactatttgattaagtgcaacatggtacagtcatgtgtaatctctttacacgatagtgcatctagtccttagcctttagttattgcacaacaattataaagaccagtgaccaggacacgtggactctgacaggcagatcggcctacacaacgaaaaatcagaacagtacaccaactggaatggtcaaacaatttaagtcaaatgttttaatggtgcaattaaaataagggttcaaacatgttttcaatatattaatttctttaaagtcatgttcaggcaaggtgctgtttaaaaaaccactattagctttgtccacacatgtaagttatcaaaagttacccaaggtaattttgacgttgaatgcagctttaaacaataaaaaaatggtattaggtttacttctcgaagcaaagagagcccccaaccttgtaaactaaacattctgacacaaatgcacaaaattaagttggcaacattaattttgagatgtagtgtgatgctgagcaaacttttggtcttgactcttgaaataattaaagagagcagttctccgttttggccttcaggaagggaaatctgcccatggaactctcccaatcagattaacaaactgtttcgattcccatataaacctggaggacacaggaaacgccagatggaaaaactggctctgg

SEQ ID NO: 87699 - DNA, 2255 bp, Homo sapiens
gggattacaggcgtgaaccatcgcacctggccattagcttacattttatcgctaggatttattaataaaaggataattcacatggaatatgtgttctagacatagtaactgggaactactgtgaacagcttaagccaattctcttaaattgttggatatatatcagtgcatatgggcaaccttattatatgtatacaaaatcaaaggccacttctgcctccgagctgatatattagaggattctcgtatccatgcgctggtatgattcctcaactctttctaaagtatgtatggtgggagaattagtttggaatgcatagcaagtttttatatgtacttttaaaaatcagtctaagccctaaaattatcagaacaaaggagggtgacagcctggcaaggcattcttccacatagctgttctttaatatcttcctacagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttc

SEQ ID NO: 87700 - DNA, 1037 bp, Homo sapiens
cagggatgctgctgaacaccctgcaatgcacaggatgccccccgccccaacacagaatcaccacatccaaaacatcgagtggtgctctaaagtaaggggaacgaagagccacaggtttttgtctgtgaaaagagcaaagtttgtgctaaccgccctttgtgttccacatttgaaggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtgcgtagagggccctcagggacaataagtgattcctcctattgcatggccacagaaatcccagcctgcttaaccttgaggttatggaaagtaccttctcccgggcagaagcacttccaaacaattttcatgggaccttaatattagttgcaaatctgatggtactttcttctgtgagtggtgaattcacattcaagaattcatgttcacatggtaggaaaagttaaagtcaatacatgaagtttatgagataagctgtttctattattggtcttcctcctctgtaaagccaactgttctgccagtaataacagctgtcatttgtagatagcgcctttattctctgcctggccctggttgtaattgcattacctgattagtcctcatagcatcctgttgaggtagatgccattgttatccctactttaaagatggggatcacacatccaacagagtctgggaagttagggagacttccctgagttaggcctcaatgctgaggagtcaggagcatgtgcatttggtgtctgaggactggattctcagccccagctgcatgttaaaatcacctggggacttgctaaaaatatagctatgcctggcccatccccccggatttcaggggtcgggggtgatgaagccagggttgaga

SEQ ID NO: 87701 - DNA, 1044 bp, Homo sapiens
tggaactgagtatctgccctggagagctgagtgagggacactgctgtcccatgaggctttcccttacttcagtcaaaggaatggtctttagacatgtatttttccggaaaatttcctgggttctcatgtcagttgcttcctagagtctcctgagactttttgtgtgtgtgtgtgtatgtggttgttggctttttctgtgaccctcaggagatagggcaggtgtggagtgaaatacgtaatttcactggaaaggagtcatgagtcaaaactcacttggagggttactaagccagaaagcatcagagttgctgaattaagccagagccaagggacttgcctcaacatcccatcatcagtgagaagtggccatgtcaccagtataagctgtcacctcactcttgcaaccatccgctctttctgttcatcctcccgtgtggctccgctgcactgctggttgaaatcactgcattttatgtgcgcatcacactcccacctcctgtccttctgacgcatgctcaaaagcaacctcttctgggtccaaggcctctgtggtcctgtcagaggccttggtgctgaagagtgtcctgagcatctgcgctgatccaaggattcttggattgggcctcttctggtttgggtgggttggagagaatgacgagatgtagttaacagttacatcccgaccctgttgtggttgagtgtgtgtgcatgggtgtgtgtgttctctttctaagcagagcttgggtgagggcaggcagtggtggtgactctctctctgtccagttgcaggccccgggcattctgtctggcggacagcgatgaggaatcctccagcgctggctcctccgaggaagacgatgccccagagcccagcgggggagacaaacagctcctcccaggggctgaagggtgagtggatcagtgcttctgtgcctctgagtctccagggatcaggacagcaagttgggagtgaaccttgtttcccttccttcctctgtgatcttccttcctctttaatgttgagtagatggtttttttattaat

SEQ ID NO: 87702 - DNA, 1080 bp, Homo sapiens
gagaaaaaggcccagaaaaatggacccttaccccttttttcagaaaggaccctttcgggaacctgagagcactgggtccttctttctgcaaatgcttccacatgcaccatttggctcacagtttctaggagcattgtgaatctctgaaagcccatccgtggttaagaacctaatcccagaagtgattccagaatccacttcacttcctcagtcatgaggtttacggaatcaccacgcggcttagtagcagaggagggacaggggtcagcatacttattagctgtttgaagcgtgtgacctttggaactgacatcttccttaatattaaacctccaaagcacggaacatctgaagaattggccagcagcagccctttcctgcaggctctccctgcagcccatggccacctgtccagggcttcactccacatcagggtctgctccctggtgtcctgcctggcagggcctcggcttcatctcactgcttttctcagtccctgttcaagtgtgcaaatgattgtgcttttgcggagtctctgaggagatgctgcttaacctgtgagatgtcctccttactggtaggaagtttgttcacctttagttagcaccctgagggttagactgagattttaacctgtgtagctttgccctagcaaagtctcttccctttgaaatatgtgtctgctgtattttcatgggcatttttcctttagtcttttcccaaatagtccttttgtcgcacactgcaggtaacataacatacaacattcagatgggattgagatagtaacctgagcagcctctgctttaggaactgccctgcagagggccagaatgagttagttaaagggagcgctctgccttttgggtggcctttaaatggaaagtggcatggaagtgaagtgtttcctataaggcacttggcctcttcctgctccaccactgcagtctgggccctttgtacaagtccccaagtcagaaggtggccccatctgacctcttttgggttactagttcacatctaccccaaactacccatctgcccccaggcccctggtgttctgggcactgagtgcctgca

SEQ ID NO: 87703 - DNA, 1023 bp, Homo sapiens
tcaaatgccactcctcagggaagccatccctgacctcctcagccaaaacagccacccccgtgttccctctgcccattacctgcttgatgttctttgcagcactaatcactctctggaagtatattgtctatgtatttacctgtttctgcctttctattataaaccccgtgagagccaggccctggcctgacctcttcatggctctgtctggagtacgaagcctagtacatgatgtgtgcacattacgttttcgttacataaatgatatgtccccaaaaccttggccaccatcctctccggaagcatgttgacttgcaacagcatgttttgtaggttgctcatgggtctcactcattgtttgcttgtttcctctagctcccctactttatgaatgagctcactctgacggaacttgacatgggcgtggctgtgccaaaaatcctccaggccttcaagccttacgttgatcaccaaggtaactcctaactgaccattctatgagtgttaaaatatatcctttgctgcagattcagtaccatgatggctttgtgtttggagggtgttgaggactttttaaatcatctgtttcatgttgagtgtctttctgttcttaccagtcatggccttaaaactgatttggggccgggcatggtggcttacgcctgtaatcccagcattttgggaggccaaggcaggcggatcacctgaggtcaggaattcgaggccagcctggccaacatggcaaaacaccgtctctactaaaaaagtacaaaaattagtcgggcgtggtggcgggtgcctgtaatcccagctactcaggaggctgaggcaggagaatcgcttgaacccaggagacggaggttgcagtgagccaagatcgtgccactggactccagcctggatgacaagagcgagactctgtctcacaaaaaaaaaaaaaaaaaaaaaaaaagatttggaatagatccaagctcccatcctaagtcttttagtctcttggttattatagggcctcctccagcc

SEQ ID NO: 87704 - DNA, 1896 bp, Homo sapiens
gtgctgggattacaggcgtgagccactgtgcccgacctctttttacatttttaaatgtgactactagaaaatttaaaattgtttatgtggctcagattgtattcctactggaaatataaaggtctactggtctaggcactgaagctcagaatcaggtaacccacgggggtatatggggccaccaggaaacaccaccttaggtacttaggggccccccagagcaccttcaaaagaggcatgttattcatggacttaaataaagcatttgattatttttaacgagttcaatttttggaaatcctgccaaaagttccactcagcacacaacaaacataatggtaagagtcagagatgtgggaaaaccttcagtgcactcactggtactaaagcaaggctcacacaccactaatgtcttcgtacatctgtaagtctgggttgcctttgaaagctatgaattgagatatttatggtaagtttaagccaccaaaagtgtgattaaactagtagcaaggtaaattggtgagcactgtgctgttcttcaaaaccatctctgaatcagtgactacataggtggtcagccgtgaaggtaggactggtctgattctctgaggccaggtacatctatcagtaccaagaagttagaagtcttcctgctcgacgacctgccctgtcctctccctcagggatgctgtcaccaaaatcatagatttctctagcaacacggattgtgcttctcagacttgaatgtttgacgggatcttaagatgcaggttctgactcgaggtcatgggtggggctgagattctgcatttccagccagcagtgcccaggctgcaggtcaggaaaggcctcccggaggaataagaatctggagacagcaggaaagccacatggtcatttggcagaattccagtatggtctctgcacaggaaggtccttgactttatcaggggctattgtccatgagacccacagtgcagtgacgactcctgtgctttgtcccactcaggggaagggtgaggtgatgtgaagaggctgttctgtgggcaatgagcaccagccaggcctcgtagggggttcctttcctcctctacatggagtgtggctcagtcacaatgggatcagtttggtttgaagtgttggtatcatgctgccctgtttatttcatctttttttctcttttttactattaactaaactgtaatctttatttggatttcactggtttttctactaatgtcctttttctcttccaggatccaatccaggatattaaatgtaatattagtttacatctattttttaatgtttttgatgtagcttttatcctagcaattaaaaaaatgctaaacatgaaaacggtataaggataataaaagttacaaaaatgtatttttatagttatgcagtgtaaaatattaaagtgctggaaattatctggctaaaatttaaattaagaaatggcttgcgtgaccctttgtgaggctctggggaattatggttctgatggttggagcctcttaagaagaaaatggtttgatttgattttttgatttctttctttctttctttcttttttttttttttgagacagagtcttgctctgttgcccaagctggagtgcagtggtatgatcttggctcactgcaacctccgcctcccaggttgaagcgattatcctgccttcagcctcccccagtagctaggactacaggtacaggccaccatgccaggctaatgttttgtatttttagtagagatggggtttcatcatgtcggccaggctggtctcgaactcctgacctgaagtgattcatctgtctcggcctcccaaagtgccgagattataggcgtgagccaccgcgcccagcctggtttgattttaaccactttacg

SEQ ID NO: 87705 - DNA, 1048 bp, Homo sapiens
atgtattccacaaagctattgtttctctgttcttacagttcatctgaatgatctttagatttctccaatgtgagagaagtacttaaaatagtttttatataagtttattcttaacttgagtttgatactcaaggttgactttagcttcccatctagattttagctatctttttttttcttccaacttaagtttggtccaaggtcattaaattcagttgatagccaaacatagttgatgataagcagctaaacattattattgtgctactgccacctgaaaattacggatatttataactctcgcaaaattattaaatgcctactttgtggaatgattttgaagaataacaagacacttctgaaaattccagtttctgtagtcatgttatgaacaagtgttgaaagttatttcatattcatcattttagtcaaaaagtctataaggtttgcactttgtgctatgcataatattaatgcatagtgtagccaatctttaatatataaatcatcatttttctttctctgtagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccaggtaatgatgtttgtgctaaatgcttatgcatttttaaagggccactagggagaatagagaaagaatgccaggtaggaaggaaggaaggaaggaagcccaccctgaactgatggttgtctgccacctaatgtgcattctcatgactcatttaccatctaggctgatcactgcagccgtctgtcccaaatc

SEQ ID NO: 87706 - DNA, 1678 bp, Homo sapiens
cacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaaggtaagcctctccccgggagctggctagtacacacacttctcacatacagccgtattttagatctgacttgttttttggttagctgttaaagatttttgcacaggccgtgttttttaagagcttggggccacttcattctccaggcacccagtcaactcatctggtaaacctcattctaacccaagctttgcagattcacaaagtagtttctgaaagatctctgtgactctagagaatagtgtttacatcagttcctgttctggtctgtctctaaacttacttggaatgtgctacttgctgagcatttttaatggctgagtctgttagggttcactattcttgagaccttgaagaagggttaaatactcccggaattgcaagaggagggaaggaagaagagaagg

SEQ ID NO: 87707 - DNA, 1048 bp, Homo sapiens
aggaggaggtcagggatctggctcttaaagggtgttggagaaaggtctcctttccatattgcttctgaggacttcttagaccattggcagcacacgtcctcacatgaaggtgggcgtatgatctgggagactctgcttaagaaaccggatctctttattgatagagccatctcatgagcaagtaatgcaagctgttggtaattacagaaaacctactgtggaatttcatctaaaattaatgaagagtcagcactgtggattttaaatacagaggcagtaatggctttagctctcagctgtctgcgggctttcctttgctctctgttgtgctgggggctcccttccgtcttgtccagttggttcgtatccctatgacacagacccattttaatggaacaccaccaaaatatgcagtatattccaaagtcaaaggtttaggatcagaaaagtgaaaaaggttcatcgtattaaaaagaaaacaaacgtggagaataaaaactgggcagtgaaatctagctagatgaccataatatgtctgcttttcttgactttattattattactttttaagggcattgttcaatcctcgattttgtatctatggcagcaggtgaaggtctctagatgagcgttcacatacacgatgacaaatggttaaggaattttgaggctaaaatctttactgcttagatgtcatgtactttataggcatagcatttctagatttaataggaaggatctctgctctgtatgtgcttttatgtgacttgcaaaggaactattccatttaaatagatttcaattaggataatgggtttgagacatttcacaatggtatattttctagactcttaagatagaattgtcaaattatagcaaatagagttagaaattattttgcaattttctcagcagattgtaatttctcctgccatacatgtagtcattgtaaaaataatagtgtaagggtaccttttataaaactgattattttccaaatagactggtaccttttggtttagaaaaaaaatgatggaagaagattgta

SEQ ID NO: 87708 - DNA, 1013 bp, Homo sapiens
caagtagctggcacctgccaccacgcccagctaatttttgtaattttagtagagatggggtttcaccatgttggtcaggctggtcacgaactcctgacctcaggtgatctgcccacctcagcctcccaaagtgctgggattacagaattacaggcatgagccaccacgcccagctgccgccttctttatttttctgtatcctgaataatctgttccccgtcattggcttttctgttaggtctggtgattcttatctgcagcaagaaaagggggtccctcacgtagacacagcaccaggaggctggtcctcccagctctgtgactctggaaggtggatcctgcccttccttggaaggccttagggcctcagcttaccccttttagcccagaagtccagccttctcctcgtgcagcctccagctgttctagaacacacatctgctgttgcctgttactgactccttcctttcctcatgaacatcatgtgtgtcctgtgatggtgggctctgctcatgaaagtatgattgttttatatacctttttttaaagacagaagttgctgctttcagaaagaccattcttctagggggcagcccaatatttaagacaatgctggtaggctggacgtggtgggtcacgcctgtaatcccagcactttgggaggccaaggtgggcagatcacgaggtcatgagtttgataccagactggccaatatggtgaaaccccgtctctactaaaaaatgcaaaaattagccagctgtggtggcgcacacctgtaataacagctactcaggaggctgaggcaggagaattgctggaacctgggaggcagaggttgcagtgagctgagatcatgccactgcactccagcctgggcaacagagcgagactctgtcaaaaaaaggacaacactggtgacaaatatgcatgattgcagcagatccctgttagcagaaatttagagtcaagaatggtcatcttctgcctttggccatttaagcttcttcctttc

SEQ ID NO: 87709 - DNA, 1082 bp, Homo sapiens
aacatagggagacctccccatctttaaattctttacaaaaaatttaaaaattaggcatggtggtgtgcacctgtagtcctactcagggtgctgaggtgggaggattgcttgagcctgggaggtccaggctgcagtgagccatcattgtgccactgcactccagcctgggtgacacctcaaaaacagacaaaaacaacttggatttattggagaggttaagtagtttttagagaataacccaggaagggaaatggggggaaagagttcacagggatctatcatgaaaactgtacagagggtttggagcatcctacaaaaacatgttctgagaaaccatgttccatgcccttgtcccagacttgaaaggcatttgcccatcatgttggaaggatgggatttgaggctgatcctcttgtctggatgggttttctgcacccagcctcaggagacactgacatgaggctccattttgagaccttaaggttggagtattccatatacagcccacagccaggggtgcagtagtcttcctctcttcctagagggtagggattctgccctgctcatatttgcacctttctcctccctctgacctccctcactgccatcagcaaactagagtactttgcctgtcgggggtgtttgccaagtgtttctgagtagaccctggtactacctggtggacactaaagagggctctaggcagtaataagagggaattctggttgtaccttgtgcaggggaggcttcctgctgttgctggattccctgttggaaagaagctgggcagttgtgtttagaactgaccctgcagatggggaggcttcccccttctctctcttcctgagggctacttccagatgagtgggggagcctgccagtgctcatcaggtccacctgacatgtcaaaaggaaaaaggagaaacctgggtcttccccgggaactttgaagttacgaataggaaatcgaaggacttgatgccgagataatgttcttttggaaggaagggactggttccccagaccagcacctctggtaaccagagagaagatgttttgtgaagactagagtgatgcgtttt

SEQ ID NO: 87710 - DNA, 1081 bp, Homo sapiens
ttaagttcaatttatagtattcacttgtagcatgaaacaggacacaagttaatatgtcgaaagtttctatatgttgaatttcatttttattttttaaaggggaaattcacatcaaacatgcaaacaaccctgtagcagtgcctctgtgcatcatggtacaacagaccattaaacatttgaaaggtggttagtgcaactgagaattggaagctttaattttaattaagctgaaaccgaagctttaattttaatttaaatagttccatgtgcccatattggacagtatagctccagggtttattaaaccaccattcctggtgataggatagagcccagcacaaactaatctgggcaacaaatcaaagggcacaagtcgcatgtaggttccaaactcagtacattttagagaaaaggagtttgattatgtagtagaaggaagaactgcctggtgggactcatgatcttcctttaagagcaaggctcaaagacctggggagttttgatttgatgctatgatgtctcctggggctcagaatattatgaaatgaggagtgaatctctgagtgaaaagaactcaagctgcttgttgcattgcggaatgtctctaagaggtagagaggcgtctgttaagtggcttgtatgaaggtttcagaaggtaagatgagccccagctttgggagttgtgtttgctgccaggagggtttagaggctgcctctaggcaacacccaggggctcaaagaagacagacgcagagagcatgagctgctggtcacctctctatccccagagcatcgtagatgcttgataaatgtgttaaaaatggatgacagtttcaggaatagatttaggagtaaataagagatgggcttgaaatttttctagaaattctgaaaaataggtgccgagggaagtgcagtgccagtgagctgcagagtttgttcagcctgtgctttctgccagaggtaattgacatttctcctcactacgaatgcaagctcgacctccctcctttcgcccttatctagtcctgcaccaaatactgctgatttttatcttataaacgactcttggatggttctt

SEQ ID NO: 87711 - DNA, 1066 bp, Homo sapiens
cttttttggcacataaaataacagtgtgtcttatagtcaatggtcttagatgaactagggtagtatattatttataggtagttgtaagaattaaatgagatcacttatgtccctggttctagtgagcacccaataacaggtcatgctgtccactgacaggatgaatggttaactgggaaaagctgggaagcatctcgtaagatttgccactcaacgcctaggcaataatccatggtttgtggctggaggaacattttccaatttgcctagagcactatcctttggctgactcttgtccctgtgagaaacattaacttcaggagctaacgagccatggacagacagctccctttgtcttcctattcattaaggtctttgtcaactttaaatcccaagtttaaagtaaatattgtaataagaagactggaagcccatgctgttgtgaatattcttacatgtgagttttaaagcaactcataggttatacaagattttgtgttgctcctttccaaactctttataatgcgtaattacactgcgtgaaatgtccatgaagcaccattaatgagagggatgctaggaggtcatgaaagttcagaagcccttgactggcattggtggggtggagagaacactagacttggagtcagaaggctacagtcctgacagtttcacctgtcatccctgcttcaccattagaaacatatttcccaatggctgcgtggatcacccaaaattgcactgggcagcaaggcaggataccagctgcgcgtcacttcactaatttggacttttaaaagtctctcttccaggacagggcgcggtggctcatgcctgtaatcccagcactttgggaggcggatcacctgaggtcaggagttcaagaccagcctgaccaacatggtgaaaacctggctctattaaaaatacaaaaattagccaggcgtggtggcacatgcctgtagtcccagctacttgggactgaatcaggagaatcgcttgaacctgggaggtagaggttgcagtgagccgagatcgcaccactgcactccagcctgggtgacag

SEQ ID NO: 87712 - DNA, 1026 bp, Homo sapiens
cccagggggatacccctggttctccgcgcctcagtcaccccacctcaacccccagccctcgtctcaagggcacttgttgctgctagactgcaggaagaggaaattaagaagtgcaaagagctggggacagtgtgcagccccgttgggagagtgaagcttttgtccccctcacctggggctcttccaggtaaccctccccaccactcctctccctagctccaagggcggtggcccctttaacagacctgacaaatcgctcccccatttccgcggcctcacctcggcgcgcggtagaactggattggttgggcctggcgtgccgtttgctccgcccccgcgccctctggttggcggcggcggccgcgggcgcggggcgggtccgccggcggggcggggcggcgtgtgcccgggggcgggcgggcggcagggcagcaggaccgcggccggtgccccagccgaagccggagtcgcgcggccgggagcacgggcgccggcatagtacaatgaggcagccagcggatcttgggtgagcagtctcagggccaggcgggggcggtggagggagcgccccgcggataaggcccgggctgggcgcggatcgaccccgcgggcttcaaagtaccggtcgggtccggcggcccttggcgtggcggggctcggccccccaccccgctgtcatggttcaggtattgaaggggacgcccacccgcgacacccccgggcaatcccttccttcggggccccgccggatggctcgggctcgactccggcgggaggagctgccggccccgtcccctcagcctgcggtccccggccccgggcagggaggcaccgtcacgcgcaaactagaggaaaacggcttgcaattttatgaatggggccccgggttcctgccgcccccctcaccggcgacgcgaaatgcttgaaagtcgagaaccgcagttacttttactcgaatctgtcagaggttgtatgcgccccggtggtttttctccaactcctggagaacgcgggtggcggtggggt

SEQ ID NO: 87713 - DNA, 1054 bp, Homo sapiens
aactaaagtttataaacttctcttttaaaatttagttgtatttattttagagacgaagtcttactttgttgcccaggctggagtgcagtagctgttcatatgtgtgatcatagcacactacagcctcaaactcctgggctcaaacaatcgtcttgagtagctgggactacaagcgcatgtcaaagcacctggcctgaagtttatatgtttcttgcatatcttgaagaattttatattcccagggttgttcttggttttgtttgttttttggtttttttgttttgttttgttctttgtttgtttgtttgtttttgaaagccaatgcctggaatattttttacttttctctctttttagggaaaaaagcctccaaaagccttcaaagttgttttctatgtatatttgaccctcggtggattatttttccaaggatttattggactcattaggaaaaagtccccagttgctgccttacttcctcccaatcctaggatatgctcattttcctggaacctcttggcacaggagggtctggcatggtgccgggtgctgttccatcagtttctggtacaccaacacaccctcctcagggactggattgtttgggccagaatttgcagcatgaggaaatctcccagtctcctcccaagacttctacagagtctgggactggattctaggaaaggaaaaagagtggatttcagtgcctttcaacgacagaccctaaagcggaacctaacaccgtctctagaagcccatcacaccgccagccgttgattaaaagtgtgtatccctgggccaagacgagctcagtttgcagatggtgtctctggcagggttagtttaagatgaaaaagatagcaaattttaaaagttcttttcggctgggcacggcgcctcacgcctataatccagcactttgggaggctaaggcgggcagatcatttgaagtcaggagttcgagaccagcctgaccaacatagtgaaaccctgtctttactaaaaataaaaaataaaataaataaaaaaaattagctggggtgtggttgcgcac

SEQ ID NO: 87714 - DNA, 2205 bp, Homo sapiens
agacgttcctgacaatgtcttgagtgggtgggagagaggctgcagtcattgtgctgtggaatttcagaggtgagaaccacacctaaccaaaattactttccctgtttgcctcagtgacacagctgcaggaaccctggtgggtgttgtattaagtaaatttgacctttattctttgcagatctgtgaaatgttgtcttctgaggggccacgtgtatctgtagtgctgaggactccttgggcctctgaagtcacagagagaaccctgcagggtgggggaccagtgtgtgacagccctgctttgcattttctttgagaagtgctgtcattttgcatttctctccaccagggcaatcttcaatcttgagaggtgtgatcataacttgccttgtttcttgtcgctacagagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgcagatctgtgaaatgttgtcttctgaggggccacatgcatctatagtgctgaggactccttgggcctctgaagtcacagagagaaccgagcaggtctatgtttttgttttgttgttttgagacggagattcgctcttgttgcccgggctggactgcagcggcgcaacctctgctcactgcaacctccgcctcctgggttcaagcagttctcctgtctcagcctcccgagtagctgggattacaggcacatgtcaccacgcctggctaatttttgtatttttagtagagatggggtttcaccacgttggccaggctgatctcgaatgcctgacctttggtgatctgcccgccttgtcctcatgtgtgctccacaggcctttgggttgggattgcaggcgtgagccaccatgcccagcctagactcttttgacaatatgatgaaagctgttggttcctttcc

SEQ ID NO: 87715 - DNA, 1035 bp, Homo sapiens
tttctagttggggcacctcggccctgcatcctgttccccaagggtccttggacccagcagggctgaaacaaaatggagacactatcccagctcaccctcaggaagccagccaggctggctgtggaggtcccaagaccctgggtcatcctccatctccagcttctgccttgctgagttccacctgcagcagagtgtcctgtgcacatggagggtccagaatagtggacttaggtgctgcctgctcttcagggcccactgttgcccagggcccccctctactctggtatctcccagcaggccctgctctttttccctccaagggctccttccatttgtcaaaatccaatctttaggctgactccagagttgcttctgtgaatcccccactgcccagcccagagccctctcagtgcctctgaaccccttctgcagtttgttgagacctcttataccttctacttcatagtggtgttgtttatcaataattgatacaatataaaattcttggggacagcttcttgcatccccagcatagagaacagtgtgggtcagataagggtccaggcactgataggtggataggtgacacaaataccatttgaagctgttaaagagcactacaggatggcagaaggaatccaggaatccttttgtgggtgtttttttgctttttttgtttgtttgtgtgttttttgagatgaagtctcactctatcacccaggctggagtgcaggggtgctatttcagctcactgcaacctccatctcccagactcaagtgatcctcccacctcagcctcctgagtagctgggactacaggtgcacaccaccatgtatgcctaattctttgcatttttgatagagatggggcttcgccatgttgcccaggctgttctggaactcctaaactcaggggatccacccaccttggcctcccaaagtgctgggattacagggatgagctaccatgcccagccaggaatccttttttttaattgtcataaaatatacataatattaaatttaccattttct

SEQ ID NO: 87716 - DNA, 1034 bp, Homo sapiens
tatccccatgaaaaaatggatgctacctccaattcaactttggtgatgattgctctgttaccaaaaaaacaagaactgcaagtgtgcatggagtaagtgttccatccgtatttgagtttttcacattttgtcttcagattgctttagaaaatgcctacttgaggttctttcgctgttgggaaagaggttccagagcccttaggggactaggagggtccaggaatcacggggtcctttgggtccttgcaggtcagatttgcattgggggtgctgtcctcaacctcactcaatgcatggaagttgacacaatggctcaacattagcgttgggctgattcatcatttggctgttgacaccagcctctggcccagccaggacagaaaaagggcccctgaggaacttctggctctgttccctctatgggggaggggcagtggacttgtgataagacagggtgttagggtgaggtggacttggggaaacaggatatttctaaattagagaaacagaaggattgtgacccccgctgtgacagacaggccctgagcctgcccgaggtccaggaggaactgtatgtgagcttggggctgggtctatactgaggccccttggcgtacttttctcgataagactgaggacttatggccctcccaccattccctccaccaccttcgagaacagcaaccatccccaatgcccacatctcctcttggggtctcccccaggcagcaggtgaggtccccatgacttctctgtcttcaagtcagggtccacagtcagctgtttggggatctgccccagcatgtgggccactgaccattgggtggggtcctggtcctttccagaagggcaagccatacccgtcacttgcctctcataggaaacaccatctctaatgaatgcaggcagggatcacccaccacctatgcagagcttcctgctctcattggcttttctcagcctcactgtcctcttgctgacatccggttgggaccatttgcgcaactgcagactggcagggccaggcaaacaca

SEQ ID NO: 87717 - DNA, 1055 bp, Homo sapiens
ccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatgtatgttttacctggagctcctatgtattttttacccagattctctataatcatttccgaaccatttgagaataaggtgcaaacgtggtgtcttaacacttcattgtgtatttttcagatgcagagacactcacctacataactacaatccagtcatcaaaatcaggaaattaacagtaatccactattgccacagagccctacaaattgaactgattatctcaataatggcatttataggtccaagatcttgtctttcatgtagttgtcatatgcctttacactccttcaaatgaacaattcctcttgtcttgcgtgaccttgacatttttgaagagtacagtctagttaatctgtagaatatgccttggctgggatctgtctgctgtttccacgtgatttatgtatttttgtcgggagtactacagaagtggtagtactgagaagctctcttctcagtgtgtcatatgaggagtgttactggtgatgttaacttttatcatttagttaagatggtttctactagatttctccagtgtaaagctaataaatagtttgtatttattaattaacggccaggcgcagtggctcacgcctgtaatcccagcactttgtgaggccgaagtgggaggatcatgaggtcaagagattgagaccatcctggccaatgtggtgaaaccccatctctactaaaaatacaaaaattagctggatgtggtggcttgcccttatagtctcagctacttgggaggctgaggcaggagaatcgcttgaacccgggaggtggaggttgcgatgagccaagatcgtgccactgcactgcagcctggcgacagaacgagactctgtctcaaaaaaaaaaaacaaaaaaattaactagtaatt

SEQ ID NO: 87718 - DNA, 8422 bp, Homo sapiens
tctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtgagtttgggagccgagctgtcaggcctggcgggtggggggatgggagggcgggtcagggtggcggccggcgggggctttgcggcttggacttggcctttccgggctatcttgggacttcctttcccgaaggcttgcgccattttgatattcacgtcacagtgattggaagagatttgacggtgtagtgtcttcaagcttgctttttgtgtggggattggggagctgtcggggcggctgccatttggtagctgttgagggagttgagagggagcgtattgtgcggatgaaagcgggacgcttcgaggcagacgaaggaacatctgttaggtgcggcgtttcgggaggtgtttttggggtggccgggcattctgtgggagcgaggggaccacttccaaagccctggtgctgttggggtaggagggcggccggcatcagccatgtggctgagtcgcgagtacaaaatgccggcctcggacatggcggcggcgcctttgttaccccgcccggcggaggagctcaaaatggcagcgtcgagaaaatgtggcgcagagagaaatgcgagacaaagggggaagcgccgccccagcgggaacgccgcccggccgactccgcccgggccgggactcctcccccggtagtcgccggctcctccttttcttttttcctgcgttatataattttgattcgttgatccggagctctaccgcggcgttcccccagctgggtttgctagcagaagtgtttctgagaaaacccttgttctgttatcgctgactgtactgtttaggttcttaccactaaagctgtttggttccaaaacggccatatgagtaacatcgtcgtgatgctcttcggttcatgtagccttgttattgctgatagtgaattgctaggctggtggggaagattacagtaaccacaagaagtggtgtgtgccagaatcccaaattctggcatgtgggtgacaagtttccgacatgataaatccccggcttccgacatgataaatcccaggctgtttacatgacctaagtaatgtgtacttgggactacgggaaatgttaactgtggctgttgagagagagagagattttcacgaaggacagtgctaggtttacctctcgaagtctgttttcagtggtttttagcttgtgccaatggatgacaaatctatacagaaacctgggtatagccatttgaaaatgtgaataacgttttttttcattccaggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcagtgagtaaattcatgtggcttcatcaggctgtaactcgatcgtggattctagtaaatgaaattctgacaggtgttttgcaaataactcaattttggtagagttacatgttctgacttcataattgggaaaggtgtgactcacttttggatataggtggctttgggatttttacttaaattaggttgagtataacaataaattttttttttcataatagggtgttcataggtgggtccagattaaaatgaaggctactttaaactagttactaaattatgaagttaggggcttatcaattacgtatttagctaggggtggttgtcatgaattttaagactgttataatttgttttgcagcaagaggtggaaacatacagaagaagcaaggaaattacagttagaggtcacaactgcccgaagccagttctaaatttttatgaagccaatttccctggtaagtgctacttttcagttctacctacccgtgtttttgtttccacctaccccctctttttcttggcatcactaatttttactaaatatctgttactaattatagcaaatgtcatggatgttattgcaagacagaatttcactgaacccactgctattcaagctcagggatggccagttgctctaagtggattggatatggttggagtggcacagactggatctgggaaaacattgtctgtaagtttgggagaactcttgagttgatctgatatatgcaagaaaatgtaatggtaatttaaaaacgagtattttaatgtgatttctgtttgtccccactttcaccctaaatagtatttgcttcctgccattgtccacatcaatcatcagccattcctagagagaggcgatgggcctattgtaagtatatatttttaactttttattagaagcataatgtgtagattttagactacatagctaaagatgtaatcatttgtggtggttttatatagaggttagctcaccctattcagctggagctgttttgggtattggacaacacatgaagaaaggatctgctagtataataagttagcagtttaaaactagtatccaggtttgtgctgaaagctgtttctctttccttagtgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtatgtaatgaaaagggttttatttgtcattggtgctaaatatcctaggtattgtagttacacttacgtatttaattaaaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagagtaagtgtcctttgaaatatgtgatcaaactgaattgtgttttcactcttaagagtctgatactaatttttccccccaaaatccattagcctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaagtaagttttattaactctgttatatttgcttcctaacaactttgctgtaaaattgagggatcattgtttggtgagttgttttaggttatttcagttggtgtgatttcatttagttagcctactaatcctgaaaatttcttgaatccttcaaataatggctgtcaccatttatagctttcctatagaaggaattcatgtgtcccctggttgacttaaggaccaagggtcgaactgctcgataagtggattagcaggcgtttcctctttgacttccagccatgtaaattgaacttaatgttttgctgaccataaatgtgtggccctagcaatggtcttttaaaactcaggatttttcctttctctctcctattattagacttattcgtctaatggaagagatcatgagtgagaaggagaataaaaccattgtttttgtggaaaccaaaagaagatgtgatgagcttaccagaaaaatgaggagagatgggtatgtgtgagctcctccattgaagcagattgattaaaacagcttaggaaagggcaaacttggatcacgagcagtggatttttttcatatctgatagtgaatttaactttttcatttctggcgaaattaaagagatctgtgaccaaaagtggtcaagcactggagtctgaggttttcaatgtgagtttaataacacaacttgtcttttaacttaggtggcctgccatgggtatccatggtgacaagagtcaacaagagcgtgactgggttctaaatggtaaatatttcaaatgaagtatttttcccccttacttaacctagctagaattctgctcagataattgatcatgtatatgccttcctttgtagaattcaaacatggaaaagctcctattctgattgctacagatgtggcctccagagggctaggttagtacaaactcgcattcatggcttggtttcccagaagatctccatttaacttttttaaagaaagtttattgctttctttaacctgcattttttctaagttttttttcacataaaggtgctgtctttgtggcaaggcctaggcatgacaatcggaggactcgagggggatggaggactagtgatcggctggctgcttccagtcgattagagaggtgaaaaagctgaacgtgtgccagtaatcttcaaaaggcagaacatatcacctctgccccgtaaactgttctctccgagggaaaaaatggaagttatcctcacagttcactgccgtggtatttcttctgtcccatgctttgcatgactgccatggtacagccttgtttcaaactgttcactgtgatctgtgggtctttgagtttcagtgagtttgctgaaatgtcgaagaagtagttccaaacttcaatgttcaatgaaatttttgttcaagtttgaaatggagagagcagctttaaaaggtactaagccttttacaaattggtgagtactggcacatgagatctagagcaggagcaacttctcacacatagtaagtgggaaaagaaagtgctttgaaagttcctccctcacctacacagtagtcgtcatgtcgagacctgccagagagagacacattctcaagtgaatcctggcttcttggaagcgcttgcctagacgagacacagtgcataaaaacaacttttgggggacaggtatgttttcttgcagctgcggttgtaaggtcttggcaagacaagcagtgtggccagaattttgaacttctgatgaatgtgtaatgcaaaggaccttgtacatttttttgtttcaaggtcctcaaaatgagcacatgaagaggttgctgtgaaactttaagtggccctactgcgcagaagcattcagatgtcacttgatgatctgtaagggaacttgctgatttgggaatgtgcttagggaacacacattccttttgacagggtctgtcactgggtgggtgatgaattatacagatgacatgtgcttttttttcttttttcaacctcaatggtattcctacaggaaatggataaccattttaactgtattttttgcagcccgtaccttcttgggaatacaattgtctaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtaaggatgactgataggaaatgttggtagttacgagtcacatcgttgtctacaaatccatttaaatggtattggagggtgagtaaaaccttgaatgtgaaaacttaagctgaaaaattgtaaaaacatttcacgcctaccatgaatagatctgtttctttctgtccacaatgatttgtgtcatagacataattgatcaatttgcaattgttttcttgacaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaagtggaaattgtactttattttatataatgtcatgtaaaactttgcttaagatggtctggttttttttttgtttttgtttggttttttttttccatgaaaacaaatgactgttcctttttatttaatttgggaggcagggggaatcagaaggcccttctttataatgagctattcatattgcaggagtcagaatgaattgatacaggtgaatttttagttacaggctaaattgcataaaagctttgtcagcttccagcatcaggggagtcatttaatagcctttttccttatttgctagtatggttaaatgagaaaatagtaaaatagatacaaagtcatctatatagtgtgagaacgtgggtgactttttcaaagtttataatttaaaaagctccaaataactggctttttcaagagacttatactcatgctcttggctatactgtgaattactgaaatgttgaacaaacctgtgaaagacatacattagccctttaagatggccaggagctaagcttgagtctcctttactgaatttcgttcttagtgcaggttacttgtagattctagtcttcacaggctccctggggctcttaactagtcacactgggagtcatgaatgtctttccaataattcagggaattctagagatcctcaaactgtaaggtctattcatactcaacacaaggaaaaaacctcattaaaattaatgactaatcaggaggcaacgtaaccaaaagcacagtgaatgaaagttttcatggtaggttcaacatgggtttattgctagaaagatccaggggatagctttaggtttaacttcggctcaccaacgtaactttctaatcatttatttcagtaatagctagaagtgggtctgaatgttttcccagagtctgatacgtgtttttttttgccagaagagaggtcttcaggagacttcatttaaattctgattattaaactgaggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgtgtccagcctgtggtcgtcttaactaataaatgtgatttttctccccattctctctttttatttatttgcgtataggccttttacctggtgtgagttcctgaatgtggaaaacacctggcagtagtacccagctttgcagttaattactatctagctggcctttttttaaacccttgtatacacttgtaaagaagaactatttcctgaacctggtacagcactttactaatgataaaactttactcctgaattacattaactcaattgctaagctgttacccctcttaatcaggtagtagtttggtagtctcacagtgaaatgtagattgttcctttttccctgaacctctttaaaggttttcgtaactgaggctggtataagaaatcatggactttggaatcaaacttcctcagtctgggtataccacttttccactttctgggtaggtctta

SEQ ID NO: 87719 - DNA, 1008 bp, Homo sapiens
ctaagtttcaataaactttagaaaaagtcacgtagggatttaaaacattcattcaatgataccttaaaactgtaatattgtattttgtgagaatcagtgatccatccaattttataccagatctgtctttagcggcaaaggggaactataaagacatatctaaagaaaaatggcttaacataatcgtttatgttaaatgatttagttttcatcagaattcaataaaatttggataaatctgcaccaaatttagttagatcatgaaacgctgagagatcacttcctgttctacctgcttgacttacggaacattttcacagtaactattaataagacacaactaattttctaatacctcactttcaattgagagattacttaaatgctcacttaacccatgggaatctcaatatagatgaaaaaacaagacttgcccaatctagttcagaaagccgctgagagagtttttctgatacatcatgtaattcttgttctgttaatctctttcttggcctctgggggaaaggtgaattgcaggatgaggctgtagctctgttttcatttctgtaataaaagtgaccatttgacagtaaaatagctaggtgtctattatttagtttaaaataactgtaatacgtactttaacaaatacttcattctggtcttcacagctaaatttggagatcatgcccctgcattttcaaattcctttgtaaacagactgtaaacactgaagtctgcagtaatgttacctttttcctttgggaggcttccttgtcctaggcccttggacctgagctggatatacttcccatttgctgcctttaggcaacttggaaattaagaaaagtccatcatctagatcctattaaaaacagaaaaaaagttgatttgaaaaagctacaaataagaaacatgaactttctgggagtgaggaagggaggaactgtggcacaaagctacgtgccttcaatctccgtgttttgaagtgcatttgtcaaaagaccc

SEQ ID NO: 87720 - DNA, 1033 bp, Homo sapiens
tactgtctaatttccttagtttttgcctaaatgctcctggcagctcaggctctgcttgaaagtctgggtgtgccattttcctactccttgtgaggtggcatctgggccagccttgttagcagcttcctggtggcatggggagtgagccctcagttccacaggagtgcccaggatcactgctgccctctgctgcagtggggtgttattggagctgctcttcagattgaggtgataaagctgccaaaggctgaagggcttctggggccactggccccccacacgtgacatactgcctgaagacatcgtgatggggagtgaggcagatgagaacgctggaatctgcattcctcttgtccttacccttctcttccctcccctttccctttcttagcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatggtaagtctgacttttctgtccagccctgttaagaaggtgaactttgttatctttcaggaccaccttctttgttcgtgactcttgtccaaatttgaatccaaaatctaaactgaagtcctatagtgctggccctgagttctgcttggccacacttcattttcttactccattgtgcattcccgtccattctcagtctccgtgtccctcatcttaatgtgaagtcttacttcctccctgcctcctacacataacaggtacttctccagtaaaactactttagaggtttgggaacatgtgagagacaaatttagtgtgataacatgaccttgcattccacataaaatcaggactagtgtccagctgtgctgtgaggggttttccacaaggatgacatttgctatgtcatcctaatcaggctgtgaaatgattaaccttttgagatcccaagctagcaataaatttcatctgtaaaatattttagtaattata

SEQ ID NO: 87721 - DNA, 1088 bp, Homo sapiens
ataattcagtatgttttattatactcagttgtgcaaccatcaccactacagaacatttttaccaccccaaaaagaaaccgtatactgactagtgctcattccccctgtcccatccttagcagtcaccagtctgtactttctgtctccatggatttgcatattctggacacttcctaaaaatggaatcatgtaattcgtggcctttcgtatttggtttctttcactccgcatgttttcaaggttcatctatactgcagtatgtatgaatacttcattcctttttattgccaagtaacatcctactgtatgaatgaatgcacactctttatccattcattaactgatggacactttgggttgtttccccttttaggctattataagtaatgctatgaacatttgtgttttttgtgtgattatatagctaggagtgaaattgctgggtcatagggtaactctatatgaccttttggtaaccttctgaggaactgctagattgttttccaaagcagctgcaccattttacagccccaagttctccacatccttgccaacactcgtcctctaactgtggttctgagtcgtatttccctaatgacgaaggtgttcattatcttttcatgtatcacagaggttctttacaaccttcagaaaagcagtgtcaagcagccatgtacatagggtaagaacgccaagagcagaaacatgccacacctacacatgtacatcactgaggagggggagtgatcatttggggaggccaccggaaaacacactgctcaaagggcttggatatgcgcacttgtcctcccttcatcagtgtaaattctggatagaaaaactggttctgacggcgacgcattcatgagctacagacaagttacttacgctctcctcaaagccttcctctagaaatatgtccaagtctttagtaaactataattactaaaatattttacagatgaaatttattgctagcttgggatctcaaaaggttaatcatttcacagcctgattaggatgacatagcaaatgtcatccttgtggaaaacccctcacagcacagctggacactagtcctgatttta

SEQ ID NO: 87722 - DNA, 1188 bp, Homo sapiens
acgcacctgcagtgatttcatccacatttccttcatttgcaggtgctgcaggcccgagactctttaccatacaccagattgatgcctgcactaacaacctgccgaaagcccacacttggtaaggtatttttgtagctgtattccccattccatgtacataagtgttagttccaaacagatttgactttttatttattgtacttactagtgttaaatgggcctttaaagggaatgataagcaacttaagtgatttaaaagttaagattattcggaaattggtaggaaaacccaaaagtggtcatctctgttttagagaaataccttttagttttctgtgtgacacagagtgatgtggctatactggtatacacttgctaggccagtttacttattttgaatgaactgtataaaatttgatttgcttattcacagcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactccccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattctacctttgtaaacaattggctaaaagaatcatctttaagaaattaagccatttacatgtttgtgtttttctatagcagagcattatattttgcattatatgtttcaacctagtctaagtgggtcttttttacatttttcaagaacggatttcctggaatacag

SEQ ID NO: 87723 - DNA, 2889 bp, Homo sapiens
gtctccccagtaactggtactacaggtgtgcaccaccacgcctggctaacattattttggctttttttttttttttttttttttttggagacacagtctcacttgtcccccaggctgatgggatctcagctccctacaacctctacttcctgggttcaagcgattctcatgccttacctgggattacaggtgcccgccaccacgcccggctacctttttgtatttttagtagatacagggtttcgccatgttggccaggctggtcttgaactcctgacctcaagtgatctgcatgcctcgtcctcccaaagtgctaggattacaggcgtgagctaccacaccctaccaatttttaaagacaatatgtataacatttattttagcattgtatatattaatcctgggtgtaattctataaaatacaggatttgcaagttatgttttatagtatacatggaattcactgctataaacaaacatgttagattagtatggtgagttagtcttgaaccctagggagacatattaatgatagtataaaatgatttggatatagttcatctgtgtgaccctccatcaggatgtgtttagcagaggtctgtatcaatgtgctcatgtattttgtgctttaatatcaatttaatattattaagcaaatgtaggccaggtgtagtggctcacacctataatcctagcactttgggaggctgaggcaggcggatcacttgaggccaggagttggagaccagcctggccaacatggcggaatctcatctctactaaaaatacaaaaattagctgggcattgtggtgcatgcctgtaatcccagctacttgggaggctaaggcaggagaatcacttgaacccgggaggcagaggttgcagtgagcctagatcatgccactgcactccagcctaggagacagagcaaaattctgtcttaaaaaaaaaaaattattaagcaaattgtatgactcacttattcaacacccatttctgaagtttctgtgcattatcggttgcttccccaggatgtagtgaaatggatgttactaccatattacagcagaggaattgattgaattgccctcaatcaacaaagctaataggtattgaaactagtagatgatgcaggtccaaagaaggcacatatctgtatttactctttgggtctcaatttctgtccattttttttaaagctttataattttattatgaacttatgaaacattctcaattgtttacctggtcaagtctatcacagctgtggttctcagaccctggagagggagtttgcagtgagtagatatctctggagctttttaaaatatagatcccaactgtcaccccaggtgcacagaattaacatctctgagcctaggacctggaatgtcaatttgaaaagcttttcagatgattctgatgtgcatctttaattaggaaccaccaaatgacagccagcagtacaaacctaaagttctcttttgaggaatttttggtctggctgtggtttccacaggttcattactgtgtactattttcacagctcattatttgtggacttggaaagatagatgttaatgactggaaggtaaacacccggttaaaacactgtacaccagacagcaacattgtcaaatggttctggaaagctgtggagttttttgatgaagagcgacgagcaagattgcttcagtttgtgacaggatcctctcgagtgcctctgcagggcttcaaagcattgcaaggtaacagcctgaggtgcaggcaagctgggcagcgggtgggggcggggctgtcagcgtggggtctgtggagatattttgtaaaccatgtgcttagagattctctttttcacttcttatctgtgactctcacattgtgataccttcttctccctcctttcttttgttcccttcccaagagccttttctgcgggcttctctgattgtagtgagtgccgcatgctagagaccgtacgtggtgatgctctgcctttgttttctggtcaccttacttttaattctgttgcacattcctgtagggaagtcgttcacttccatgttcacatcttgacctggtgaaacgtttacctgcctgggatgcctctcccctctacttttcgttctttctcttattagacagaagcagcatgggtcatggaaaccatctgttcggtcagagcattttaattactgcatggcatcagaccatttgtttacaaccatattccttttttaagaatggttttctgtggaataagctggttaattttgggaggagctggtaatattgctaatgattgtggtgcttcactgggtggcagttgcttcctttacctcttaagcacttcattttcaaagctgctggtgatgaataaggacacacaaagcgacactggtacataattcgacagtgctgcccacagcgcatgcgctgaaatccctggggggagagcgtgctttcagctgtgctgcccttctctgtaaggagagctcctcatcctcacacttcccagatgcataaagtgaagttgtatttctgctacatgtatttatatggggtgcctgtgcgaactgaaatggattctatagacggctcttttgctgtcagcccagtttgagtcatgaaatctaaatttgcatcaggtcgtcatctttttgaatgtgtgcctatgtattttaccttggatttgcctgattacttttcttctcatgcttttgggatattgactttctataaaagatagaaattgagaaagggatttcaatcttgagttttttctcaaatggaaatgtgaacctattacggaatctaagccttatccaaggttaattctggctcttaaaacccagatgcttttcctgctgccctttggtagtatgtgt

SEQ ID NO: 87724 - DNA, 1008 bp, Homo sapiens
tgtcctactcagtccctggatcccactcttcagggttcagtcgtgtttacagcacgtaataatcccttgccaactacagttattagattaaaaattcaaagaaaaacttttacagttacacagttttgctgtccccttaacccaacaaacaaaaatacggtcctccaaaggatataatgttaagtaacttatttcttaaagtagagaaccatttctccaaatttggaaatgttaacaaatttgacagatgagtaagttctgtgatgcatgagatggagaagttttcttgggtagataaataaaaacaattcacttataaatcgtacattcacacaatagatgtagtttagtgcatttttttattggtaaaattacatcttccagaatttttatatcctctagagaacaatgattatttaatcaaaaagtgcttgctattggcttttactatttattcttctcatttttggtatgaggattctctacctcctcttctcccgtaggcctccctcaaatagaaacaaaacacccaacacattcaaattacatttgcaagtaaaatcagaaaaataagtcatttttgagtgaaagagctctttattctagttattggcatgtatgctgtaagtttagaaagaaatttcatcaagactcagctctagtagacgtcctgtttcctgggagcttctctgatttgaagggttgctctgctgatgctgcttttgttagtagtttaccacttttcatcaacattgaactgtgtcacacctcagggttcatttatccccattagtctgagatttattgttagacttgaggctaaaccgttaatgttagatgcttgtaagatgcggtgttgctaaagtagagatttataataataattaccagatctgaaaatacatgtgattatacgaaatcctgccgaatgtttacaggctctatgtgaactggagatttttacgaggcattgaggctcaattcttggctctgcagaaaggatttaat

SEQ ID NO: 87725 - DNA, 1109 bp, Homo sapiens
caaactcctgagcacaagcgaaccacctgtcttggccccccaaagtgctgggattacaggtgtgagccaccgtccccagcctcacatggacattttgaaataaaaccatattcttccttttgttttatgtttattatggattacaaatttatttggcaattaaaagtaacagaccactggaccgtatcatctcgtgagtagctgaactgttggataatacttttatactctttgatgctaaaatataataaaattgcctaaattttgcgtgagatgttacttcaatataatagagtttttatatgctatttgggtacggtagatttttccaatgtgatcttatataactgtagttagtgcttttttgccttttattaatttaaataattatttgctaaaatgattagttaatgacatatcttaataaaaatgtatacattaacaaaaaaattccttggtcatatcttgttttctagggaatggttgtatctcttgtcacatgaaatgttgaatccatactatggcctcttccagtattcaagagatgatatttatacattgcagatcaatcctgattctgcagttaatccggtatgatttgaagttatgatgtgaattgtgaccaataatgcttttcatgtttacatgttaatgtagtttattatatagaaattatttgtccttgtcttagttgtgccctttgactcagcaattccccttctataaaattttcccaagcagatgattatggatatatgcaccaatttggaaacagggatgtttattgtttatagtagcactcaactgaaaacaacatagttgtcttcaggagcggggactgattaaattatgacatgaagcagaataatgcaaatgattaaaggcataggttctggaattagaaagacgtgtcgtggtctcatcacttactagctttgtgacctttcagggcaagttcatggacttaagcttcagttttgtcattgctaataaatacatttgtacctcaaagaggggttatgagaatgaaatgggaccctgcacattaagcacttagcacagtgctgtatgttattcactctacaactctatcaactacattactaagc

SEQ ID NO: 87726 - DNA, 1050 bp, Homo sapiens
taatattgacttggcattttaaacaaaggtgtattttctttgtatggtcatatgttttaggtataatatttggcctggtgtataaaaagaagggatccctgccaagctgcctttcagactcctgtttggctcttccagaaagaaagagtctagataacaagcagtgtttggcacatgcctgaattttaaagtgggtgatggtaaactctgtaggggaaaatggaagctatattggaaaaatttgtcctcagaagctgtataaagctttatggataaaattccattatccaattctgtcagtttatgtggactatgagaaataaactttgtagctggtttattgctgccaaaaaatgtcaagccaagtatatgttctactaaggcttggaaaatgatagagctagacttgctttataatatgatgctattttaaatctataattgcaatttttaaaatttgatatactttaataataacatctatgtttacttctagtcggcagaaccaattgaaagaccaacagcaacagcaagtggtatcgttatgtcctgatgacacagaatgcctgacagtcccaaggtacaagcgagacctggttcagaaactaaaaattttgcggcaagaactttcccaacaacagcctcaggcaggtcattgccgcattgaggtttccagggaagagatttttgaggtaaatttacgagccttattttgttttactatttttttttccagaaacccattgcttgctaatacaaaccttattttaaattagagagaaattggccgggtgcggtggctcacgcctgtaatcccagcactttgggaggctgaggtgggcggatcacctgaggtcgcagctcgaggccaggctgactaacatggagaaaccccatctctactaaaaatacaaaattagctgggcatggtggcacatgcctgtaatcccagctactcgggaggctgaggcaggagaatcacttgaacccaggaggcggaggttgcggtgagccgagattgtaccattgtactccagcctgggcaataag

SEQ ID NO: 87727 - DNA, 1053 bp, Homo sapiens
ttttttggcaaaaatgtcattagaatataaattatattgcaaaacattgccattggggtttaataaataactttgccaaggaagcatattcttctaagaaagcattttagtcagtttttttttttatttcctttgcttgaaaagcatgtttttgtaactcagtaactatcttaatagtagctatagtaactgatatttattttgcacttaccatgctctgagtgcccatgtcatcttcattgcaatcctgggctacctctttctcatcagtgagaaaaatggggcctcaagcagttacagaacttgtccagaggtgcataaaaggtgctagagctgggatttgaatccacccagtctgactatggaggtttttttttttcccttcatgttttgattccagtaacactaattacttatttcccttcctttgactggcattgcatgaagatattctgccttatacccttaaaggaagcttttctttttaaagaaaaagatgacttatgggcaaggggattacaatttgagtcttttccctgcttatcagatctacttgatttcaagaaaatcatttgcttgtttgataaagcctttagacattggcagaggccctaaaggatagaccagcacccccactgtttcctggcctgcactctcacatcagcccttacagaactgccccttgcaccctagcacacctgaagagacaggctgctttattgggtagttagattttttttttccctgagtgcatcaggaacaatagttccaggctagctgcccacatcccagaaggattttctcctgtgtccgtttttgtccttcagctctaagccacctttccatttgcatggcttggtctttcacaggaggctttgtgaagaggcctgatatctgctggattttttaaaatcagccttattgaaatatattgacatacaataaactgaatatttaaagtgtacagtttaagttttgatatacaccatgaaaccatcaccacagtgaagatagtgaacatattcaccacccccaaaagttttctcttgccct

SEQ ID NO: 87728 - DNA, 1180 bp, Homo sapiens
ctaccatgccctctctgggcaggccaccgtccagtacctcagtgtgttcaccaacctggaagctccttaactcattctttaaggccctattaatccttctctatatatactagtattttaagaatgtataatataatagcaatagtctttggtccattaaaaatcttagcttttcttattgcagtggtaacccttagagcactcttggtaatgtatcttaaacaggttcttcattgactaactttacagattttagaattgcagtttattctttaaaaatatgctgtgattattttcaggatcataatttcagtaacatttccagttttgctttgttggcgagcttaaaattatggaatggacattttatgcaaattttatggtatagtaaagaaatgaagggacattttagaaagcatttaattctttatgtcactgacacttgtaaaattacttcctgtcaaacacgtgttgaaatacagtttatgttggcaaatattgggattgattttatattaatttaaatctgtattacattaaagcctaggaaattactaaaaaatgtaggctatgtgataagtttttctgagccatttatggattgggctttgaagatgaaagtttgttaaaccattgggaattaaagattccagctgaacatctcaagtttctgaaacaatacattttctcacactttgtggaattgttctgtgtcatttacacttgcttggttcagcagggcgagcaatgaggtattttttattttatatttgtttttgcagggatcttagcaacatcaattgtgaagagcttggtccattgcctcctggatgggagatccgtaatacggcaacaggcagagtttatttcgttgaccataacaacagaacaacacaatttacagatcctcggctgtctgctaacttgcatttagttttaaagtaagtttttgaaacaatacatgttaaaatgggagttaaacatgatgaaacgcatagatgcttttaataataaatgtgagtctcgatacagtggctcacgcctttaatcccagtgctttgggaggccgtggcagcaggatcacttgaggccaggggtttgagactagcctggtcaatatagtgagacctcatctctacaaaaaaaaagttgtttaaattaaaaaattagctgggtgtgg

SEQ ID NO: 87729 - DNA, 1020 bp, Homo sapiens
ctcactacaacctctgcctcctgggttcaagtcatcctcccacctcagcctcctgaatagctgggactacaggcatgcgccacaataccccgctaatttttgtatttttagtagagatggggttacgccatgttgcccaagctagtctcaaactcctgagctcaagcaatctgtgcacctcggcctcccaaagtgctgggattacaggcatgagccaccatgcttggccctattttgagttattttttaatgaacagatgcaaagtaccaagtagtccagttacaactggaaaaaagcttgaattctaaattaaattctaaatcaactttgtatgttgcacatacaaaggatttgtaggatgtggatattttatgttaagcacagcagcgcccctcctccaaaacaaacccccagaacaacccacagaaggttgtttttttttcctgcctaaagcttatgctcaggactctattgtgtatttgaataaaaaacagatgtgactagctagtcttgggttgctttgatactctctatttataaataaaactgtgattatgaaaatgtcttactttgtgttatagagctcagaattctttgagggtggcaaccaagggaatgtgctattactcattactttatcaaggttgccatttccatgtcttgacaatataagctgttagtttttaaaaagtagtgggggccgggctcggtggctcacacctgtaatcccagcactttgggaggctgaggcaggaggatcacttgaagtcaggaatttgagaccagcctggccaacatggtgaaaacccgtctctactaaaaatacaaaattagccaggcatggtggcatgtgcctgtaatcccagctactcaggaggctgaagaagaagaattgcttgaacctgggaggtggaggttgtggtgagccgagatcgcaccgtggcactccagcctcggcaacagagcaagaccccatctctaaaaaaataaatagataaaaagtagtggggaggaaattt

SEQ ID NO: 87730 - DNA, 1010 bp, Homo sapiens
aaaatcgaatgaattaaattgataagcagaggaatctctgaactaaatcttgaagaatgtcaggtatggtcacttcatggagcttactgtataaagacattgggatgcaagataaattttgggaactgcaaagaggtgcttttgaagtaactgaaaacaaatagtctatgtggctgaatccccttctcctcacccttttaagtgagaacaaaatttgccatcttgtgcagtgttttgttttgcctgttttccccttcttgagcaggactggcactaggcataaaataccaaattcttttcattagctgcacctacttttatttatacagaactaattgcttaactcattggatcacaaggttttctcttttacattataattctcaggtaaaagcttagctcatgttgccaagttgcatttctagtattaaactgccaaggaatttattgaagtacccatttttattatatctgagcacaaatgaatatgtacttgtgtcagtgttcaaggtttcacttgaacaccaatttccttctgactcatttaaccagtaaaattagcttgaatttctacatgtataaaaggatgattgttgttttaaatgttaatttttttttttttttggagatggagtcccgctctattgcctaggctagagtgcagtggtacgatctcggctcactgcaacctctgcccactgcaacctctgcctcctggattcaagcaattctcgtacctcagcctcccgagtagctgggactacaggcgcccgcccccacacccggctaatttttgtatttttagtagagatggggtttcgctgtgttggccaggctggtctcaaactcctgacctcaagtgatccgctcgcttcggtctcccaaagtgctgggattacaggtgtgagccaccataccctgccatgttaatttaagaatgaactcttgattatttttttattttgaaagatctgcaatagtagactggaagccccttaaagagacaaact

SEQ ID NO: 87731 - DNA, 1054 bp, Homo sapiens
tgcggtggctcacacctgtaatcccagcactttgggaggccgaggcgggtggatcacgaagtcaagagacctcgtgattttatggttaaatatattcttagtatagccattttccatattctggagtaattagtatgaatttaattgtgtattgttgacattattaaaaattctcagagtttggctgatggaaaatatttgttacacctcagcataaatactttagaagcttcagaatcccataaaatatattacagagttctaaaataagttgaaaaaattatatattctgtgaattgatacttcgggttggcattcccgatttgtaacagcagatgtcttactggcttgcttgttgcactgtgtccaagtttcctattaatgccttatcactcaatatttttatttaagctgggaagaaaggagaaccgcctctggaagaatccagtatctaaaccatataacaagaactacgcaatgggagcgcccaacacggtaagaacatacaaatattttctcatgatctatgccagccaccctcctgaagtccttttctatttatctgtcagctttactagattttttttcttggtttttgctgtcgtagatcagtagatcttataacaggtgccattgttattttttaaaagtgatcttcaacagtttgtttgacaggtcatgctgtcattgtagctccagggcctgcagtggtactcaataaatatttattgaatgaggcagggcgtggtggctcatgcctgtaatccctgcacttttcgaggctgcctgtaatccctgcactttgggaggccaaggcatgtggatcacttgagttcaggagtttgagaccagcctgggcaacatgatgaaaccctgtctctaccaaaaaaattagctgggcatgtgacttatgcttgtggtcccagctacttgggacgtggaggtgggaggattgcttgaacataggtggtggaggttgcagtgagccaagatcgtgcccgtgcactctaacctgggtgatagaatgagactctgtccccaaaaaaaaaaaaat

SEQ ID NO: 87732 - DNA, 1044 bp, Homo sapiens
tagaaaaccttagaattctaatattactcctaaagggaaaaatctatgggaaaagaaattataaattttagtagaaaccaaagagttcattctaaagtattaaaataagctaagtcagatgtcttctgaagatagaaattttagattataatagttctttctagttgtatgaatcttagtaatatttctgtcatttaatagtaagtcttcagtccagagaccgaataggcacaggaggacaagttgtggactgcagtcgtttatttgataacgatttaccagacgggtaagctaacatcactgaaatcattagagaaatatatagataatatccttaaaagaatagaaataagtgggtgtttattgtatattaaatggtgtttatcgtatattgaatgtagattttccttctaattgtaaaattaatggaagatcttgtctcgacaaatttataaaataagccacaaattagatgtgttaaatttggttattaagagttttgactaggagacaaatgaaatttcttgacaaatataactctcttgtaaatattatctagttaaaaaaatgttgcttgattaaattattcaaaacaggccatgcaagtgctaaattagaaacattgctatatttaagagggatgggatggataatttgtgtaatagtaattaaaataacatagtaagatttcattgagcatgtatatggcagatactgttataagcactttatgtacatatcatttaattctcatagcatcttggaaggcagtatatagccatgcttctgaaatcagaccacctgagttctaatccttactattctgtgtattggctttatgaccttaatttatttaacttccatatgctttggtttatatttatttacaaaagagtatgagtgataatagcatactcataaactgttgagaggatcaaatgaaataattcaggtaaggcactttagcacagtgtcttgcataaaataagcgcttagtaaataattagctactattatttctattgctactattattgttaccct

SEQ ID NO: 87733 - DNA, 1854 bp, Homo sapiens
attaagactcagactaaagtggtctaaaagttttggagagaaagtgactgcatgttggcaatgtaatacaccagtgtttggtttttgaaatctgaactctttaaatgataggtttgatttctaatggattgtggaaatttattgtcactctatagatgttagaatctctgataccagctaattttttcgttgctttctttgttgacttcaaatagatcagaggttggatttatgcaaactcgggccaaatgacaatgatacagttagaggacagatagtaggtaagtgtggaatttaaagttacatgaattttggtttcaaactgacctaaagtgtaaaataccttttaaatcaaagtataataactgtagcttcattgtgttggcctgaattaaatgagccaggtaaaatgttacagtgaatccaggatccaggttaacttaatttaaaaaactttaatgtaaaaaaaaaaaaaagttttgtgaagaactgttgatccttcaggatataattctttcaaagtatcctaatatagtagagcactaagttcagactttataaatgttattaaagtttactgaaaataattctcaaactagtttttttagtaagaagagaacattctattgaacttgttttaatgtttaatgctttacagctttaaaatctatgctaattgagaaaaaacagaatgagcaatggtagtgtaacactggaaaaagggagaaattgttaccttactcatgaggcacttagtagccttatatggtatttagggtgtcttgaattgacctggagggaagggcttgatataaaatttgctgagacctttcttaagaattgatagagatttgatcaagatgcctagtatggaaggacactgttcatcttagaggcttcttaaattaaagaagaaaaatgtggccaggcacagtggctaacacctgtaatcccagcactttgggaggctgaggcgggtggatcacctgaagtcaggagttcgagaccagcctggccaacatggtgaaaccccatctctactaaaaatacaaaaaatgagctgggcatggtggcaggtgcctgtaatcccagctactcgggaggctgaggcaggagaatcgcttgaacccaggaggcgaaggttgcagtgagccatgatcacaccattgcactccagctgggtgacaagagcaagaccctgtctcaaaaaaaaaaaaaaagaaaagaaaaattcaataggaatgtcacacttcatgatagaacagaacttagtgagattattttgttatgaacccatcagagaggttttagttactgaaggtactttattttacaaggcagtgaattgggttcatagttagagaaccatcagagtagccacatagcaaagccctattgtggttatcccagggaagtatctataccagcgcaccccaccatttttggtaccaggaaccggtttcatggaatacagtttttccatagaccaggctgggggtggaggtggtttcaggatgattcaagtgcattacatttattgtgcactttattattattacattgtaatacataatgaactaattctacaactcaccatcatgtagaatcagtgggaaccctgagcttgttttcctgcaactagatggtcccatctgtgggtgatgggagacagtgacagatcatcaggcatgagagtctcataaggagctggccttgtgtgtgcggttcacaatagggttcgtgctcctatgagaatctaatgtcgccactgatctgataggaggcagagctcgggtggtaatgctcactcacctgccactcactcctgttgtgcggccgggttcctaacagacc

SEQ ID NO: 87734 - DNA, 1015 bp, Homo sapiens
cctcaccagacattgactctgctggcaccttgatcttggacttctcagcctccattgatttgtgaaaaacaaatgtttgctgtttaagccacctaatctatggtatttgttttggctaaggcaaacgtcttgccaaattatattcttcttctttttttttttttttttttttttttgagacaagagtctcgccgtgtcacccaggcgggagtgcagtggtatgatctcggctcacgggaggctctgcctcccgggttcaggcgattctcctgcctcagcctccagagtagctgggactacaggcacatgccaccatgcctggcaaattttttgtatttttagtagagacggggtttcaccatgttagccaggctggtctcgatctcctgatctcatgatctgcccgcctcggcctcccaaagtgttagtattacaggcatgagccaccgtgcccggccatgttcttttttaatgtgtttgcaacctcgtaggttaattttatgagaaattttagagttgagtaataataatagccagtgtttattgagcacttgctgtgtaccaggtactggtctcatgttctctgtgtttcaatttgtttaatctttaaaacaacaccatgaggtggctcttagtatccttctgtcctcatgtttacagatgagctatctgaagcaaagagaagttaagtagtttttagggtcacaagttcataagggatagcaccaggttcaaacccatgcattctgaccctaattatttaactcttttatagtgcttatagcttaacacactatattacactgcctctataagtgtctctagaaaaagaaggtaaaggaaggaaacttgggagtggccaaaaagtgatgcaagtctttttctacatataaaataatgtttaggcttcattgcaagtatatacttgaactttacaataaggtttccttctctcggcatccttatgaagaaagtaaattgtgtggtttaatttaaatatacaatattcatctct

SEQ ID NO: 87735 - DNA, 1033 bp, Homo sapiens
tcagcctcctgagtagctgggactacaggcacacgccacgacgcctggctaatttttgtatttttagtagagacgggattttgccatgtcggccaggctggtctcaaactcctgacctcaggtgatccacccacctcagcctcccaaagtgctgggattacaggcgtgagccagcacgcccagcctacagtgctttttatagttgcagtcttctttcctatttgtgcttgtggcctgtgttttcaaatggagcgtatttggaaagctaaatacctttgcactttgttttcttagtagatcatcaggtatttgagtgactacagtttttcagagtctggaagaatgcagaagatgtggaagtttacctttgtttacaatgttacagaaacaaggcaaataaaattttagaacattatgggacaatatacttttctattgtgaatgagagagaaggctcagtgagatctgttattagataagtagttgggccctaaggaatgggtacgcagagtacttatgaatagttaaggaagccatcctgatttgaacataaagagttactaggttaggggaaacaaggagtgagctgcatgtatcctttaccttttagtttgcacatccttataactcgtcagtggttttctgaggattttatttgattcaacaagtatttgcatattatgtttaagatattatataataaactgtagaagaggtttatagcttaatgagacagaggtaagacatcacatgaataactttaacaagcaaaatgagaaagcactataataaaacaagtagaatccaagtgttggaggttcacgggaaggaagagatcaaaatcagactgaaaaaggagagtcagaaaaggcttcacagaagtttgatgaatggataagattttgagggccagtggttgggataataacatttaaggtgggaagaacattatgaataaaggcaaaggcagaaaagtcctgggcttatttgagggaagaggatgagcttgtcagtctaggggttaatgagagag

SEQ ID NO: 87736 - DNA, 1006 bp, Homo sapiens
tttgcccacactagactttgagatttatttggactaattttgtagttaaatgcctgtgtgtcacatcccagtccactggctgaacttgctggatgaaaacttgcagtgaatttggtatttgagaatttagcttgaatgtatgttggctgcaatttaaataatatattactttcatggcagttttcctttccctagggaaaattgcagggaatcattaactgagtgattcttaatggaaaacctggattggaggatacttgtattccaccccctcccccctcattcagtgtccttacattgggaggagtcagtggaaacctttataggggatctttgttgctttagagtttatctgttgctgttgctgtctgtagtcagtgatcgtggaaagaacatgtgatcccaggtgtgcagaaagcatcagaaataggctgtttccatttaccctcctctgggctatgtagagaaaatgagggaaaaaattgggtttttgattttctgcagataaggttagttgaggtttttagtatgacttaatagatcttaaagtgtttatctgtggtttccgtactgcctatgatacattataagaatttataattaaagtttattaagaggaaagattatgcttatattttaggggaagggggaatattgaactacatttatagtgattttgtttcaggtttttctgaggaattttaaataccctgtgtcctcttaatagtaaaaacagtttgaggtactctgagtttcttacaactatttgtctctgaatagttttctcttaaaatttgacaaatattaaaaacattgtccttccttctttggttacagtggagtctcttctgttttgccaggaaagttaacatattttttcttccatttttgttcatcatttataaattagatggtatagattttagcaaatagatctcaagagctggattcaattagcagctttttaggacataaacattaaagggttagatggaaaagattgttt

SEQ ID NO: 87737 - DNA, 1012 bp, Homo sapiens
tgcctgtggccttgggaagggccagggtcgcgatcaatgatgagttgggggtcggaggaatgggaaggcctagttcagggagagtaattggaaaaccacttgctctggtttggacattgtttaaaaagccgaggatgactcggggcggggggtggtgttttgtggaggggagaatacaccggttcgcatcgcaggcggatttcaggtcggaaagtcttggtcaaggagccagacgctgcctcccggggctcggggaacagcccctgggctaccgcccaggtgagatcgtgaaggggatgaagagctcccgtggcgaggattattgaatccggttgctgactgcgcgcagtaaacactccttaaagatggagcgcttaacgggagggtgtgcgtgtgtgttcccgggttgttaccttgcacacacccagttatgcccgcatgaaaaacctttactccccgccgccggccaccgctgcccgggccacacaccttaaactcatgtctctgaggtgaggagacaggttgacttttccggtgtgcctgtctgatccgacggcttgggctcattgtacactgtgttttggaagtgtctgattgtagggtggcatgtttggggttgttccttttaggccgcagaacttgtgtctaacttctaacgccagacctgctttaaaaacacacttttttggggggggtgcattgctaagtatgtgctcatacaaactttcgagcaaactttctgttactctccccaccctccccattcctttttcgaaatggaaaagaatgtccggaggggttgccagatagaagactacacttacaaagtgtttatgattccaggtgcatgaaatctttaacattacaggtacgttttgcttacagtgccatttttggtattcttacatggacatgccacccccgttttaggagaacttttatttggtttgtaaaggaattggaatcacggcgttatcctaccttcaccatttacccctgataaattgtccac

SEQ ID NO: 87738 - DNA, 1338 bp, Homo sapiens
ttgggcctcttgttaaaacttttggagtacagaatttctgaagtgctgagaaaaatataaggtaaccagcatcaacattttttccttttcagactcctgccctaagagccatagggaatatcgtcactggtacagatgaacagactcaggttgtgattgatgcaggagcactcgccgtctttcccagcctgctcaccaaccccaaaactaacattcagaaggaagctacgtggacaatgtcaaacatcacagccagccgccaggaccagatacagcaagttgtgaatcatggattagtcccattccttgtcagcgatctctctaaggtaacgaagtcttaggatttaatcaagtcatttttagtatttatagaaagctgtgcttgataagcttcttcatgtgcaagaatcttgggttctactaggagtcctttgctgaacaatacccagtaacccctttacttaaggttgtatcaatagaaccttggtactttcagtcaccgtttttgtgaaaaagtactcttggaatcttatttgtgcaactgttctgaaataaaaccatttccttatgtttaattggcagattttgagacacaaaaggaagctgtatgggccgtggaacagttgaacagattgtgtaccttgttcactgtggcataatagaaccgttgatgaacctcttacctgcaaaagataccaagattattctggttatcctggatgccatttcaaatatctttcaggtaagtcctatcaaggtggctttgtttgaatttggacttgataataattggtttactatttagacttgggggagggcagctgtaagtttactcactagtaagccacagaatcagaaagcctgtttatgtggccacccctttgattaaaaatgtggcaggcattataaaagatataaaagagatgacaagtggatggtgcgaactgaatcggagtcaggcgcttatgtggactcatcacacctgtttacttggttgatttaatttcccaatttcataccgaattttggtgacattaaatttgaatgacttggccgggcacagtggctcatgcctgtaatcctagcactttgggaggctgaggtgagtggaccacctgaggtcaggagttcgagaccagcctggccaacatggtgaaaccctatctctactaaaaatacaaaaattagccaggcctggtggcagacgcctataatcccagctacttgggaggctgaggcaggagaatcgcttgaactctgggtggggggcagaggttgcagtgagccaagattgcgtcacttcactccagcctgggcgaaagagtgaaactctgtctc

SEQ ID NO: 87739 - DNA, 1833 bp, Homo sapiens
cgttacattttattttttaaaaagctgaataagacccactatttatttcatagtcactaaagagttgggatcaactgtttgaaaatactattttgaagtatccatgaggtcttacactatagctggaatgataaaaggacccaaaagagcgtttttaggaatatattttgggggggagaatacctgtgatgcccttctttttcccttaggtataaacttgaaaagcttgttataaacttgaaaaaatggtaggtgagtaatttatatgtatggtttcatgtgtatatttgaaatattaatacatgaaagcagtgaataatagtatctgacacgtaataggtacttaatatgtgttagttttctttctgcaggcatatcttggttgtttaattgtaaacaattagctttacttttaacttagcttttagacttcaaaagttctatcataagatttatcttaacttactttgagtgattaattttaattattgaaagacagttgattggatacaatttacatctttggctgacataaataatgcagtctttttatttttttggtcaggtactggtagttaactctcaaggagaaatttcacggttgagcaccgaaaagaaagtggtcatgaaaggaagtatcaacaattatcttaaattgggtcaagaagggaagtatcgcgtctaccacaatcaatactccactaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaaccgggcatcacataggtaaaggaaactaaggttaatttattgctgtaaatatactaaatgtttataaaatgattgttgtagttgtgcacttgaaaacgtcattaccaatgagttgaatgaagtcaatgtggtcagcagacaggacgttagaggcatgagtgtacttctaacttactgaactgacaccactaactatttggaggattcctaggagtcagaatctttattcctggaatcagatggagaccaaagttacaactattatgcttttaatttagatcaacctagtgaaataatttctttcatttcttctgaaatacagggcaaactggatcaaggcagttcagatgtgtagcaaactcagagaatttgcattggctttagccattttggagtgtgcagttaaaccagttgtgatgctaccaatatggcgagaatctttaggacataccaggtaagtgaattctgagccttgtaaatgatgaatattggactcgcttttgaaatactagcctattaatcatgaaagttaatgtatttaagaggccatattaaagactttacttttggctcagtttcttcctatataagttgtaaacatgaatgaatattattagttctttctttctttctttttttttttttgagacggagtcttgcactgttgcccgggctggtgtgcagtggcacaatctcggctcactgcaacctctgcctcctgggttcaaatgattctcctgcctcagcctccgaagtagctaggattacaggtgcccaccactacgcccggctaattttttgtccgtcaacccaggctggaatgcagtagtgccatcacagctcactgcagccctgacctccctgggctaaggttattctctcacctctgcctcccgagtagttgggactacagacgcattccactat

SEQ ID NO: 87740 - DNA, 1911 bp, Homo sapiens
atttcatttattttagttttatttgagaaattaagaccagaagttttgctcatgtctttttcacttggaaatctgacttagtacctagttaatttgtctctctcccatcattttaaggcgttcgcttctgttaatcacagatgatctgtccttgtgttgtgctgcttgactaaaagcactgttttgttttgttttgttttgttttttaatgataggatacagggtggcttttcagtctagtaaacatgaggaggggagagattgtgggtgggtgtgggtgtgtccgcatgtcccaaatacagcacatgcccatttttttatggtacgaggttagggcttattaataaatgtatactagatcttgaagtgtaagtctaagtctgaacattttaaacaagttggactttatggctttttcaagttccatcaagtagatactagtcttaggctggtaggtgattaacaacatcatttggagtacagtgtttgtaccactagcattcttatgtctgtacttgaacgtgtagttagcatttaagttatgttcactcttgtagcattcaggtcttaccatctggtttcaaatgcgagagcttatatgaacattgttttgaaagcatgaatgatatggcaatattttatgtcttgataaggagagttttgtgacatatacaaatctgctgttgatgatgaaagtttacaggtggatcagagtatgctggaactcagtgtgcataaaatttcagtcagtgaatatcactgaacgtcatatactacttggtatgtgactttggtttgtgttaagaaagcttgtatataatattttttgccatagtaagtgagaaattgtccttaatcatgcctgtttgatggtactaggaaagaaaggggtagagattaattcttgcacagtataagcaacagtgcaacaaactatgccatttaccttttacctcttacttgaaggcagaatcgcaaaacgtttgaaatggcttttctaaactactctactctggtgagagctcatttaccacaagaagccttataaaaaagtatattttgtaataaccccgtagatactgtacctaacaaaacatgactcgtattagctctataaaatatttgtggcttaggattttttttttacatatatctttttataactttccaggaactaagcacattatctgataattgttgtaaatttttttgtcagtgctttagttcaggatgggcaataaattatttctaaaggaggtctaaaagtggaaagaatggtttgattttataaaatgagttgctagttcattacagctttttacttttgtacatattttgcaaaacatttgcctcttgctattaatatttgctttgtaaaaattactgacatttaataaacatttgtaaacaattcaatactatgatgttatttaacagtttggtaattgtaaaatgtaaagcagatactaaaagtttgaaagcaaaagtttcatctagggcctgagttaaggcacaaatctacttcagcagaatcccaatgccacttggcttgaatattagtctagaaacttcttactagaaatggagatgtggacttcttccaaggaagttctcagacacttaatatgttttgacaagggaataggggaagagaaaccacttgttttctctgctcctcttatggccactgaaactgtattagggtgtacctgagctcagttcatccagctgcgacaatattaataattctgttacgtctgttgtaattaatgtttggagacaaaccaacattgaccactcatcttttttaaaaaaataaacttcatgttagattatgatttacagaaaaatttcaagacagtacagagttcccctatactccacaccccttataatagttcccgtagttac

SEQ ID NO: 87741 - DNA, 3125 bp, Homo sapiens
aattttgagtagtattgcagggatgaaaacaagtagattctggccatttgtagtaaattttgaacccgtcctgctaacattttaatgtatcttggcttttgttgtggggagcacaagtgggtcttgctatattgcccaggatattctcaaactcctggcttcgcaagcgatcctcctgcctcagcctcccaaagtgctgggattataggcatgacccaccatgtctgaccagtcttggcattttataataagcataatctatctgaaaatgtcacttaaaagatcattttgtttgcatatctattcactagtccagttagtagtccattaaaaattcgcattacttcgggattaataggtataaaacaagttttttcttttccaggattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttg

SEQ ID NO: 87742 - DNA, 1080 bp, Homo sapiens
aattctggccgggtgcagtggctcacgcctataatccgagcacattgggaggctgaggcgggaggatcacttgaggtcaggagttcgagaccagcctggccaaaatggtgaaaccccgtctttactagaaatacaaagaagtagccggccgtggtggtgcacacctgtaatcccagctattcgggaggctgaggagcagaatcgcttgaacctgggaggcgcaggttgcagtgagccgagattccgccactgcactccaatctgggcaacagagcaagactccatctcaaaaaaatatgtatatatatatattcttaattccattgcaccattttgagacaatgagtattcttgtaatgaaatttcaaaatcatatgacactattcagaaaggcataaagtgcagcattgtgaataacagcattgttttaaatcctgccttgatttttaaaatattttgaccttgatgataaatattagctgtcccgttcatgtattaccagaaagttgtgttgtagttttggaaaaatgctagactgacaaggaagaaccagttacattgcataaggaagtgtgccatcacagagtagccagagacttgtgtgaccagcagcttctgtttgttcagggtcttagagttcactgaccaagagtgcagagaagagctcatttgatccttgcaacaaccctccctcccaggtatatagaccaagtgtgatcacctccatttcacagacagaggtgctgacactcagagtaagtgactagtttgagttcttgggtcaataagtaagaaattaattatagtagagaaaggatttttcacacatgtaatatagcagcaatgaaaacatagaagttttaagtcatgagtggggttgcacagtaaaagaacttttagaataggttagagagaggtgggcagaacttggaactgggaagtgatccttgtgaattggcactggaatcagatcccattgccttttttttttttttttttttttttaagacaaagtcttgctctgtcacccaggctggagtgcagtggcatgatctcagctcactgcaagctccacctcct

SEQ ID NO: 87743 - DNA, 1132 bp, Homo sapiens
ggaggattgaagaaagcttagtctgtaaatgttggcatacattgtattcttctagcatagctatagtgtcattgcataataaataatgctttaccatggaatttgatagcaaaattatttacatcctactgtgccttaaaagtgtggtattcagggccttctttttatttggatggatgtgtatttactcccttttttttttttttaatgtcatggtgtggcaatactggtgacacttggaatattttcaagttataactgtgtcactgcagtttgtggtgcaccaagcagtggtgcagagtcatgagagtgcaacacactgcctcagtctccactcctcacctctgctgttgtagcctggaagttcccatagacgatacaccaacaggtgagcgtggctgtgttccagtgcatttttatttatggatgttgaagttcgaatttcatatcatttttacatatcatgaaatagtcttttaagttttttccccaaccatttaaaaatgagccgtacaaaaacaggcattgggttggatttggccttcaggctatatagtttgtggacagacccctggtccagaatctagttaaatataaggagcaatccatttgctctcaaccagctcttccttctgccataatagtaattcactagcactgttgtagttgtatatactttttcagtggtactgtgttgaggatcatttgaaagatcttaatacatattgccaaattgctttctagaatatgtttaccttgctttttattagaaaatctatatttgatacccatctctataaaccttatgttatattcttaaggcatgaatcagactttgaattaaaaaactctactctttacctattttctataagcagagttgcccttttcttattgacataaagccactggtgtttttgagtatgttctaaaacagcagatcagttcttcttgtgtgttctttggctatccagcttaaattccatatccttttaaagaagtgcattctaaatcctttccttttaatattttagctgtgcagaagagagcattgaatacaaatgtcacttgttcagtaactgggtcgataagctgctaagcctctctctgtatgactatgaatttaatagaa

SEQ ID NO: 87744 - DNA, 1040 bp, Homo sapiens
ttgatctcttttctgtctttagcatttacatttataaacaagtggaatttagtggcagaaagttgcctttaaaaaaaaaaaccttcccgttcaatgtattatgcttgtgacaactctgacatttgtagaaataataagatggaaacaggatgtcataaaggggaagttataatacaaaaaattcaacagatgtttatgtagctattgctctgtacagggtaaaattgctatcctaggatacagggaggtgtagcaaagagattttgagtctaaatttgacatgtaggactacatataaaaataaagaagtgccatgagtggtataaaccgtaagtgcaaaagatattgagtgaagagtatgattaccgagagttgggaagttgcagtggaggtaggggaaaaataagaatcaggatacattaaattcttggttctgccactgaaacagttttgttggctaagccacctaacttccctgacccttaggcttctcatctgtaaaatggagcataaggttacttgttctccaagctgtcttccaacttaaaatttatctttgctccctgtataatagtaagaaccccagaaggagaggtggaagcagaggcgtgtgggggaaatggtgttaggcagaggaggtaggaatatgcacagaattttccagaagcatggggagatgagcatggagcttgtttcatagggaaaagtaggagataatgttggagatagtcagttgggactagctggagacttcaaacacgagacatgctaactgcatagctaattcagcattttatcagatactattatatttctcctgttttaggtagttcttggtaaatactttttgactcagcagcacaactgaacagtatccttgatccttcagtgttcaccaagtttttcccaacatccttatgtttctcattcaggtgaacttctcagtattatatcagtaactctgcctcctttttttttctttttctttttctttttgtttctacctcctttttaagaaacaaaatccatagtattcctct

SEQ ID NO: 87745 - DNA, 1007 bp, Homo sapiens
ttttttagccaacagaagatagtggtgctaaatggtaacatggaacaaatatggggtaaatattaccatgttgctacctgatcagcaatatatatgatgtcagagctgacccatctctgcagtattaaactcctttctcacatttaaaatttgtacttaattttgttaagtaccgtggctcatgcctgtaatcccaacactttgggaggccaaggcgggtggatcacctgaggtcgggcgttcaagaccagcctgacaaacatggagaaactccatctctactaaaaatacaaaattagccaggcgtggtgttacatgcctgtaatcccaggtgctcaggaggctgaggcaggagaatcgcttgaaccagggaggcggaggtttcagtgagctgagatcgtgccattgcactccagcctgggcaacaagagcaaaactccatctcaaaaaaataaaataaaataaatactaaacatatggctaaaacttttttctctgtttctccacgatgaagcattttagtaaggtcctttttttgtgacttctgtagtaggagaattactaaactgcgttgtacattttgtgttaacatttgataggactacggaaatactcctagaacacttggatcattaagattattagccttgggccaggcacggtggctcacacctttaatcccagcactttgggaggccgaggcaggtggatcacaaggtcaggagatcgagaccatcctggctaacagggtgaaaccccgtctctactaaaaatacaaaaaattagctgggcgtggtggcgggtgtctgtagtcccagctactcgggaggctgaggcaggaaaagacttcatctcaaaaaaaaaaaaaaattattagccttaaattattttggtgataaggccaacacaaaaacttgatataaagaggaatttattaatttgtgagcagcaacaagaaaaaggcaatttctagaataatgtaataagttctttccaaaaaagctctt

SEQ ID NO: 87746 - DNA, 1021 bp, Homo sapiens
tggcctgttttagtactgaattaaatatttgaaatactctactctggctgtacattcaacatagcctgccactgcacttttgagttaccctgtctttagaaaaccttcttatgtgacaatagctagataatttggtaactcagatgaataaagagatgggagtcaggggttggctggatgatacaattggagatatggatgaaaactgacaaaatggctaggagtcatttccaactatttttttttgtttaatttatattcacttattgagaaataaggcaacacttgttacgtaggacaggacagtgtgtgtgacagtgggaggaacatcccacagcttcctactttctgtaaacagtttaacattgtcagcattaatacaacttcctgtaatggccagtctgtctttgcaattcctgaaaccaaagtgtttttgctaatcatggtaccttcagttagacttaattcttttctttttgtgcttgaggttactcttcttgaagccgataagatagtgtattcattaacacagagatttactccctcaatctgtgtaacaaagtaaccatttagctccatgattggcctgtaaaaaggggaggtccaactaagtattctagaaacttcagtttcagctaattttttttatttatttatttgcactgcagcatgtattggaaatataatacaatcaagagtcatttgaagctcctgtagtcccagcttctggggagacaggaggattgcttgacctcaagagttcaagtccaatgtgggcaacatagtgaggacagccccctccctcttaaaaaaaaaaaagaatcagagtcatttattaattaatgctaatttggatttgctttaaatattaaagaattgctactttcagttgtaaaatactatgtttcttttggatgattggtccattttctctataagtatagtcaagcaaggactttgagttgctaaaaacctattggttatcttttgattctaggattagtgttaaatatttcatccc

SEQ ID NO: 87747 - DNA, 1963 bp, Homo sapiens
tcttggctcacctccgcctcctgggttcaggcgattctcctgcctcagcctcccaagtagctgagattacaggcatgcgccaccacacctggctaattttgtatttttagtagagacagtgtttctccatgttggtcaagctggtctctaactcctgacctcaggtgatctgcctgccttgccctcccaaagtgctgggattacaggcatgagccactgtgcctggccatctacctcctgtttttaagtgctgcttattctcctttcttcttagttcattttctcaacaaaccacacactttcaactcaattttgtcaggctctattcatccttccaggtcagagaagaaacattcatctgtaataagcatacagtgcatatggattaaatgaataaataaagaactgcatacctgaaagttctctgtggggaagttccgtatttgccctaagtccatttaattaaagttgtgtttcatggacagttttttaatttggaagctgacgtctaactgtctcacatcaggactgtcatgtcctcattgttgagaaagcatccctaagtatatctttgtgattaagaacgaataggtaaaaccactcaggatgaggacctgcttgttgttgacttgagccagttgatccttaaggagcaaagaagtcctcaaagatgaggagagataagttccagaaatacttttttccatgatgaaaagtagagacaagaaaagaggaacagagcaagacctaattttaaacttctggaggacagagattcttttttcctgagtctacgctcagcattgttttttgtttttttgtttttgttttttaagagaaggtctcactgttgcccaggctggagtgccctgttgtgatcatagctcactgtagactcaactcctgggctcaagtgattctccagcttcagtctctcaagtagctaggactacaggtgtgtgccgtcacacccagctaatttaaaaaaaaatttttgtagagacggagtcttgctatgttgccagtgctggtcttggactcctgacctcaagcagtcctcctgccttggcttcccaaaatgttgggattataggcatgaaccactgtgcgtggcttcagcattgttaatagcacctgacacatagagatgctccattattatgttgacttaatgactcttaaactcttggatgtgctgtggtgcttggcatagtgtcaggcactgagaaggcacttggcttacttaaaattttcctcaaagtcatcatcaattccatctactcatctacatgcagcagctccccaagttctgatttttctacctctgtaacgtctcttgcattcattccctcctttcctctattttgtgttctgctacctcttgcttggactccaaggcagtcttgttcaaacacagcattggtttgctcagaaagctttggtggctcaccattgtcttcagaacagagctcagcttttttgtgggagtaaagactctagctagcttacctgtgattccagcaatatatttcattaggccactggacatactctgtaatctcttgattcccacataccctaattttttgcttctatagctctcatcatgcgtagtccctctgccagaattattctttaccctatctgttactaggtcttacccttcacttaatgtagtgataatcacactaaatgtggcccatggaccccatggactggaatgcttgttaaaacaaacaagcagatgctcagactttatacctgaggatctgattctggattctgggatgggacccagtgatctgtgttttcagcaaatagccataggtggtttggatgaatttgctccatgccccctccctttccccaggaacagtgccttaggggctgtgtctctttatttgaagcatctccagtcttcttggctagaatggagatctccgtgtcctttgctttccctagc

SEQ ID NO: 87748 - DNA, 1002 bp, Homo sapiens
cgccccacttccctctcgcagggggagagaccaggacgcggtggggggtgggggaatggccgtgacgcccaccggggagacaagcgggagagcagggcgaccccgagcatcctctcgccctggggcgcgagggcaccccgggcgggcagggccagttgccggggcgcgcccccttcccgccagcccgcccgccgggcccgttccttcgccagcgacacagcggaccagggcggtgccccgccccgcacccgccgccgccccagcccccctgcccttaacccccggcccccattcccggcccggcacctttgatcacgttgctgtagatggtggggcggaactcctcgcgcgcgcgctggtcgaagtcctgcccgtggatgatccgcatctgcttcaggaaggtggacttgccgctctcgcccgcgcccagcagcaggatcttcaccagccgcttcacataggtcttttcccgagacaggcatttgtcgatctccttggacttgcgttgctgctcggcctcgccactcgtcagcaggcagccggggaagcacacggacagcacggaccgcgacggcaggaagtccgccatcttgccgccgccgccgccgcctcggcgggcccctccggctccctccacctcctcctccggcggcgggcggctccggcaccgaggctcgagggcggggagcgcggcggcggcccgagcgcgcccagggagggagggaaccagcgaactgactcgcagggcgggccgggcagggcgggccaggacagcgggggagggagggagggaaggagggcgggcccggccccggaggggcggtggccccggagcgtgcgcgctcccgctgcctcccggaggcgcgctcgcacgccgcggccgcttctccgcctcccgccctgggcggcgagtcacgagctcgatgtgtcgctcgggtgcccgcgcccgcagccgcggccgggcgcgcggggagggctgaggaaccgcggtcacgtgggcca

SEQ ID NO: 87749 - DNA, 1047 bp, Homo sapiens
ctggagtgcagtggcgcgatcttggctcactgcagcctccgcttccctggcttaagcaattctcctgcctcagccttcagagtagctaggatcacaggtgcctgccaccacgcccggctaattgttttgtatttttagtacagtcggggtttcgcaatgttcgccaggcttgtctggaactcctggcctcaggtgatccccctgcctcggcctcccaaagtggctcacaggcatgagccaccgtgcccagcccggggctatcttttctatcagacaggaattgtttgcatctctaccagacaaacattatttgcaacttagcaatttcctttaagttagcatctagaatctgggccttaatcagcaataagtactaagtcaaagtgcccatcccttcacattgacggaccctcgggtattacccagatcccctctttggggttcagccctgtccccacagctgctgggagtatcagctgctgatatgggtagatggcttacagctctgttcttacctggaaatcacctgagatggaaggaaacttcctcccccacgtgtataccttccctcccttacttctggttggtcttgaacaggtgatacaaagcctggtgctcttgccttaatttgcaacaacaccgatggccacctgggctccagagctttccatgggacaggctgaggcctcagcggcagcctcactgcgggtgagcttcaccctcacccatgcctccctttccacaagagttcctccccagagcagccccagtacaccctggtcttgcacctgcctgtctcagagtcggtatcaagggaacccaatctaacacaggacttattacacaatgctagggtggctttggggaaagggcatgaaggtgtctttttgcctcatttatgagtttttagatactttctcttaaggaaggtagtaaaaaaatctgtggaatgaacagacaggagtgggcggagaaggctcaggggaagccctcccccacacctggaaaaacaactctgggtccgctgacagaggccacaaccagcct

SEQ ID NO: 87750 - DNA, 1243 bp, Homo sapiens
gagacagcagaggtgctgggttgaagattgcaggtggcaggcccagcccaggctgctgctcagtgggtgcctggccttcatcatctcggcccacctgcttcttgtggtgtggccagtcccagctgccgtcttaaagcagatgtgcgcaacagtgtacaggcacacctgccatagcaaattcctaggatacctcagtcctccatgttggtatgcttttcttttcaacaatgtggaaaatgcagtttaccaagaagcttttttggttttccttttaaggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgttttgtttttttttttcctatgctgctctgttttgtcttaaaggtcttgagggttgaccatgttgcgtcatcatcaacattttgggggttgtgttggatgggatgatctgttgcagagggagaggcagggaaccctgctccttcgggccccaggttgatcctgtgactgaggctccccctcatgtagcctccccaggcccagggccctgaggcctgctagaatca

SEQ ID NO: 87751 - DNA, 1083 bp, Homo sapiens
attacaggcgtgagccaccacgcccggcctagcagcctttttttcaagccattctacaaaatctcagaagaaatggggaaatggacatgactgtgtgataacccccattagttgttctcattctgctggaataaggggtgggctttaggcattctgagatcatgccatcccaaaggtgtcctgctctgggtttgtctctttagcactctccaatccaggtgagacccggcatctctgtgataatttctcttctctcatcttcttgaggaagcaccccatttatgccagcctgaaagaggccgccgtatactttcatttggtggcggtgggggaaatgataccaatttgtacaaccaaaaggaaatcatccttttctgcatgctgcatgcagcacatgtggggttggactgtgtgtcccccagagctgcctgactctgggatgtggggctctgccccagcccccactttgggtttacaattgcagccctagtgtttggataccctgtcacttatgcacatgtgcgcacgtgtgtgtttgctttagatgtgtgtctgctttaaaatgctaaacttgttccattccatcttattttcagtcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtaagagtcctgtggcttttttctgctctcagtttgtttgctcagaaccaagagccagagcctggagcagctcccctggctgagcagacctaggtggggcagggtgggagggggctcagcaggcgctgggggaggctcccttctcatttcttctctcccctcaccgctagcagcaataacgaagcagcagccgcaagagggaggctgcgtggagggttctctgggggacctggccaggctctttccaccaggtgaaccagactgaggagagaaaaggagcagctgcttgcaccgacaggagagtggggctcaggccaca

SEQ ID NO: 87752 - DNA, 1025 bp, Homo sapiens
ggtggagtcaaaaggctaagctaattggctcggctcaaatggcagctaagtggagtccacacttcaaaaccatgctccccagaaacagctgggcccggcagcaggctcgttaactaaaatgtttataattaaaggagaccgtatagggaccacaactctggtgctctccagcccacaggcttgagcagccaggaaactgatcacagacttttagagcttgaataaaagaagagaggcccccttttggaatgaggggctgttttggaagaagattcttggctggagggaattaaagccacatttccttgaaggtgcctgttaagcctttctgagcctctacaggctgacatcttccttttctgctctggttacaagttgcctttccagcagtttagtccttcacctgccctgggtaatggagtgtgtgtggtggtggtggtgggggatggggggcggggtatgaggtgcttatgaaatcatttgttccttttgccttcaatattgcagttatctactcccctccccatccctacccccatcctgttttttttttttaaccttattatatggaagaagaaaaagaggcataaaagctctaccactgactttcatctgggagaaggaagagtgaaagctaccagtggaaatgtcaagagtcttggagggggtggacgggggactcttctaggactcttgaagccttatgtcacttgtgtcatggtggggtccatggagtgcttgactcctgcccccaagactgtcaggaacagggctgaagcagagtcatccactgtctaagtccctagaagagagatggaggatagacattgtcttacagccctagggcagcagaatttggttagaccagcatgagcccaatctgtgggataccgccacccctaccatacaaggtatcttaggtgagagatggggatattcagcatggcttgggaaccacctggcgagccccatagctagtgagtactaggtggttggggaggacttcccagaaaattccacaaatt

SEQ ID NO: 87753 - DNA, 1075 bp, Homo sapiens
agacacaggccctgtactttgcccgctttgcccttcccccaggcatgagcgttctcaacatgagatctgtgaataggaccggttggtcatgagacctttgagccactttgggtttcttttatttatatttcttagtaatcaagactgctttttagaaagactggttctgggaggggtagaagggagcaggttctaagttctcccctgcagcctccccatttacttcctcttcttttatccccttcccagaagaaaaactttcttttatttagaggtgactttaaagctttcacccttccccctttagctgaagcactttggattccaagcatgggggagccacttttcagggatcagaaaggttacctttgccagtccctattctaggtggcaagggttagtgtgtagttcagtgaggtccacttggatacagagacagaacaggtcaagtccctcatgtagcggctttctctttggggcacagtagatacctttgggttcctggtggcagaacctgtgagtattaataagcctatcctgtggcaaagctgccttggatggatagtgaataaaccaggaagccaggaggaagtgctgcaaggcctagagacccgtgggctcatggtgttggctctgttcgtcctggtggtgttgagtggctctgtgccctctcccaatcaagtgcgcaggttatcagattaactgtcacagttgtgcccacctgggcatttatactaattaggagtgcatttggcatccatgtggggtcactgtctcttgggcattgtctcatgctgcctctagtggggctcactagaaaacatcagaagggtctccagacttgttggcactgactcaagctgccattgggtgccaggcatgggggtctctggggccctccccactctgctgcaagcagacttggcgatgcaatgtgttctctggccgactggccctgggtgtgtgtgatcctgcccagcaccgggcggtcacccgggattcccagggctgggatcagacctcctcttcagaactctgccaattgtaggcctcgtgcagatgagagcgccgggcg

SEQ ID NO: 87754 - DNA, 1040 bp, Homo sapiens
tctgggttgtgggatggtggtgttgggcaggggacgtctcagtaggagggccctggattgagtgccttcctgtgtattcctaagaacctggtgttgagaccccgggcttggcggggtggggcagggcaccaaagcagagaagcacactggaaaagtaaacggcgtcctcctcctcattgccatcgctcctgtcgccgtgtgtggggtgctctgcaggtgctaggccctggcttggcatgatgggcaccactgcctttaatcctacagcaaccacaggttttctgacctaaggagtgaggcttacgagggaggggtaggggatctgaggacagtgcctctgtttctttgctggcaccaagggctggcagacacgactgcacaagttcttatgagaagtgggtatctgggagagcttccctttaggctgggagatgcagaggcaaggatgtgttccgttcattcccaatgcaaggggtaatgagagcaaaagaagcatctgcaggaaagagggcaccacctggcagctccaagttcacactggactttgaagcagtgcaggccccaactattcattcctcccccatagacagccaaatggccatactgtgcagggggtcccctaccttcacagatttatttccccagtatcaacagcagaggcagggacacacctcatgaacagctcataggaaacctcattccaccacaaggcatccgctcccacccaccagaaaaggcttcaaagcggcaaccaaaccttgatctagtggccagtttgggcacattccctcctcccgggtgacttccttctctattctttataagaaattcttgtaaagctctataaagtctaaaatgagggccaggcacggtggctcacacctgtaatcccagcactttgggaggccaaggcgggcggattacctgaggtcaggagtttgagaccagcctggccaacatggtgaaaccccgtctctaccaaaaaaaaaaaaaaaaaaaaaaaaaaaaaattagccgggcatggtggcgggcacctgtaa

SEQ ID NO: 87755 - DNA, 1007 bp, Homo sapiens
tgcactaggcggtttctatagttgtttcatgtcatcctcataaccttgggaagtagctgtcattaatcccatttcacagattaagcatcaagagcttaagtaattttcctagagccacagatggcaagccaggaattgaaccaaagttggcctaactccagacaaagctcaggctctttccgctatgaagttctgtctctccaacctcagggaatccctagaatggattgaggtttccagaaagcagtaattttccttacactcactcattcattcattcattcaacagctagtgaaaccagctacatgcccagccctgtaaaagaaactggggtggaaagacagaaaagtcattcctgcccaagagaagctctcaggtttagggaagagatatgaaaacaaataaccacaaagcagtttgagaagtaccagtaatagaggggaggaacacagaggaggggaccgctggctttgcctggggctaggaggcaaggagcagctggggaggaggtgaacgattccacaggagaggtgacatttaaaccaaatggtggaggatgaatgggagacagaaagacaagtgttccaaagagagaaaatggcctgggccaaagagcaacggagcgagaaagacacggtgtggaagcagcagtggtgggcagggcgtgaggacaggtaaagccacaatgatgggggtgggccagatcaaaatggctctgcaatgaggagtttgaactttattctgtcgtaactgatggattttcaataaggatgggatgtgaccaaatgtaaaaaacacaacattgacattcaacaaatcctctgagttttatctagggaattgtctgaatttaaataaaatcttaccatactatttgcacaatattgacatgtaagccacgtccacctcttctcacacaaggtgtcttttctaggttaattttctgcaaaagagagcttccatccttcaggaagaactgactacatatcaaggcagaaggtacagc

SEQ ID NO: 87756 - DNA, 1045 bp, Homo sapiens
tctctaccatccaattggctcagaatagtttaagaaatatagggagctcctaccttctactggccgcccccctttttctctcagacttcttatggttgccatatgtgatccacaaactaagttgagctataccatgtgtagactaaaaaaatctcaggcaagtctcctgaaagttctcattccatcaaacatctactttgccataagggacatttaaagtatatattaacctaagtttacaatacaacaacccttttatttccaaaattactggatatgacaaagatcacagaagattactggatatgacaaagatcacataagccacctttagtacagggacttggtttcacctgtcttagtattttaaagcttcctaaggacataaagaagcaagattaattcagttcatcaaaatgaaggagaaaaaaagaattttctcaaagctggatgaaaaaagttaacatcatacaagataaaatagtacccttatccctaaaatcttagcctttctgctgccaacatcagttttaaatacgtgttcaagataaagagagggaatgaaattgttatagagacctaagttgccaacttgggcactcaagctacacagaaagatccttcagataggagcctcttatggttggaaataaagcaaaaacacaccctctggaactctatttgaataagaaaagatgccctttctgtttgttttcacttatagatgaagttggaattttcaccataatgtgttttaccatgtgggccaataaacatgaagagtggcattcatcgtaatatccacacacgtttaggattttttttctaattgtaaatcgtgaattttttctgccatttgaagtaaagaaaaaagctggcccaatgaggatactgcggccctcagccaccagtgattgttgagagcttttttctttgtctttttactctttaccatgaattcttttcagacatcatcagaatatgatttctacatttcagtacatttttaatattaaagaaatgccttcaacggaaagaacaaaat

SEQ ID NO: 87757 - DNA, 1112 bp, Homo sapiens
tattcatccatatttaacttaatcttttatctaaatttgacctatgtccccctttaaatctgtgacactaacacaagtagtcaaaaataattagaattaggctgggcacagtggctcatgcctgtaataccagcactttggaaagccgatcacctgaggttaggagtttgagaccagcctgtccaacatggtgaaatcctgtctctactaaaaatacaaaaattagccaggcgtggtggcgggcgcctataatcccagctacttgggaggctgaggcaggagaatcgcttgaacctgggaggtggaggttgcagtgagccgagattgtgccattgcactccagcctgggcgacagagcaagacaccatctcaaaaaaaaaaaaaaaaaaaaaaattagaactattgtcacagacactttttaggatctgctaaatatgagtttactaaggatatctaaaatgttgagattgttacattatgaatgtatttttcactgttcatcaaagcaacttcaataacagtagctagcctcacatcagccaatcgaacaactaaaatgtgtttgaaacagcccctgaggactatcttctctttcttttcaagcaaatattgttatcctgatactggttgcattaaggaatcaaaattgaaactggcagaattacaaaagacaatcctaagctgctttttttaacttgcttgctttaaaaatgtttaaatggtttctggttttcatttaagaaaaatgtctatgttttgattctataaaaacaagaaatgaatgaggcattgtaaaagttatgtttttaattaaaaaccaaaagctgcttctcatcaggtcttgatgggtggcatctttgctgtccaccacatgccttggtgccaccaactctcccttctgtcccctcaagcggacagatcagcacacagagtccccagggaagatgtgctcattgtggggcacaaagggttaactttctccttgggcagattcaagagaaataacaccaatagaatcagaaaataaattttctaagtcagctttacaaaaacgtgatgttttctctaatcaataaacagcaatttaaaatcaccattatttttattcata

SEQ ID NO: 87758 - DNA, 1051 bp, Homo sapiens
tactacattctgtccatgaaaatgagtcaaatgaccaagtgccaaaatgaacctagatagatattctcattctattcttctctctgcatgaatgatataacatttttgcaacaggtgtttgatttggacattctgattatatttaagtgttttgtacacatagatttaggtacatgaatagatattgatactcagagagaggcacagccactatgaggcttgattttctgggaccaaatacatttgtctgcagatatattcaataatgccataaaagtagcgtgcatgctaattgtgagacatacttcactccacttctgggttgatgatgaactgacctctttcaagctggtgatcaagaatggagacagagagtaaacctagtactcattctgtcagagcttataataatgcttcctcagataaatcattaaagtaattctagagaaaatttgaggtatactgaaacccacttaaagggtcaccagtcaggtgcaatataacttgataaaacatttcttgaggataatttggcaatacctatcattattaaattgcctgagagatatacctagcctttgaccattttcagaatttgcccaaaggtggcaattaataatcgcactaagctttagctaatcaaaaagatgcttgttctagctttcatcctttcagtcaatagttatttatttagctcctcttatgtgacaggtacctgcaacaccagcattctctatatcctttctatatttttaactatagcaaatacactgaaaactgtgcactataggaaatgacgttggagagcatatataaggatattgaaaatgttcacatgatatttttcagtgaaaatgcacatcccaaaacatatagatatgagctcatttttgcaaaacaaaagtataactcaagagaaaaaaagactacagttatatcaaaattttactaatggatatctctgagtggtagaatttatgattttttaattttatctatatttaaactataatagcacttttgcacagagaagcaataaaaattgtttggt

SEQ ID NO: 87759 - DNA, 1053 bp, Homo sapiens
ttaacatcaaagaaatcttagttaatgcaatacacaagaaaaggaaataagaggtatacagattggaaaggaagaaatagaactctctttgtttgcagatgatgtgattgtctatatagagaatccaaaagaatcgacaaactcttggaactgataagtgattatagcaagtttacaggatgcaaggttaataaataaaaatcaactgctttcatttataccagcaatgaataagtggaattttaaaccaaaaacacaatactatttacattagtacccccaaaattaactacttaggtatacgtctataataactgtccctgacttacaaaggttcaacttcatgatttttttgactttacaatgggtttatcgaggtattaaatgcatcttctacttaagatactttgtacttacaacagatttatcggggtgaaatgccattgcgtgtcaagaaccatctgtatgtatgagatttatatgatgaaatctacagaattctgatgaaagaatcagagaagaattaaataaatcaaagaacaactaaatgagcgcttacctcatttgtttcccttctctttgggtcacaatcctctgcttcctgttgcctgatatcctaaaacagtttctcctttgttttgtccagttttctcattgtttactgtggcagttacttcatcacagccagggcagcagtcatgaattttactgttttacaaatttgcacatttattttgaagtaaaatacagattattttcaagtttgaatgttttgtaaatatttaaaattaaatacaaatatttgttataaattttctaaatatttttgctggtaggatggtgcggagttttaccaggctggccataactggattcatagtgttacatgaaaggggactccatccagaccccaagagagggttcttggatctcgcgcaagaaagaattcagggttgagtccgcaaagtaaaagcaaatttatcaaggaaatagaagaataaaagaatggttactccatagacagagcagcccctagggttgctggttgcccac

SEQ ID NO: 87760 - DNA, 1109 bp, Homo sapiens
gacggagtcttgctctgttgcccaggctggagtgcagtggctgaattaattatttcttaacattttattttatttctactattagcttattagctatacctcttcactgttggtttttatagttgttgatctaggttttattatatacatcttaattacagtctgtcttcacctactgttgtaccagatcatataaaatgtaagtttcttaacagtatacttccatttccacattcatattctatgtttctgcaagtattataaacctcgcaatttgttattattgctttaaatattcaattgtcttttaaagaaattttaacgtgagaataaaaagtaatttatatttacacactttttttatgtccagtactatttgttcccttggtttcatccaggtttccatttagtatcaggtccatctgcctgaacgacttatttcaaccttttttgtagtgcacatctactggtgacaaattctctccaatttttctttgaatatgtgtgcttttcactttcagtttggaaggatagtttcactggatatgcatttctagattaacagattttttttttaatttcagcactttaaagattcattgtattgttctctgacttttcagatgagaaatcttcattgattcctgtctttttaatgtatctgttttctctggcttcttataagattttatatttatttcttttctttgcaattttattatgttatgccttgatatggttttctctgtatttatctcatcttttgtttgtttgtttgtttgatgatcttttggacttgtggtcttagaggttttttttttcattttggaaaattttcagccattccatctgcaaatatttttccaaacctctttctctttctgggatacaactacacatatgttagatgatgtgatactatctcagagataactgagattattcagtaaacttactccttgtctctctgggaaccatttggatatttaaaatgttatttttagcttaatttccagtttctgccctggcatgtaaggtgcttggaagttgccattcatcctaacaacaagtaaaaagcaggaaaaaaactgatcagcattttttatatt

SEQ ID NO: 87761 - DNA, 1057 bp, Homo sapiens
ctggatcattctccacagtgccagaggattcatcttcccaactggacttctattcattttattccctgctcacagacctcttccccatcccactgcatccaaaatgaaatccagtttcttggcctgtgaccccttgatttgactaaaaccctgaattgttgaccctgaagccccagaattgagtgggagacagacatgagatataaccaacaatgagatgtatgtgggtaaggtagaggatccggtgccagcttacattcccagctccgtatcccagcattggaagcttctttaagctgtcaagaggaaagtgtttctattggtagatattcttgttagccacagatttgtttcagaattggaggggaaagaaaatacaccttattcaggaaattttttgcctagaaaatattttctcttaatttcacctcaaaataaaagggaagtaacactagagaattaaatactacattatcatatacttaaaccttttaaaccaagtggaagggaacaacttttgagtctaatttagggtaaaatatgtgtattatacctttgaccagtcaaggaaattcaaacatttggtttctgcctctttggctagtaaatgagttagttcattttttgtgtattttaatattctgaaggctttcggtcattaataaaaattaagattcactaaagcactccggaacaaattctggttcctaatgcattttcatgtagaattttatttgctcttaattttttagtggattgaaaaccatggtcacatagttcatcagaaaagcacttcaaggatgtcagtagctttggattctaaagcaattaactataacctttctaaacaagagacagtaaaaattctcggatttttccaaattctgttctgcgattatagtactggagatcagtgcttgtgacaaataacaggtattaagcatgtcatcaggctggtttagaatgcaagcaaggtgatgtgcaaatctaaatgaaattgaataatgagtagaacataggagagtagggagatatccctagaacctaggtctactat

SEQ ID NO: 87762 - DNA, 1062 bp, Homo sapiens
atggaagaagatactgattgtgtgctttccatgtgtaaagcactttcacgcaccttatctactttaattctcccaactcactgaatgctttagaattgtaggcgatactgaggctcagaggaattacacaactggctcagagttacacagctacaagttgcagaaccaagattctagtgtgtctttctccaacacctatgtcaggaatgttggcttctcatgctatttccaagcaaatccaaccatctgttggctcagataggtcactatgagcaaaagatagaagcagctcctgtttcacaagatcattggttttatgaaccaattcatgcttgttgccacattcctcatttcccaacgaggctctgattgggttcctaattcctcattgcccacaccttttgttcacaagtccccttccctgtttcttgtttctacgttgatgagtttccttgagtatttggtacttgactgatctttcagctcttattgatcactttggacttgatcttagatccatttgacttaaagaatcctctcagtatgccttttctcgaagaattattggtccttgcccctggagagacaccagaccttttcttggtgtttctgtataggatgacaagaagtgtaatcttcccatcatgccctgctagtcacctggattcagaggaaatgctcactcatgcatacattatcttatttgaaataatgttttattctagattgtttctctctgctttaatttgcactgtagatttttacttctgtatgaatatttttctgctcgataatggctttggaagagcaatgtttgcttttgttttcaatcctagaaaagttcaaaaaaagcttttattctatataaactctaaagtgtatatattttaaacgtgttacttcttttttttaattttgcattggcatctgtagaaatttttgtcagtttaaacaacaatgcttgaaagtcactttgacttttcaagctgccagattgccttatcattgtctttgagagattagggatgcttttttagaaggttgccttttatgtaaataaaa

SEQ ID NO: 87763 - DNA, 1049 bp, Homo sapiens
gagggaggctgtgctctcactggcttcttgttagaagttctgcctgccctacagcctgcactgagggctctcatcactgcttctgagatcttaatgggggtcaacgaagatgtgggcttctctgagtttagaccatccatctgccaaggaaaaccaagccctgagactgatagagatgagagaagagaatggtaatgtccccaagacagagcaggcaggaagtttgaagcctctgagggatacaggaaaatctaacctcaaagagaagaaggtaagaacaagacaacctctgtcctcctgacatagggatcttgctgaaaaaataaatctcattgctgagctgagttaggcattggtaattcatctcaaggagatgaattttgatagggcagggatgatggaacaaactgcaatcacattgaacagaaataagggccatcatctagatatgctggactgcatgccctgggaaatgcagggaggtgtctgacatctgggggcaacaggcagaatctggcagaactttctggaagaggtagattgtgagctaatggcattttctcccttgctcaaaagcttacaaagtgctgtagcccaagaaaaagtgaagttgccacagcttcctagttgtctggccaaagatttgcataatttcatttcccctctgtacctttcattgtttttctttcttatgtatttattttaattaattaattttaagttatgataactatttttttactgtacagttcagtggtgttaagtacatttaaattgttgtgcaaccatcaccacgatccgtctcgagaatttttttttattttgtaaaactaaacctgtgcccactgaacagtaactcccattttctctccctctagcccctggcaagcatcatttacttcctgtatgtatttgatgctctagggcaggggtccccagcccctgggctgcagacccgtacctgtctgtggcctgttaggaaccaggctgcacagcaggaggtgagtggcaggtgagctacttcctgatgatctgaggtggaactgttt

SEQ ID NO: 87764 - DNA, 1006 bp, Homo sapiens
aatagaatgagctgatgggcataaagctgcatagatacattatgggtctagtatagtggaagggttctgtgttgagagtcaggtctggttctaactcatattcataatggaaaaaaaaattctctatgggcctggtttgcctgatccagctttgtgcagattaaataaattaaaaattgaaagtggttgagtaatttaactaaattgaatacattatgagacatggtaaaaaaataaatagaaagtacatgaccactaaaactgcagttggcttaaataaacctcttcattctcataagtaataaagaaaatgctaattaagacatactattttttaatatattgaaaaagtaaattagtttaaatattaccaagcgtaattttaaattaataataccaagatgcctagggtgcagtgcataaacactctaaaatgctattgttgagaatataaattggtacaaccttcctgaaagcctgtggttatctatactgtgaaccttaaaaatatccctatcttttgacctagtaatctattccttagttagcataatatcagtgtcaaaactgaaaaaaaaaaactctctaaaaacatattaatctcacttttgaatattgtaaaaaactaaatattaagcaggagaatctagtagcatatttaaaatattgtacatcataatcacatggattttattccaggagtgcaaagatggtttgatattaggagcactattattaataatataaattactatactgataaatcaaaaaagaaaaattatttgtgattctttatatactagttagagtaagcctaagttgctgtaagagggaaccccataatgcagtggagaaatgaaataagaaagtttatttctgttttgcgtaagaatccagatgtattaggatggcccagggctaggatcaaatggttctctttcatgaggtcacttaggaacctaggctgactagtgagattcctcagtcatcctcaacatactgtctc

SEQ ID NO: 87765 - DNA, 1024 bp, Homo sapiens
agaatgataaaacccttatctttgtggcaaatatctttggcatttgccttttatgatttaattttatgatacacaaacattttatttaaatttcgtctaatctgttcatcttttcctttgtaaattctccactataaatagttgttttcagcttcatgttttgatatttataaatataccaacacatcaaacgttttctacaatgtgctctactcagtaaaaggctcttagcattttgacatagcatttaccagcttgggttcctggtctgtaattttaagtggtgtctgaaggattatactggaattctgccagcctgaaatcatgaaaaggctttgagcaacaattcagcatctttttcaaatttaagaaaagctccatatggcataattattcaaagttaaggtcatagaaactacttaaacctttaaaatttataattaaaggattaatattaacttatgaagacattgtcattttggcttaagatggatttccaacctcacttttgttctttttacttttatcttttccatgactttttcctttgctaaaaaacgtgaagttttatatccttaaactttaaattaaatgttatcctcaggttagaattataaaattgattggccaacaatatcccgtatattttttattatgttccacaaatattggtgaacctaaagttgtcattttcctctggatatataagctatagcctggtgtaatagataatggcacctgtaaatataacaataatttaatttaccaggtaaaaacatacacaaataacttggaaaacttaggatgtgtacataatttgaatgcgatgaattggtgttcatttatatgaaggtttatattaatgtgcttttgaatgacctaaattgtaaagctttcttgactatgacaggggttataatcttgtcttatacaaaaactaacactttttataggataatttttttatttcaactttttagattcgggggtacatgtgcaggtttgttacatgggtatagtgtgt

SEQ ID NO: 87766 - DNA, 2084 bp, Homo sapiens
tcatcatagagatagcactgattaggttggttaaatataaatcgatcaggaatgtagaagtttctggtcggaggaggaggaagctgaactgagttaagaacatgtggagtttgaagtgacactacactttcccttgctgttgaaagaatgcttctggatatcccaagagcaggcaggattggagacaaacagctgtgggaatcacccacagagaaggcctggccagtggccttgagagtgagtgggactgttaaagcaagggggaaagaggcagggagggagggagagagagggcaactgtgaaggaagaacttaggggtacagctccatttgagaggccagggaggaaacagttgaagaagggtcacgaaggtagaaggaacatgagaagaatgcatttttatggaaatagaggaaaagactatttggaaagggggattgtcaagaatgtgacccaaactcaggaaggatgagggttgaagaaaggtcactggatgtgaaaccacaaagtcattgatgatcttggacagtgcgctgaaaatgattgtgtgcccagaaacagggtttcaaaagataagtctggaagtggaagtgagggaacatcctgttgtttgggaaaatacgatgttaaaagaaagatgtagttccaaagagcagcaggagttaaagagaatatattttggggctgaacatgggttgagcattttgaagtacacaaagggactaatggagaggaacagcttaatgacgtgaagaatcagagatcattgatggcttgtgatctgtgaggtggtgcaggtgggaatggcatccccagcacagacgcagcacaggcctacctcagccctcggctacaaggctgcaagggtccattggtcttttcccagaatgtgccacactctcccctgcctccaggtctttgcagctgctgtcaccctcttccagaatgcttctccacatgattttttcaatggccaacctccttgacatcattctacactcctcagagcatccttccccgaccttttcatccaaagtctggcctacctatgccacctttttttgtcccattgtcttcatagctcatagcattacctgaaatcatccttttatttgttcgcttgtttcctcccacccactagaacataagctctgttagcaggaccttgtctagcttgtttacttctgtaccaccagtgcctagaaaacccagctcggggcaggtgccctccgggtatgacatgaatgagtgacaggaggcatgaccttcaccaatggaggaaggaagtcaagcattggtaaagatatagagaagctctctgacaagacttgaaaagaccttgtagctaatagcatctgtattcttagtaaagaatcagagtagtctgcttaggtgaggagtttcaaaaaaagcgaaacaggcttccagctgaacagtggaatgccttggaaaggaagaagatataagggaatttgttcctatagaattggagttctgcaggtagaggagggagcatgggtatcctgcatctggaagaatggaatgctcctggattgaagtgagaacacaagggatcccagaatttagaagggaggtttgaggacagttcttttagctgacatgggtagaggtactgagatgaaccagaatggagggacttgttgacaaaaagggagagtctggggaaagggaagactctcttttacataggctggtgttgagtgcgatgagttcggtttttgtccagttggtggaattcaccaacctcagagtccatatgatgatatctaaatgctgtgctcacatcgagtaatttgtatttccaatgattgatatttttacataaatagtcaaaggagtttagcattttcaaatgcagtaaagacctggactccgaattccctgaaagcaggaaatatttgtttctaatgccccaggagcttgcatggtgccttacacacagtaagcactcattaaatattaagtgagtgaataaaagaatgataatcgaggcgggcgaatcacaaggtcaggagatcgagaccatcctggctaacacggtgaaaccccgtctctactaaaa

SEQ ID NO: 87767 - DNA, 1067 bp, Homo sapiens
ggggaagggaaggagggagggagggaaggaaagggaaggaaagggaagggaagggaagggaagggaggaggggaagggaaggagggagggagggaaggaaagggaacggaaggaaggaaggaagggagagggaaagagggagggaaggaaggaagggagagggaaagagggagggaaggaaggaaagaaggaaggatggagtgcaatctaagctttctattccatatgttcatatttcatttattggccttttgcccattggttcttcttttgtgacttccctattgatatcttctgcccatttttccatttttaaaaacaaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggtaagatatttaactagttttttaataggcagttgaaatccatgtttaaaatccattgccaccacccttatatttaatctccaaaaggtagtagacatggcattactctttaaatgtataaactcttcagtcgaggaatttaagtatcttgctcctatgtctaagtaccagtaaaataatctagggaatttcctaacttttcccttggctttcatggaagggattatatggaatatcctattccatagtaattaaatacacgttgtaataaagtgatattataatattgtccaatattattttgattagaaatactggggctgtatccctaaattttcctaaatgggactaagtttcagatcttccctcagttgtctaataagcatttctagattttacagctttttataacagtgtcacataaatgatgacttattttcccaggttgatatttcagtcgagataagaaaagtctttttagaagtatatattattggaataaatgtcaatata

SEQ ID NO: 87768 - DNA, 1109 bp, Homo sapiens
attgtaatgttattagcaaacagactattaaagaacaaaagctggcaacatatagtaattccgaattgggccagtcccacaaaattagcataaatatgtcaatcaatcagaatagttttggacttcctaggaaagtgtccctattcttatctagctctaaaagaatgtgaaataaactattcatttaaccaagtataaaaatatgcctgctatgccgttataatcatgtgtcattaatcagaaaatactgcagaaactctgacaaattaaaaacacaaggatgtgtctgcaagggtttttttagccattaaaaagctgcttcacctctctggcaagctcttttatggcaacttcttactcagtgtactgacatcttcaaaggctctgacatctgtcagcctttgaactaccattaaaaaatattatcccatttccattcttttatgcccatttttttaattatagcccctctttcaagttaggaacatggttggtttaaatgatgctgtcctttcgttttcagccacccagctgcggtttgaataaattgatgtggaaccaaaggcgggactttaaagggaaaaggtttgatggacttggactccgaaccagatgaggttttatgatgaaaagggtttaatcccagcacaggcattgcttctatcagttgagcagtacaaagcaattcatatatataggttcacgtgaaatgatctattttttttaacagcacagatctcttcaggacttgcaaatgtggcattagctaatattcagagagctgatttcctttcatccaccagaagcttatgattatagtacagttctcgaattggaaatgagagctgcaacacagatttaaagctgtgctgtctgatttgtattcaatatacctgtcactgcaggacaggctagtctgggccaagctggttcaatacaaggaaaaacagtttcatcatctgagagtcttagtcagaaatatcaccagctaattaaaacagcagtctcatgactattagtgaggtgtttggttgattggtgtctcttcaaatttgacaagaaagatttgaagatgcagcttctcttttattacatattcttcttgcagt

SEQ ID NO: 87769 - DNA, 1032 bp, Homo sapiens
acgcagagaaggatagcctagtccgagaccatgaacgggaaattgaaaacctggaaaaacagcttcgcgctgccaatatggagcacgaaaatcaaattcaggagttcaagaaacgagatgcacaggtaattatcaataatatttgataaaacgggtatctgtttttaaaaagtcatcagcgtttaatgttttcttattattcttattgatgcacgctgtttgatcatttgcaaaactgacatataaatgtgattttttttttgtttttctcccccccacccccccccccccccgttttgggatgaataaagccttaactacagaaaccacaggtagccagattaaaaatcccatggcgcgctataacttggcccccttttttatgatcttgtctcagttcctttcatgatggatttttttaaggtatctgccccttacccctcccttcagccttagcaaatccctatgaaatatatcagcctcactccttgctttttgttttaatctctgtaggtaatcaagcagctgttttaatatttgcttttccttcctagtgttgctgttttcattagactatatttgattagatcactcagatggtaattgataaaaatgactccagagaagggctatttcccatcaggtctgttgctttttcctgcacacacacatgcctcctagcccacatctctgtagtccctgttggaagccatttggcagaataacccccagctgtggtagcatttgactcctcaaacttgtggatgaaatgtgcactgtcagcatggaaaattatctttataaatttcagatgaaaaaagaaatcttattggatgtgtatctttgtgatacaatacattctgtagagtatatataatcaagggcctttagtgtatcctcttgagattgctgtgaaattgcattaaagaaaaatttaagagcaattgataacaataaaaagataatgttcttttctaataaaaacatattgtatactaggtctaaataccccttttcccattgaaatctaac

SEQ ID NO: 87770 - DNA, 1052 bp, Homo sapiens
agtctggtgattcattgcacgaaacaagatcgatttggagcaggctcctactgttagcttttttgaagatggattctcacgccgaaaataacacaacatattctagataacagcagtttttccccctgaaatccaccaaaactgaagaaaaatccaagtgactgttcttagcagctgtgtggcctggagttcactggggaagctggcttcctgccgtcccctattcatcacctgcttcaaagacagcctggctggctatagtttgcaggccaggtagggtgccattgtgcacagtctgggaggattagtatcaaagctgcggcaaccaggccttggtctcgggctgccattcagtctagcggggagaggctaagactggccaaggtcacagtctccagtgtggagtggactgggaaaggatcctgagaatagaatgctctttatgaaatcatggcgcaagcttgcagcacagcaggtgcccttctggaacacataacatctgtttatgttggtataccgtagctgacaacgagataatagagctttgaaatttatcattttattttttaaaagacaactgtatatacaagaatccagatgcatatttagctccgatcttttatttgtaaatcatgaagaaagctgaccgatttaattgctgctttttacatgtgtatatttaagcaaaaagcaaagcgtactattaaccatttataaccattgctgatcagtaatacccgaattcttggggaggaagtgactagcattcgagataatttttttcaatgttcagacatttgtgtcaacagattgaagaaggatttactgaatatgcccaactattttgaatattaggaggtttgcataaccaccaccccaacaaatgagagtatttcgagggtgaggtaataatgatgtaaaaataaaaattttcaacttggacaaattagagaaaaattaagctgtacatgagttgtcatgacgacaaggatgttctgttgatgaactgtcctcctcattgtccaatcagatagtagagctgaagctggagc

SEQ ID NO: 87771 - DNA, 1022 bp, Homo sapiens
gcacatacccagtattgttatctgtctcatagctcaatgcttttggattatggaacttgaagccttccctcttttattacagggaactccttagccagccttaattaagcagggtccttgatcatggtgcatccagttctcccttgtagcatgtattatgggtccagatgccccacaccccttaacttagaaggcttattaaccatttaatattcattttgtgggttctgtctgcttttatgtcctctacaatgtccataatttaccacctcctggtcatcattaactccgttagacattattgttggtcaaccgaagtatctactagtccaacatgaagaagatgtgctactttgtgtttacctttgagatgtgtccacaagtaaaggacaaatggaaagtccagatgattcttttaacatttatttacatggatggggctaggcaccagtaaaactttttatttacatatctaccttgatgacattctttgtagttatgaataccatcgtcaagatattcccccaacattagggtttctcctctggaccctaccatttatctggagaagacacccttgctagaagatgctgatggtgcggaagcctaggaaaagaccagaaagggctcatgacatccagaagttagccatgtagtgttggacttagcagacaagcctgagctattgcattttaaattgaaaattatcctccttattctctgttcaagcaggagaggtaaaagtgaatgatatttaaaaggctttggcaaccttgagatttgttcattaagtagaatcatgagcaataggccctggcaaaatatcaaactaacaatcatttatgactatttatgtttatgcttgaaatgtgataaccgctatttcctttttttcctgatttttaaaaatgaataaagtgaaatttgaacatgggcatgatcattgatgagtctataagaaacttcaaatgtctctgtttagaaagttactgtgaaagtacattactactagagtacagaac

SEQ ID NO: 87772 - DNA, 1068 bp, Homo sapiens
agcactgagccacctccatggtggtttcctctgtattccggggccgacagtaggagatgctgctatggaactgagctgcctcctttcaacaggaaagttgggttccagaatggcaggcactacatggggcacttggatagatggaaggtagacacgattactctactggatagtaaggctagacaggcccttcaggtgtcttaccctgcagggatctgtggtgataatgagctgtgttctgagagataagatagagagccagtgggaatactacttggcttgtacaacatcaagaaaatgtccaagactgatgagtgaaactgaaacagttttccacttagggtggaaaatcatagtcctctaccaagtttcccgatctgagttggttcgcagacccagaacccgtttgttttaagagagaccacatcccttgtttaagagtcttgtactgccaccagaagtaaatattccccccgaagggagctactggcatttgacatggtcctgcacacaaagaagaaaacaaaaattttacccaaatcttaccttccggaaacgactgctgttaatcttaggtgagcattattccagaaatttctatgagagattgataaatagaaggataagtagatatatagacaaaaacaattttctagaaacaggaccatgctacatttgccacttttaattaaaatattaaattatatgtgaaattatttgaagaaacaagggaaacggaaagatttctctcattttttcttttttatttattttttatagagatagggtcttgatacattgcctaggctgatcttgaactcctgggctcaagtgatcatctcacctcggcctcccaaagtgttgagataacaggggtgagccactgtgcccagtggaaatggaaagatttctaaaatttagaaaaacatttttttaaccacataagagattatttttagaatgttagaaattaaaaatacattgaagttagagtaatttttaaattttgtggttcaattttgagggcattagttaactccttattagagaaaaattaaactgcccata

SEQ ID NO: 87773 - DNA, 1066 bp, Homo sapiens
cacttttgcttaccatttcatccttaagagatttttttgaccccaaataattttaattttaattttttatatttttaattgacaaatcataattgtatatatttatgagatacaatgtgatgttttgatacatatatcaaaatgcacacatgcacacaatgtagatgattaaaacaagctaattaacatagccataacctcatttactggttttttgtggtgactatttgaaatatactctcttaccaattttgaaatatatattattaactatagtcgctatgctctgcagttgatcactagaaagtattcttcttgtctaagtgaaactttgtaccctttgaacagtatctcccaattcccttttcctactctcgcccagcctttcctaactaccattgtactctctacttctgagttcaacttttttagattctacctgtaagtgagatcatgccattttgtctttctgtgcttggcttatttaacttaacacaatgtcctccaggtttatccatgttatcacaaatgacagaatttccttatttttaaaggctgaatagtattccaagatatatacatgccacattttctttatccctttatccttcaatggatacataggttgattccatatcttgtctattgtgaataatgctgcaatgaacatgggagtgtatatatctctttgaaattttgatttcaattcctttgatttatgctgagtagtgggactgctggatgaaaaaatggtagttctatttttagttttttgaggaaattctatacattttctgtagtggttatactaatttacatcctcaccagcagtgtacaagggttcccttttctccacatcctcagcagcacttgttcactttcatctttttgataaaaactgttctaacagttgtgaagtgatatctcattgtagtttgaactggcatttccctaattagtgatgttgagcattttgttccatcagcttgtggggcatttttatgtcttattttgagaaatatctggttaggtcctttgcctgttttttaatcagtttatttttctt

SEQ ID NO: 87774 - DNA, 1053 bp, Homo sapiens
gcgggcgtgcggtctttggttcactgtcctcatttttgttagttggcccctgtaggcatttgaatttggactcctgctccacagttacagctacagtcatttatttttaaattgaggtaaaatttacataacataaaattgacattttagagtaagcaattcagtgacatttagtacattcacgttgttgtgcaatgactacctctatttagttccagatcactttcatcatcacaaataaaatcctatacttattaggcagtggattcccattccccgccttctgtcagatcctcctaaccaccattctgctttctgtctctagggatttatctttcctggatatgtcatagaaatggaatcatacaatatgtgaccttttgtgtccggagctactttcacttagtgtaatgttttctaggttcatctacagtgcagcaaatattgtcacttcattccttttgatggctgaattatattccattgtgtgtatataccatagttagtttacctactcaactattgatggccatttgggttgttgctaccttttggctattgtgaatagtgctgctatgaatatttatgtataattactcgcttgagtacctattttcaattatttgtgtatatacccaggagtggaattgctgggacagcttactgtttgtatacttggctttcagtattggtctccaaaataatactctggcagttggcacacacatttcccttttaccctaattggaactgcagctatcgcccacaaaaggagaaaagccattgaaaattatttaaagggtttccaggcacttgataaaaatatgtttttctagtgggctagtctgttcaagaattcaaaccatcagttgaaatgttgtctgataatcatagaattataactaagagaattgtgtgttcttaaatggtgtttctatctagttaggataagcagttaagttgggcaagttgcccttctctacttcggggatattttgcctgtatgtcttatgccagctatcataaagcacatttttctctgctaatcagtac

SEQ ID NO: 87775 - DNA, 1017 bp, Homo sapiens
tgttgtcatgaacggttctttgatttttcacaccattgaatatatgctttattaatatagtagaccatagacaacttcttctgaagcttttatcccttaaaaaattattcctggcaccatttgttcatggagtgtatagtaaaaccttagccatcacttttagactgacaagtggtcctcctctacctctcctgtcatccaccactagttagatgtaaaagtgatactacttctattcttgtgactccaggccaaaatattgtttctggtttcattaatgttcttcttttaaactcttgccttcttgtattttgttaatttatagggtgttttctttgtaccaatccttccaccagttctttgcttcctcttacaattattgcatcttcctccattttgaagtctaattcagggccctcttggtatctcttaactacattggtcctttcaacacttagacatgagtaagtatccatcttaaaacttttttcttaatctcactccaaccccttcaactgcggcttctctctctttctttgcttttatattcaggtttctttaaggagttattttactcattgcctcagatttctcatcatctaccttcaagccaatgcagtttgggttattccctgatgttaccaaaacttctcctcctagggataccagtgacctccaatctggattttgttcagtctttcttcctcaggacattttcttcttcattttctgtggcacacattcttttggttttcgtcatccctcttggtcttttttgcatgttcatcctactcttgtcttactctagattatttcatgagacaatccagttcgaaagtatagcttcagtaactatcattctgtgccatccttacagcaatgctatacaaatgtgtatcttggccttgggctatttgcttaattttctttatggcacttattaatatatgatattttaatatttttatgtatgttccaattttaaaattctactttaaaatttgtgttaggcagagt

SEQ ID NO: 87776 - DNA, 1047 bp, Homo sapiens
aaaagtctttgccaaaatactgaattttgcttggagttaaaagaagatattttagcatgttaaataaaattcttctgtagattatttatccatcttccatatagttaataccttcattttggctaaatgtctggatgatcttaacagtacagtacccagcatagtagtaataatgtagtctgaaagtaaaagagtaaattattgtgaggtctaacttcaaagtaaacagcacaagttggctgttttcccaaaggagaatattgtgactgctgctgcttttgaatctaagaatagcgttagatctggttggcccagagacagttccattttgctgcaagacagctttgtgatgtagaaatttgccttgactattaacaaaattttttctttaaaaatatgcaaagaaggaaaatctcagttttagaatgtagtgttatttatccatgtagttattatttctttcattcattgaataagggtttatttcttctgtgcatgttgaatatatagtagagaggctatcagagaaaactgggatatataaatatgaatttatatacatataaaaacatgatacatgctgtataaagcaaaatactttaaaaacataataaggtaataatcagtaagatggactggtaatgggaggcatcttagagaaggaaaagtctttaactgagttgtgaaggaaaagtggagaataaattatcctgggattttggtcccatcttctcctgtctctgtagagatgctggtctctactagttttgtctctttcttttctatttccaagctgtctttcttcaccttgttacatgaccagatatactccttccatagaatacctttccttttctcctaatgacttctaagtgtcaagttctttgattctctcagattatagaattttgcgaccatgtagggatagtcttgtgaattgggatgatatataatgtgtttgagatgttaatggaaaagttgagtggctttattctgacacagtaattgtatcaaagacaaaggctgggaatttttctatgagaggat

SEQ ID NO: 87777 - DNA, 1102 bp, Homo sapiens
tttcatagagtaactatatgcgttattattgttttgaaatcttggttctgctttcattttataattaaaattttgaagttttctgtaaagctattatttttatgtcagtgttacatttccataacattaaatattatgtagcatttaatttctatttttactttaaaagattatatttttatgtcagcattacattttcataatatttaatactatgctgcatttaatttatatttttactttaaaagattattttttctagtatcttttaaaaacatttttcattcaaatttctagataattttaattctgattggactttcaggggtacaaaaggcatattttttcaatcagaaagtataatatggtacaaaaatcaatattctgctttttattcttcttaaaatccttgtaggcatctagtatgattgaagaattagagcagaatgtctgtcaattaaaacagcagttacaggaatcagaacttcaaagaaagcaacaactaagggtgagtcttgtatttctacacagaagaacaatggtcaaacacagttttcttgattcagatgtatcattgagagtcaattaaaaaaataaaactcagaaatgcaggtcatcttttctgattcttttatcgcattgtataattttacattttatttatcttaatagagattgatgctttgagatgtagagaataaagtacaataatttgaattggaatgatctcttttgagattagttttaaaaataaattttatttaaatatatcattattttagaataatttccttcttttaaattacctgccaatcttcataatttctctctttctttccctctttctttctctgcctctctctctccctctgtctctctcttttgcaccttttagatctcttttctctcgtgatcaaaaaataccaaggactgttacatgatgtaacttcaaatttatcatttccatatttattgacttggtcatttttgaagtaatctcttaatcctaagggtcagaaagattttcttatactgtaaagcaagtgcttttgagaatagtaatatcttcaggtgactaagattttatgcctcgtaatacaaa

SEQ ID NO: 87778 - DNA, 1060 bp, Homo sapiens
cgtctcagaaaaaaaaaaaaaaaagattttaaaatattaagatagttgacttggggctagattaagtatgaccttgaattttagatttagaagcttgaactttgtcctgtagatgctggatgtaaagagccagggaaggattttgagatgtgagttttaggacctcatgttttgggaggagtagcctggtaatggagggtgtattgaacagagtaggccaattccaagtctgttaggcagaggcagaatggagtgaaggagagagaattctacttattagaaaacataggctgtaattccagctctgttaccagtgtccgatgtatgatagcaagttgtctctgggtcttggtttactcattataaaatggtgagatcagaataaataatatataaagtccctgccaactcagagatgttctgcttctgtgctgctgtaattttgcatgttaaggtgagaaggatttctgaatgatggcgctgggagtagttagaatggaaccgaagaaaagaagaagtttttaagagtgaatcatgatttagtgaatgagaagatctaggcaatgaataagagaaaaggagaagggaaggttttcatttaggattttctgtatggaacttactggctctcccccagatcaaacctgagtatatctgagtgaatgataatggctttgacaaattaggacagccattacatagataagttaaccaattaaataaatatttgtaggttcatttccacccttaaatgttggtaaaagcaattataaattcgtttaggttttttctccaaatattaccagtgtctagaaaaatattttaaatttatttccaggtcttcttctttaccctgattcaaaataggtaattcaaacatgcctaaggtttaaaaatgatgaggttttaaaaataatgtttctaaaggcattttgaattgcaatcagatcttagtttaattttggaagtgtaaagtaaaatatattgtagatggtaaagacccacattaggttaacttggattcatctcctctccttatttgttgtgtagttgagatata

SEQ ID NO: 87779 - DNA, 1106 bp, Homo sapiens
cttttttatctccctttatcatgaacaaccttccttcaaaggtgcttctctctacctcagaagtgattccttcctagaactgcctttctggttcttcatagtttccaagccccttgttttgtgcccatctctggcactctgagccattaagtttttttgtgtggcccacttaaggtaggccacttttctttgacaggtcagtatttgatgatatttagttccaccactactaggaccctgaggtacttccttttttccccatgctaccactctggctcaggatctaattctgctgatttggtatctttatttggccacctacatgttaatccagggatttgtattccctttctcctttttatgatgtagtcatggatgatgggcatttttatttggtctctttatcaatctgtatgtgtctttggaggatggggagagacatttaaattcatacagttgccattactttataggatctggcgtccacacgaaagaaaattgttttgtgtatttcctttaacctagatgctaaaataattatactttatatcctgtctattgctatattccttttaagttttacttgattggattctattataaatgttatgacttctacattttttgattaattgattcttcattcaccgttatctttattgtcaaattgggtatggattgttcattttcaagagttattaaccgtaataaatcgtttggggaactttttgaaaacacaatgggattttggagaactagaatccaataatttatatttgaaatgtttatcacttgatcctcatagtacactccaggatgttaaaagaaaaaccttaaagaaattaaattgaacagagtttagtaggcaaagaatgattcatggatcaggcagcccctgaatcataataggttcagagaggctgcagcactactggatgattgaagatttatggacagaagaaggatagtgatgtacacaaaatggaagcgaggtacagaaacagcaggattggttacagctctgcgtttgccttatttgaatctggtttgaacgattgattgcctttaattgccaaaactcagtgagtggcacaagagtaagctgt

SEQ ID NO: 87780 - DNA, 1018 bp, Homo sapiens
ccacagtactaaaattgctgagaaacaaagagaaatcttttttttttttttgagacgaagtgtcgctcatgttgcccaggctagagtgcaatggcacgatctcagcttaccgcaacttctgcctcccaggttcaagcgattctcctgcctcagcctcccaagtagctgggattacaggcatgtgccaccacgcctaactttttgtatttttagtagagacggggtttctccatgttggtcagactggtctcgaactcccaacctcaggcgatccgcccgcctcggcctcccaaagtgctgggattacaggcatgagccactgcacccggccaacaaagagaaaatcttgaaagcaccaagagagaaaagaaagttctaaattatgaatctaaacccccatctaaagaaactggcgaaagaacaagttaaacccaaagtaagcagatgaaggaaataataaagattaaagtagaaatcaatgaaattgaacacaagcaataatgaaaatcagtgaaaccaaaagctggatttttaagtgatgaatggaatcaatgaacttttagccagactgacaaagaatgaaaagaatagatttgctaatatcaagaatgaaagagaagatatcattacagacactatagatactcaaagtataataagagattactgcaagcaactctatgggcatacatttgacaatgtagatgaaagggaaaaagtccttgagcaacacaaactaccaaaaattcacttaagatgaaatagataacctgcatagtcctatagctattaaataaatataatttatattttaaaacctcccaacaggctgggcgcagtggctcacacctataatcctagcactttgggaggccaaggtgggctgatgacctgaggccaggagttcgagaccagcctggccaacatggtaaaacctcgtctctactaaaaatacaaaaattagctgggtgtggtggcatgtgcctgtagtcctagctacatgggaggccgaagcagg

SEQ ID NO: 87781 - DNA, 1043 bp, Homo sapiens
cctcttcttcatgggtctttattgtaattttacttaaggttacagagaagggaaatgtgttcattaatggggtactttgtggtatgattagttgggacaattctcattaagtaagcatctaatttcagctgtcttatctagttttattttaggcaatttcatgctttttttttcatgtaggttagaaacctgcccattttcttattttttcttttttttagagacagggtcttgctctgtcaccaaggctaaagtgcagtggcatgatcatagtgctcactgcagccttgaactcatgggttcaagtgatcgtcttgcctcagcctcttgagtagctggtggtgcacaccaccatgcctgactcctgtccatttcatactacgcaatggtctgggagagaaactgagctgaaaattctgatattttaggcttctcatttggctgtagttttccacaaatgagtgaaagtgtcagattttgagactaggacaaagttacccaaatgaagaagagttatgagagtggtttacataaaaaattaatactttgataagacaaattctctttgtctttctctagagtttaaaaatatctggaagtatctactcaaaatggtagctgataattccacatggtaaaatatcagcacttattttcttaacattttaagtgtttttttaaatagtaaatatttattattcataaaaaacaaacaaagccgtaacagtatttatagcattttccccaaagcttgcttttggggagtgtaactatattcagagttttatttgagaagttgacatttatttcttttaaaagtgaatgtaaacttctggccatgagtaaatctattacagccaggttctcccacaaccaagaattctggacaaaatacaaaaagcaaaccaactggggactctgaaaagtcaataataacaggccgattgagagggaagttggaatatgaagaatcactgatatagtggcaggaagtttcctggttttctgtttgtgttttttttcttccttaactcccagctttg

SEQ ID NO: 87782 - DNA, 1050 bp, Homo sapiens
gttaatttttgtgctctggactacggatacattttttatattactgatgttactgtcaacaccttcattctgatgccttagatgttgtagaatttgaattttctagcttttgttaaaaaatcaaatttttcccaaatatattctttattttcccagaaatcaaattcccaaatgtattctttattttcccaggagtatgttagtattttttctaggaatacataattcaaatagagatttatttattaaaaactagcaatgatatttttctcttgtattttttcttaatatttaaacttttcaacatttagtttttatgacgctttcttgctttctcaatatattttttacctatttcgtgtctgactctctaagtcacaagctgaatgtttgtgctgtgggtattcgctatttgtaagttcatttgagtgcttgcatggatggaggctttggaacattctccctttagtgactcgtggatcattgtgaaacactctatgtgtacccatttgaaaaaaaactttaaaaattatgtcttatttggtttttcaagttttagattctatttattttgcgattaatgtaatatcttaagatctatgtcaggaatattggaagtttttgatgttgactaggaattatttgtagcttcctttgtaaagtgctacagttttaaggtagtaggaaaaagtcataagtatgttcattctggtttctagaatgtgcttgtgaattttctttgataagtgaggcatataatattaacattcaatgaaaatcacaatcatgaaacaagttaagcatcctgtctctctttgaatttaaatccctttatctaccttataggtatagaaatggatgggaaaaattagcttgctgacacaattgaaatcttccattgaatgaagcttttaaatttagcactaaaaatcatggtcattattgactgatggtttaaaagaaaaatggccatacatagaaagaccaacttttatcctaagaaaattatgttatccttactcttgtgtggtaattgaattgataatattt

SEQ ID NO: 87783 - DNA, 1027 bp, Homo sapiens
atgaaagttctattggatatgagtagaaatgcagacaaggtcttgattatcttttaggtctttttttttcttatactttttctttctgtcttttttttttttttttttttgagacagaatcttgctgtgtcgcacaggctggagtgcagtggtgctattgtggctcactgcaacctctgcctcctgggttcaagcaatcctcctgcctcagcctcccaagtagctgggattacaggtgcgtgccaccatgcctggctaatttttgtatttttagtagagacgggggtttcaccatgttggtcaggctggtctcgaactcccgaccctcaggtgatctgcccaccttggcctcccagagtgctgggattacaagtgtgggccaccgcgcctggccgttttaggtctttatagtggactccatgttagtatgattgctgggaggagggaaaggtaaaaaggaaaaacttttgagagagtaaaatgtgctaagtgactgattgaaaggctgaactgaagggcacctaaaggcttggttctgagaaacggaaatgttggccttttgtcagttaattgactgtcagatgagggcggatccattttaaaggttttaatttaaatagtggagtttgaaaactggtaaggttaaatgggatagttcaaggcctagagcttcctgagagtcaagagctggaggtatatgttggagtcacactgtttgaggaggcagctgcgcccggagactagaacagctctaatctttggagagctcagagagtcaggaggtctgggtggagagcagagtaagggaggatgtctggttcatggaatgggcacagttagaaggttgggaaatggataggaaattaaagtaatgtgggcctcctattaattttgggagttttctagagaaggagagaagtagaattgatgagaggaggataataaatcaaaagaaaaacattttcatgttttaaggtgcaggggaagttgccattggaggcaagtcctgttaccagtgtgggagaag

SEQ ID NO: 87784 - DNA, 1112 bp, Homo sapiens
acaatacactttaaagctactgtggtataccacaattaaaactttttgtaaaagaacttaaagagaagagcctggattaatttttaatttttttttttttgaaatttagttgctgtgtgaatatattgttaaggcagctcatagccctcagcagtcattacttagaactgagaaccctagttcagttgtaacctaatcctttcctctgagggcaatacagcattaccagacaagcacacaaaactctcattgcgctgaatgacatgtattttgttctttttttctccctcccgtcccacttctttctcttctttttctccctcccttccccctctttcccttcttttcatcccttcctttcttccttttttccttttttacttccttcctctttatttccctttatctcttctatcttttcctcttttatctcttccatcttttccttttatttcttccatctttccttcctctcctcttcctttttcccttttgtatttcaggaagtttattcgaaaaaatctcctgtttctttggatgatagtgacattgaagctcgccttaatagttggaatcttggggtaaaaaaaagtatttgctttatgtatatatagatgtgtcaaaatcatattgtatgtgtataatatctgaactaatttgattttattcagtgaacgttggatgttagacatatgttactgtgtggccttgagaagggcttaagtataggaaataaataacattctgaacaaacataaaatagtccctgtccccaacaagctaactttgttatgtgtgaaataagagatatgcacataaaatagttaaataataataaataataattaaagatagtatatggtagaataccaagatgagttatgtgagtcgcccgaggtggaggggagggaagggagaacttgaagcaacacagccatttgggttaaaaacactcaaggggaccccatggatgagcagctcttacggaaaacagtttatagaggctgagggtcatgaaagtatttggagaggtagagaggtgggaattggaggcagaaataggcacgaagaaagatgtagtggggtaagtgagctgtcgtgattgggtgttt

SEQ ID NO: 87785 - DNA, 1104 bp, Homo sapiens
tctttctctaactttagtaatatgtaaattggcctgcttgatagtgtctcataagtttcttatgttttcttcagtcttttaaaaacatttttgctcttgtggaatgtataatttcaaatgtcctgtctttgagtttactgattctttcttgtacttgatcaaggctgctgttgagcccctttagttaagtttttagttcagttattgtattcttcagccctcaaatttttctttttaaaaatattttgtttgttaaaatactcattttgtttatgcataatttatcctaagcttattgaatattttgattatggttgtttttaattcttaccagctaatccatttaccttcatttctttagggttggtttctggagatttattttgttcctttctttgggccatttttcattttccttgaccctttgtgttaatgtctgcatatttgaaaaacagccgcttctcccagtctttatggattggctttgtacaggggcagaccttcaagaatcggcctgagtagagattctggggtcctcataaactttttctgtggatatgtcttctctggacttctgtgtgtaaatttctaaatagtgggattttctggtttctgtttttaggagatcataatctcttgttccttcttattctgtgtcttgtaccatgggccttctggagctagtagcacactggctcaatccttttttggttattacttgcttttttagtttcagctgcccctaggcacttagtttatgctgcgtcccaccagtgcttcaagacagatgagacagaaacaagttccttgggcagtcccccaagagtctgaatgttggatatatgctttagttttctctttccctccccagggagaagctgtggaccatgagtttttctaattgtgctgagccaggggtaggagctctggccgtgagtgtttactagtccaaaccaccacctttgttctcagtggtccccaggcatttagagaataccagtcctgtgagtacttgcagaatccggtcccttaggcagccccttccaaaagccagaatgttggacagatgcttcagctttttcgttccccagggagaagttggga

SEQ ID NO: 87786 - DNA, 1751 bp, Homo sapiens
caaaagtaataggttgtattcttgctttacaattctgtgaaaaatgttttgaagcttcttgttaatggcttgtagtaattttatgtcttttcagtgaagtatacgtggtctggtagcttatcaccaaagtgcagtgaggttctgggatagggaaagatgtaaaaaaatgatttaatagcacttattatttttactgaaaactttgattaaaagttagggtagggtgaagaggagtaatgttaaataaaccctgacctttaaacactgctttacaatggaagaaacacgttgcttctgcttatttgagaggaatttattgatgaaaaagaaggcatttaattaggtgccattttattaggagcctacaccagattgcttaggatttctaggagagtgcaaataattattattaactacctactatttttaccatatcagatttaggctaattttatataaattatatttatcttttaactcatgttgggtcatctaaataatacatgtgttcatacctgtaagaaagaacttggagaataattatcctattttaaataattatagaggactatagtttttacatctttgctttaatgagattttgccatgggttatttgatgctagattttagtttggaatgaagattctaattatggtcctgcccttatggaaaatgtgacttgctttataatgatcctctttatgatatggttttccaggaatgcattgtggcaaaaagctgggattctgtatgtcttaccccaatatagctagcatttcatttgtgtgtgcagtttaataacatggccagcagatggtgatcaagtataatgaaaacccacttgtggttgaagaagttaatctatgtgagcaaacatttttcactttaaaaatattgatttaattttttagtctgggcatgcaaaagaatctttttactttgttaaactccacttttatatgtaaatgatactatataacattataaattgctcctcctgaaattgttggataatttagcaaggagccaatcaatacctttccttcttagtaaaaccttcttaaatattacctgccaaaagtacattcattttatttgtgaataaccctgatgtttgggcagatatgtgttctacagcagtactgttcaatagaactttctgatggtaatgttctataggcggcactgtccaatacagtcgccaccagtaaacgtgactattgaacacttgaaatgtggctggtgtgattgaaaaactgaatttctaattttaattaacttaaatagccacatgtgattaggggctactgtgttgggcagaacagtaccagatccgaatcttctgcttggccattgcaaaacctgactgaccagatggagagctggtggcctgttctctgtctcggtggggatgtggggtaggaatggggactagggcttgggtgctggtgcatagaaactggctctgccacatgggagacctttcttctgtgcttacttgcatttcacgggcagctcccttttttggtgatgatcacccatgatcaacatctagttgctcttggtcaatttctgctgtcagaggagctcctactaacaaaaaagaaactgtttataaataaatatacacacacacacacacacacacacacacacacacatatatgtgtgtatatatatatatattttttttgagatggagtttcactttgttgcccaggctggagtgcaatggcacgatctcggctc

SEQ ID NO: 87787 - DNA, 1002 bp, Homo sapiens
tttggttatttctaggttgagctgaaagaaagcagtttgcctttgttcacattccacttctgacacttggcaaccatctgtcctcaggcaagttacttaatttctctaaaccccagtttcatcactcgtaaatggagatagtggtagtactaacttcggggttagtactaccactatctccatttgcaaatggagttgtaaggacaaagtgaaataagacgtgtagagcccttgacagagggcctgttaagtgttagctgcggctaccaccatcatcactggtatggtgatcattattgtaatagttcatcagggccttgcttgttagattgtttgaccatgcttttgcttccctaattactaatcctcccaaagggtattatcttaaagtctgttggtcattaattattttcagttactaaaagtcattttgtattccctgagaaaaataaattatgactctgcagaaaggttatgattgtaagtatgaatcctgcacaatatcaaaataaagaatggtaattctattttaaaagaggctttataggaatctttaaacaatgtaataggcctctttttcaaggatagaaggaacacacagtggctggcctcattgtttacattttttcacgccatatatttgaagctgcctaagtaactgtgtgtttttttttttttttttttgagatggagtcttgctctgtcacccaggctggagtgcagtggcacgatctcggctcactgcaacctctgcctcccgggttcaagcgattcttctgcctcagcctcctgagtagctgggattacaggcgtgtgccaccacgcctggctaatttttttatttttatttttagtagacacgaggtttcatcgtgctggccaggctggtctcgaactcctgacctcaggtgatccccctccctcggcctcccaaagtgctgggattacaggtgtgagccaccgtgctcggctggtaactaatattttgattttagttcacat

SEQ ID NO: 87788 - DNA, 1266 bp, Homo sapiens
aatttaatctgtacaaaatccctttgaaacgggtatattgtgacagaggaaatggcctaaaaggatttttttttctttttaacatttcagaaaacgttgagggaagcataaattttagaaaatatagagggaagcttagatgtagtttatagcgattcccttcacacactgtgaggaatgacaatgaaggagctggaaaggacatgcttaaaatatcctctgtcaaatgtcagaatcactaaggtcaattagggctgccaaaacaaaatatctcagggtatcttatgtttcttttaatttaatagttttaacttgattatttttacaattttaatttgatttacattagttaacagatatttgtagtttttacatacatgaagacatttaaaaataaaactaacatttactttagctaaagccaaggaaactaatcttaaggtgaaatatgtatcatgtgtgacatcagatcacatttggtggtgaatcgactattgatggttctgtcttatttcttttctaaatttcctcctttactctgagtgatcatagtatgctaatgaaaaagttagtatctgctaatcttgacttaatatatctaatcagttctgcaagaaattgttttaaaaagtttaagaggcttataatatttgacacatgtatgtttttatggtgaataatttattgttacttagaactgaagtttaatgctgcctcataaattttacagccacttcaacttgtcctttgaaaaacctctttaatcttaaaagatttttcccccttagtgtttcttttttgatcactttataaaatcctgctttacttagacctttttgtatgtgaagtatttctaatggcattttagatgatgctgtttgtgtcctagcctttttatattattaaagatgcagagtccttttgaagcctttttgttaggactctctattcagtagagatggcacctttcctttacttttattcttcctgtaggatatggtatatagtcttgttccaaacttgttagaagtatggtgaggtcatactccatctggcttattctcacgctttattttttccaccaagtatacattatatactagtgtacttagcatttcacaccaaacagcttcaacacttagctagtagtcctgtcctggttctcttctttgctttcatttttcatatttcttggtttaagataatcttattgcccatattttctataagaaaaactactgttccacattgcattgctattatata

SEQ ID NO: 87789 - DNA, 1049 bp, Homo sapiens
tactcacaataattaaaaattaaagttatttaatgataatctagagattttatttttgagaaaatatttctttgcatttgtctttctcatttaccaattacctaataaagtgaaattgtagaccaggagttagcagacaatggcccatgggccaactcctgcccacagtctttttttgccaggttttattggaacatagtcatgccatttgtttacttatggtctctgagtgctttcatgctacagtggcagagtagttatgccagagatcatatggcctgtgaagcctaaagtatatactctctggcctttaacagaaaaggtttgttggtccttcttttagactaaagcaggtgctattataggtctttgtaattgaatgtttcattttataaaaaataaaatttctaatagttcttctgtatttatagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatggtaggtatcaatgaacaaaaggtatatattagtttcatttaaaaaaaagcgtcaagttatcatccctttggggaatggtaatactattaggttgtatgtgctagataatatattaaaattgttttttttcttcctgattcaatttttttccacctttaataaaatacatgtattgcttataaggggagtatccttattgatttagttatgcctcagtattcaacagtatttctaaaaaactgaaaacgaaattttttatattgagctttactttttgctaattttcactggattgtaatggtaatttttacgtaattcagtaaattctagtttttaaactctttcatatatattatttaaacgtttatgagaggttggagtgcatgatttgtaaaagttcctttttactctaataaaatgacagtaa

SEQ ID NO: 87790 - DNA, 1266 bp, Homo sapiens
acacagatgtgaacagtttacactgagaacagagcaacagccagtctagggcaagggggggccagcttcactcaggtgacatttgagctgcatttacctgactccaggtggagggaatagcctatgaaaagggggtgggattagataagggctcgggggtgggggggggtttgaccatggtgaggagttcattgtggcaagagggaagtgggcatttgtgggttggtgtagttaggcaaagtgtgtgtgtgtgtgtgtgtgtgtgtgtgtgtgtgtgtgtttgtgtgtgtggtgtgagagacaggcctaaatgcaaaggtacttgtatgcctaactttgggtttggatagtattctgttttaggcagtcacgagagatttttaaacaggaagctataggcttagctttgtcattaggaaactcattctggagcaggtgaggaaaatggactcaagtagagaaaactgacagtagggagacagatgatgaggctgccgcagtagttcaaataagtggtaggcaggcctctatctgagatcgtggcagtgagaatagggaagcaggcagattttgagatatttctcagcatttattgatgtattggtttatgggggttcagaggatgggaacattgaaacttctagcttgggagatgaagtagatgatgatgtcatcaagcagagtacatcatagatttatggagaaaaacatcaaggattgttttcttggacatataaatctagataataaacaggacattagtgaataggtccaggagctattgtaaatgagtctggagttgcaaagagaggctggagtttgaaataaaatttaagggtgaatggcatgaaacgaatacttgaagcgatggtactgaatacaatcactatgcgagtgtgaaaagtcagatcaaaaggagactaaggaaagagcactggagagtccatattgactggagaagccagagccattgagagaccgagaaggaatgatctgaggcagtaggggagccagcagtgaatggaaccactgaagtcaaagaagagtttcttaggagcagggagttgtcagaagtggaagatgctgtggagatgtcaaataggatgcaaactgaagacagccctttggatttggcaattagtggatcactggtgaactttgaaagatttttgctaccatgatggagatagaagaggtaatatacagggggtgagatctggatagaagttgatgaagtggagaaagtaagtggatttggcgaatgga

SEQ ID NO: 87791 - DNA, 1036 bp, Homo sapiens
gtgaattgccttactctacctaatatttgaaactctggatttacaaaccagacaaattagagaagtgactatgtgctttctatatagttctttgctttggtgaagaatttaacctcagatctctttaaataatgaattaccctagtgcgtttacaaattacagttcacagagaccttttccaatagtatacatttatttgtaacatgctgtctgcttgttatattttgtttactgtgtctcatctgtatttgacttctagtaggcatatgctagtccattgtattttattgtttgttgtaacttaagaaggatatgttacctcagggtgatgcttttaatcccacaaatatagttacccagcattttctgttttggctcctaccgcaaaattaatctttctattaacatctgactatcgtagagtgaagttttcttttaatgctctctaattttgttttttttttcctcggttttgtttgatagaacatcattcttctgcaggagaataactcattctcattcatacctttggcaacacactctctggaaatgacagctggagtttgaaactgctttttgtattcctcatacatcagattatttttacccgatgaggcagtgctttctgtccactagtatgtagtatgttgctttggttagtaggtaaaatatctgcagcaagcatagtttttctttttttaactagaggggtgtgtatgctcccagtgactcacatattcatgcagtaagtaatatagctttagatccaaaatatttatcttcattttacttagtaaatggtgagtaggtatttgaagactaaagaaataagtgagttttagtccttaaaactgggtttgtaatttatgccatttagagaatggcatcttacaagcatgtgaagtactaaagttatttctactttcatttatgttgtatcttggggaagggaagggcgtttctctggagagacttattggcttattctcatgttcccttcatggactctgtgccattcttctttatattgcaata

SEQ ID NO: 87792 - DNA, 1033 bp, Homo sapiens
cagtttcccagaaagtgcttgtttcaattctttcctcaaccccgtttgcccagatgatatctgtttcacctgttaagtcttagtctaaggtttagctctggtctttcccaattgtcctattctacatgttcttcctatcgtaggaccttttttttttttttttttttgtgagacagagtgtcactctgtcacccaggctggagtgtgcagtggcacagtctcacttcactgcaacctttgcctcctgggctcaagaaattctcatgccttagcctcctgagtagccgggattacaggcacataccatgacacccagctgatttttgtatttttagtagagacggggtgtcgccatgttggtcaggctagtctcgaactcctgacctcaagtgatctgcctgcctcggcatcccaaagtgctgggattacaggcgtgagctcccgcgccccacccttcctatcataggaccttcacactgtatcacctctctacttctgtttcctctgccagttttgagtgcgaggactgagtcttatttctttttgtgtctccagtgtgtaatgtggtgcctgacactcagtagatactatgtaaatatttgttgggtgtgtgattatataaatattaagagatgtgatacaagcattcataaccagaaagatcacagtgacttctgcctggctgccttttctatatttttttaaagcaagtttataatccaaagttgtgccaactaagatcttaggatcattaaagaaaaagtacttttaaagctaagcatacttattcaaaagagggagcagaaaattctacctttatgtatataataagttaacatatgtaatggctaaacctaacacattaacactgcagaaataaaccacttaatgtgtcttctttctatctttagaatattatccaagcatcaagaataaatcttattgcacaaataaaacaagagtgtatcatgggctatagcaggagggggaaaatgtcttgggtatagggtgagaaagtaaaaccagcttttag

SEQ ID NO: 87793 - DNA, 1048 bp, Homo sapiens
atatattacctaaaatacacacatacaaataaattactcattagttaatctacaaatgtacatatttttagtagctccctaaacaagatttaaagcttgactaaatgtagtcatggagcttattatttggtagttttgcattctgtagtttatgtaactctatccttaaaattgaaattatttctgagtggtacaagccaaatacagaagtcaaagctttatttttgatagtttcagtgttgttgatttgaggttctgaccttggaaataaagatacagaaaataaacacacaaaatatacaaaataacaatggacatttatgtatgcttttttcaatgtttattttctagctaaatccaagcacaacctaaaagtcttataaatattccatggaaaattttccttcctatgctaggtttctgagttgctttaaaaattagtctgaaacaatggttactttttttctccttggtaaatttccctgggggagtctcttggacattctttattgccctgagtctttgaaccatattcagaatgagaaactgaagacagttggtctgaagatactcggaggatggacagaaatgaccacagctgatttgatatgtatgaataattttgaaaaattttgatagaactcaagtgccaaggacagtttccatgtcgccttctttattgttcctttgtgcctgctatatggatgttattgtcttttttgaataatggcctcccttttcaaataatttagctcactttttaaaaattttttttagacagccttgctctgtcgtctatgctggagtgcaatggcatgatctctgctcactacaacctctgcctcctgggttcaagcgattctcctgcgtcagcctcccaagtagctgggattacaggcatgcaccactgcacttggctaatttttgtatttttagtagagacagggttttgccatcttggccaggctgatctcgaactcctgacctcgggtgatccacccgcctcagcctcccaaagtgctgggattacagggtgttagctaacttg

SEQ ID NO: 87794 - DNA, 1052 bp, Homo sapiens
aggccaggcgtggtggctcacgcctgtaatctcagcactttgggaggcagaggcgggcagatcatgaggtcaggagagaccatcctggctaacatggtgaaaccccgtctctactaaaaaatacaaaaaattagctgagtgtggtggtgggcgcctgtagtcccagctacttgggaggctgaggcaggagaatggcgtgaacccaggaggcggagcttgcagtgaggtgagatcgagccactgcactccagcctggatgacagagtgaaactctgtctcaaaaaaaaaaaaaaaaaaaaattgctgggtgtggtggtgtgtgcctgtaattcaagctactggggagactgaggcacgagaatcactggaacccgggaggtggaggttgcagtgagccgagatcgcgcccctgtactccagcctgggcgacacagtgagactgtctcaaaaataaaataaaatttctggatgtttctatcgtcatgtgctcccgtaaccgccagctatctgacatcaactctgtaaacttcatgtcctgtgtctccttcgtccacatgacttacatttttttatttcaattcatcttttctgctctcatctctatttctcatctttttgaaatttgtagtcatcagatagcttttatttgagtattaatatgacaagtttagaggagaattatttcacagaatgaggtctgaaattttaggtgactattcaacagattttttttccctaagcattcatcgtcatatctgccagccacggtgcctgatgctggagatacaagtgagcaaagctgagactacctctgctggaatccctctagtgatggacccagccactaatctgaaaatcatgtggacaagtaacaaaagactgcatatggagttaccaaggaaagcactacgggattttggcagtgtgtaacaggggacctaacttagtctgaaggatcaggaacgtctctcctgagaagataacatttttccctctgttgcccaggtaagagtcagtggtgattgtagctcactgcaatctcaatctcctgg

SEQ ID NO: 87795 - DNA, 1031 bp, Homo sapiens
caacatggggaaaccctgtctctactaaaaatacgaaaattagccaggcatggtggcacgtgcctgtaatcccagctacttggcaggatgaggcaggagaatcttttgaatctgggaggcggaggttgcaatgagctgagatggtgccactgcactctagcctgggtgacagagccggactccgtctcaaaacaaacaaacgaaaactgaaggcagatctcatttgctggagtgttttgaatgaggattattatggtgagaagaggctggagaggtaggcaggagccaccttgcaggtcttagtccatttaatccgtgttaaaaattcagtgctttagcccaagaaccatggcagtctttcaaagggctttaagcaaggaggtggcctgattagtgtctccttgtgtaggaggatcatgcctactgttatgtgaagaactaactagaagtgggcaagaatggatggggcagcctgttgggaggtctttcctcattctggtgagagacttggttccagaaaccagagatgtggtggaggacaaacgtttgcaaatccaggatcctttttaggaggagagatcagctggacatgatttggaggtagaagggagaggagggtatcaaaggtcagaggactgtggtgccattcactattacgtagcatgctagaggaagaccaggtttcggggaagaccatgtggttttaaacttgctgaatgagaagtgccttagaggtctccaagtgtatggtacagggactggggcagagggtgatgccgggaaggcagctggatttaggtgctggagctgagagaggcagccaggactggagagtcatctgcttacaagttaagttgaatgaatggcaaggatttgagtgcctggaagaaggcacagagagaaaagatgagagggctgatggaatcagtatagtttagtcatctacggagatgggaatgaacaagagagggcagggtttgcccagagaggcaggaacaaaaccaggagctgtggtgttaggaaagccaaga

SEQ ID NO: 87796 - DNA, 1024 bp, Homo sapiens
tatagtataaaaaagaaatgaagttacacatgatcaagtcatctctgttaatcttttgttatactcttctgtctttttaagtgtgtgtgtgcttatttttttttcctcatgttacaaaaatacatttttaggtcttttgttaagaatatattgtgataactcaatttaaaaatgggcaaaggacttgaacagacatttctctaaagaagacatacaaatggccaataagcacgtgaggagatgctccacgttagggaagtgcaaatcaagaccacaatgagatactgtttcacacccattggatggccgttaagagaatagaaacaagtgttgagaatgaggatacattagaactcttgtgcattgctggtggaaatgtaaaatagtgcagctgctgtagaaaatggtatgaaggcttctcaaaacattaaacatagaattcctatgtgtcccagcaattccacttctgggtatctgcccataagaattgagagcagagacttgacagacatttgtacacccatgttcatagcagtattcataatagctgaatggtagaagcaaccctgtgtttgtcagtggatgaatggataaacaaagtatgggaacacatagagtggaatattattgagccttaaacaggaagggaattctgatacatgctgcaatatggatgaacttcaaagacattatgccaagtgaaatgagccaataacaaaaggacaaatgtatagtttcacttacatgagttatacatttcatgtataacttctcaaactcatggagacagaaagtagaatggtagtgggctaggggtagggggaaatgggaagttcgtttttattttcattttatttttttgaggcagggtctcactctgtcacccaggctggactgcaatggtgtgatcatagctcatgacatcctccatctcctggctcaagccatcctcccgtctcagcctccgtaatagctgagactgcaacacatgcaccaccatgcctggctaatttttttgattttt

SEQ ID NO: 87797 - DNA, 1110 bp, Homo sapiens
ttggggaaacagataaaaaggacattttaggctttacaaacacgctacacaccataaaatgtttgtttcagcccattgcttactccaaagcaatggccttttgcttgaagataatctcaataatagaaaacagttaccaaaggaactaggttttgggtggacgacttagccctccacaagggactgcagaatcctggtatttgaactggcagggtgtttggtttctttttttttttttcttttttttttttggcttgtttgttttcgtttgtcagaatatggccccagtttggtttaagttttgaatgttcaggaatttctcagagcagacaggggtccataagggcttagtagtgcttctactgtgcaaacagtgatttcttttttctccaaaaattaatttggcgtaagtgtgatcatggctgcttgacatttttttgttttgagatgggagagcataaaccacattcaaaggaaaaattagagcctatgtattagaatatttaaactgcttaatgtagagcaaaggaaaatgtcacaattggatgctgttgtgttctaagcaagcaatgcttctctggatttggatacttgagaaatcctttatttagaagtcattcatattcatctttaatacagcaactgtgaatatcattagccagaagcaataaattttgtgaaaattatttggcaattgagaaggtagggtagccagttgaagtcctgtgggcccaaggaggaacttggcagtgagttattgtcaaaagctgcgagtgccaggagtcagcccaaggagagttctgtgggaatcagaggagtgtggggccagttgagtccttatattatttattcctgcaagcatgacagattgattattacggatctgaaaaatcacttgcatgggtcttctcattctttttcacccctcttttctttctttttgggagtggataagacttaaaaaccacatacctcaggatacattgccgaatcaaaatttttctgatggtcgcagacttccgtgtctagaaagctgctagctttctactatttaaaatacaaattttgggatatggcaagcctcaccatttcttcactgtatgtagtact

SEQ ID NO: 87798 - DNA, 1042 bp, Homo sapiens
tagatataactaatgccaagcaagggaattatggggacaggacagaatgtcaaagttatacacctagaaactataaaaatagtgtaacagagccaaagtctggaggcagagagaggaaaagtaagagaaggtataagcatgctggtgtccacatctttgatagtagatttaactgattctgtctaaaacaaaagcattgttcaaaaaaattgcttcagctttttaaatattttcaccatctcttaatctgaaatttcattaattttattttgttagagtcaagaaaaattatatcagaagtgaaaatagcatgtggaacatgttcccattttcataaagattacttgtcatccatccttgttcatagaaagatggctagaatggtttttgcttagtgttaatgatattatttctgtgtgttggcatttgagttgatttatttttacatttgtctttctactctgcattgcataaattctctatttctttttttaaaaaagaagcataatatgccaagatgtttaaagtagataattttggatgttgagaacctgaataatttttttttttgtagttttaatttccaaaattaggggagagggagcatcttgtttggtttaccgtgctgaccataggttatatgtcattttatgcatataagtttaagtaatttaagtaccaagttactactagtacttgatttcctaagttgctgggaatatacactgtgggctgttcataatttttggtacttaatccatttcctctctgccatgcttagctttttctctatcactttcttccccccttgtctattctggggccatatcactctttgttatccatcactgaatggcctaacttcctttcaaacagagtttccctcatttggttggttttcggttttcatggaaagctattgaagtggtgtaagtgagtatggggtaggggaagctggttttgttatgatcaggtttagaagttcatttggcctgctgtgcagagaccggattggagggagactggagtgagtgagactata

SEQ ID NO: 87799 - DNA, 1363 bp, Homo sapiens
tgaaaatataccttcccaattataggaaagatagtaaattatattcacagtatgattaaagtgatgttttttttgagatggagttttgctcttgtcgcccgggctggagtgcaatggcatgatctccgctcactgcaacctccgcctcctgggttcaagtgattctcctgcctcagcctcccgagtagctgggatttcaggcacgtgccaccaagtccagctaatttttgtatttttagtagaggtggggttttgccatgttggccaagctggtctcaaactcctgatctcaggtgacccacccacctcagcctcccaaagtgctgggattataggcattagccaccacgcccatcggtgattttttttaaatctagtttttaaaatacctgaacagtgatggtgtaaaggacaagatgatagaagacttttttcttttcattttcttgattttctttatcatccacttttttaaaagacaccaacattatttgcataacaaaacaccatataggccggcacggtggctcacgcctgtaatcccagcactttgggaggccaaggcaggcagatcacaaggtcaggagatcgaggccatcctagctaacatggtgaaaccccatctctactaaaaatacaaaaaattagccgggcgtggtgtcgggtgcctgtagtcccagctactcgggaggctgacgcttgaacccaggaggcggaggttgcagtgagctgagatcgtgccactgcactccaacctgggtgacagagtgagactccgtctcaaaaaaacaaaaacaaaaacaaaacaaacaaaacaccatacagatggatatctaaaagtgaatgagacttgaaaatcagccagaaatgtttgctgtggtgataaacataacccttaaaatgattttttaaatatttttttaaaaaatagggtcttactccaatttcccagcctggagtgctactggagtggtgtgatttcagctcactgcagcctccacctcttgggctcaggtgattctcccaccttagcctcctgagtcgctgagactacagccacaccaccatgccctgctatttattgattttttacttttgggagagacggagttttgccatgttgcccatgctggtcttgaactcctgggctcaagtgatccacttgcctcagcctcccaaagtgctggggattataggcgtgagccaccacgcccagccaaaatgaattctttggggtccagaaatcttgtcttttgcaaagatagtttgatggggcagggttgctgggaaatgagggtcccaggctaacagttctctcaaatgtgcttcatggctcctgagtgccagctctgagtcatgggta

SEQ ID NO: 87800 - DNA, 1079 bp, Homo sapiens
ttagggcagattttctggaaagtcccgaaattcagtgttctgttggatttctggcatctattgagcaagacagttgggataatgagtcttggtattaaatgtattctacgggagggaggagagagaagtgggaggaaggtgtatccgtcttgctggcttcctgcagcttaagtaggaggaagaaaaggagagggtgtgagtagatgacccaagccctggactaagccctttaggtacatgatctcatttaatccccttttcagaggaaactgcctgagatatgtttgacccaggctttgtgctcttagccactaaatggcttccctttactgatgattttactctgcctttatcctatagttacttataggcagctatatttacttcctccaaatagattaactctttgtatactctttggtacctggaataagtcctgtgtaatcctaaacgctcaataaatatttcttaaaatgaagataattctccttgacagaaaattgatcttactgagcatatatccactgagaaaacagacgtatgaatgtttaatactccctgattatcgtatgctttcttatttaagcagaagtattaaacgcatgccaaaggctcacataaatgatttattatgcaccaattaacgttatctgagccatggtttttctttgttgttatgaattgagcattgacagcaaggcagcactcatttaccttttgtttctatgcagaaaacatttcaaataggcaactgttgtctctcctgagtagtctgagaaatgtgaatggagacatttgtattaggtgtccatctcgtgaccaatatgctttgtacttttgaagtttgctttatccttaagattgtgagaactgtaaatctgccactggaaccatccctgcagattgtcataatgtgatcagctctaaaaagcttcctgctttttagagtgtgtacccttaaggataacaatcatatagataaccttttagatgtcaacacaggcgatctttttatgtgttttattcatgatgcaatttacagtacttaaaggaaaaaaaatccagaagccttacaaggt

SEQ ID NO: 87801 - DNA, 2037 bp, Homo sapiens
ctcaacatcctgtatgtactggacagacacccccccattaccaccaacaagaaagagtgatccagcccaaaatgccagtagtgccaaggctgagaaattctgcaagaatccacccctaacacataataatcccacccctaattgcgttatgatggtgtattttctttcattattttatttccacattatacgtaactgtgtacttagtttttttgtatctggttctcttcattgagcattatatcctaacagagtaattttgtaattttcaaaatttttaaaattcacacatttctctcctatactacatatattctaatttactgctgttgtgaataacctgtaatgaataactttgtgtatttggcttttctttttcttttaatttctagttatttcttaagggtagtatttgtaagttgttcatattatttttctaagtggtgaattttttatgattctcgacagatgtttccaagttgctttccaaaggcatggtactaatttcagtgtcatcaacaatgtatagactttctgtttgcttgtgtttttgcctgcataaagcataaagttactggggaaaagcctatttttttttttggctaagtcaatgggcaaaaagtagtatgtgtttgattagtaatgcttttgtgtgggagaaacactgttctgatcattgtcgtcacaaccctcagaagtcatgataaaaccatctgtttctgtttaacaaaggctctgagagttattctaggtcagtggaatgatgcctttctgtacttactgcgaagaagtttattaagataaattgcgatagtttcaactttcttggagtacttttaaaagagcaagatccactcagatcatcatggaaaatcctgtcaaactctaagaaaattgtctaggaggccgaagtgggtggatcacttgaggtcaggagttcaaaaccagctaggacaacatggtgaaaccccatctctactaaaaatacaaaaattagccgggtgtggtgatgtacgcctgtaatcccagccacttgggaggctgaggcagaatagcttgaacctgggaggcagaggttgtagtgagccgagatggtgccacttcattccagcctgggtgaaagaacaagactctgtctcaaaaaaaaaaaaattgtttttgatgaagccattaatgttatagttaaaatatatttaggtatgctaggactccattgcactttcctattttttatgagttatttgtgtatttaatggggcacctagcactatgacatttcatatatgtagaatatatatatatgcttgacacacggaatgctcagtgaaaatgtattaaatatgaacgaacaaacttctgcccgcactttagggccaagagtataattttctgctgtaatgatgacagagagctatagtggagtgtgaccttttgatgtactgctggtcctgattatagtttacttgactttgaaggcttgatcaggaataaaacctccaattatatcactttttcagtggcaaacctgttttatggagtagtgatttgtcttgcaacagggctttggaaactcattaaaaccagggattttctcgcacatttcctaagagaattacaaatatgaaaagctgtggataaaaattatctgatttttgaagatttgctcatttttagaataaaacgttttcttatattttcatatcatgttttctaaatttttattctttcttgagggaaccattccaagttgtacaagtacgtttctttaaatatttgcatttgacaatgactcccttctctggttcttctaacaccttaaatgacttttttttttttgagacggagtctcgctctgtcgcccaggctggagtgtagtggtgccatctcggctcactgcaagctccacctcccgtgtttatgccattctcctgcctcagcctcccaagtagctgggactacaggtgcccgtcaccacacctggctaattttttttatatttttagtagagacggggtttcactgtgttagccaggatgg

SEQ ID NO: 87802 - DNA, 1031 bp, Homo sapiens
atgttgatgtagggatatctttattaatagtcttggtgaaactgaaggagaaggcatacaatacagtctttcacagaactcagcagtagccataaatccatttatgaacagttcaagtaatagagctttgaagcataacattagttttcaataatgatgttattcttttaaaaaatcagaggtttaaatgtaatgcatggggaaatggggcataataaatttgaataagtaagcattacttttcagtggatccagcagattccctttttattttatttattgttcaggttgttgaattttgtttattcaaatagtaaatgagacatagtccagggaagagccctttgcttatgctatatgatttaaggccagctgccgtttttcctgagctacatacgcttcatcatgttggaggaatcaacttcaaaagtcagctggctgttctgcagacaagcaccagacttgttattcaccctgaatcctcagccttagctccccaatctctgttgcacagaaaactacaattcctgggtgcctggaaagagagggacaaatattaatttgcatgacagtatcctgtgcaggacctcgtgctaggagaagcccaggaaatgtttgttggtagttttcactttgtcttgctagaaaagcctctacaggaaatctcctctgcttctaggaacgtcaaatttcaaataatcctggccaagtagctggttcctattcttgactccttcatgggggcggcggaggggaaagcttcctatgataatacattgcagcattacgctgcccaaagtgccaagggcggttgggtactattcttagtgtttatgtctttagttcttgttcttttacttacttatttttggcagattactgtttacaagcctcaggaagttagcagcaagcttgtcccttagtccttagcaataacgtttgagaattgctggaacctgtttgtcttgttagcaactacccaaatacgaagaagcaaggctgcaaggcaagcaccaaacttgttattcacc

SEQ ID NO: 87803 - DNA, 1019 bp, Homo sapiens
taatattttattttcagggggtctgattttcatttgcattaaatatgtgagaaaactacggcttagggaggtcatggggcttttctaagttcctgtatttggccagttggagaacctaggccttgtcacttcttgagatcttaagagtcttgatgccagggactgggccttattcttgtgagtttctttggtattttgcatgtagtaggtctgtagttgctgtttgttgattgaataagtgataccaccagtgcactgagcaggtcagattttgtttctaagtcagcacaggacccatcagtactgataaagccccaaaacccccacctttgcagtcagcctattgtgtatttggttggagcaaaagtaattgtggtttttgctatttttttaatgggaaaaactgcaattacttttgtaccaacctaagacctttcagtaagtgagagggcagcttgtgaagccaggctctttgtgaggtgtgagctactgaaggttaagtgtccaaaactagactctgatgtgtgcagttagccggggggaaggaggtagttcagaaaaccagaaggtggcagctagaattaataatccctgcctcctagtttggatataccctcactgcctttttttaaaagcaagaactctagagattaagtgttccaatagctgggatgcttttggaaggccgtgtatacctcagtgtatgtgttcccagtagtgtgtgccctggaggaaaccccagggcccagagcttccctgcagccccggccccagctctggccccggccctggccctggtcctggccctggaggcatcttctaatgaaattacctccactgaagtttcctataaacatagtcaagagcagcctctctccctgctgagctattgcagatccctcccacttcctcttctgctctcctttctctgaaacaccaagtgaggatgcgtgtttgcttgtttatggatggagtagctaaaggagcagggatggagcttgagttcctccagctcagaa

SEQ ID NO: 87804 - DNA, 1036 bp, Homo sapiens
tcagtcttcctcattagtaggccttgccctggtcaggcttcctcagtttgtggatggagcaggtagggcgcacggaggtgaatctcctgagccaggagcagcagagccaggatggaccctgacttctagcttccctcagcctgagctctttctctcctgccacactcttcttgggcctcttgctgtcaccctgggcttgtcaggtgccagcaggaactcttgggcaaatgggtcctatttctgcttgagtcttgaggtttggagcagcttaactgggagagaaggcagcatcctttaatgggggctggcagtttaatgccatcaaggggtaggatgggagtgtgaatggaagacagcccgtcttcattagactttacaatgtggcttatcaagtgcagtgtttgaagaccttgtgaagacatcatgagcctcacagtgctaagagggacctgaatgaaaggaaaacaatggctttcaatgatgatttgggaaacatggatgatgcactgatctgagcttatagatcctgtccttgggtgaacagggagaggtcagaaacaggaggatgcttaattcattccagccaccgctgctggagttgttttagcaaagctccccatttctgtagttggtgctggcattttgacgatttccccctttgctatggtgatctggaagcacagagccagatgtgtagctgcttctttgttcctaggcacacgccttttttccccgaatgtggccttggagtcagattgcccaggttcaaactttggttcctcggcttgttagctgcatggcctagacagcttgcttaacttctcttgcctgggttagaatgatagcaccccagcagtcctaataacaattcctgggctacagtatttactacctaccttgtggggttattatgaggaacaagtacaatcataacatcaagggctgagagccttcctagaacacagtaactatcccattaatgttcacagaactatcaccactcatgaaatcctagcttgaatatttacattagtct

SEQ ID NO: 87805 - DNA, 1021 bp, Homo sapiens
ttatttaattcatgttcacctctcccattagactgcaagcttagcgaggccaggggctgttttgttgtttacccttgaaccccaacccatagcacatgtaagtactcatttgtcaggtgtttgtgtttcatatccattttttgccttttcttacatacatggacacacttttctctcttttgagataacttccagaattgagtggttatgagcaattcctggatccctgtttgcctcagagccggtaactgttctcaccttttgggaaccataaacgctgccattgttgacctgaacacgaggtgactctggcaggagccctggccatcgtcccttttttggttatcatctgacgtttgtgcagctacacacatcatatctcatttgatctcttggactcccgttggttagtagaaaccttattttatagacaaacagctgaagctcagaggtgttcagaaacttttgccccatttgctgcaagtggtccatgagggtctggaatcaagaccttctggttctggtttgatgctgggactgctctttctgaattgtttctatgcctgtctgttcaatgttataatgatgagggggccagtccctcaccagctgcattctaactggaggctagaaaataatgaatgggaagtaacttaggggaaaactatgatgaggttgttggcatttgttactcttggaaagaagtgtagccttggaaactagaggctaagaaataaagtgaggcttcttagatgtcgttgtgtattaaacaggaagcccgtttgctctggctgtagagtgtgcccatgagagtttatggaagaatgaacttgactcaataaataacccactcagtgcatgatacccttttcttcagctgcaggtaaatgtctgttatggtgagtgacatggtggcatgttgggctctatgaaactgagtccacacacagcctgctgtgctgcctgccctgaaacgggacaggcccttggtaaatgacttgctactgaatggtagtcctca

SEQ ID NO: 87806 - DNA, 1058 bp, Homo sapiens
aataaagcttctaagagcaaaatataattttcttccctgcttgtttcttttcttagcattttagaaaatcccactcagtttctagagttaacacctttccccactaatcagaacacaacacacaacacacacacactctcacacatacagactccctcactgaccttatgggccctttgctctgctaaacacataggtactggatggagtttgtagcaacatgtccctgccccgaatttgtcatccagatgtcgcctttggatgtcatgtccttgacattgacccagggtgggacttctgcagtcaaatgctctacccctgagctatcccccctacggtgggacttctgaataaagcctgtgtcactgtctctctggttcccttcagcgggagctctctgtggtttaatggagtctccacttgaccaggagtgtttccagatgagaaacccagggagggctgcaagcaaatgagagtgaaaactgagctctgtcccactccaaatggcatccgggattcacataccaaggctggctgggaacagctgatccaggctgatcctgacactggagagtccaagcattggaggccagaggccattcagaagaattacctcggagtagaaggcttcctaatgagcaataaggaggaactcccccattcttagggcacaggcctaattgaaaccatcctgggaagagaacatctaattaagtctgactcctcagaggactcaaatagttatatatgaagaaatgctaatctcgtggccttacttgtggctagggaacctgaggtgatgctcaggacagcaataccagcccttacggccttgctgtgtgtcctgggctgtgaacagtgcagaagtccctgtctgttcccgtgattttgacagaggatgccagaggcagaagtgctgctctttggtggtgtccttggtggtgttttcatctgtctacattagggttgggttcactttttttttttttcttcttttttttcttgagacagggtctggctctggctcaggctctgtccaggctggagtgcagtggcat

SEQ ID NO: 87807 - DNA, 1012 bp, Homo sapiens
aaaacttttagaatacggagttagaatttatttatttatttatttatttatttatttatttatttattacctaaaacaagttcagtggaagatgctttttgattattatcacattttgggcttttgtttttggtaacatgcaggccatatatgaatgaaattttgctctttcacagaatgatatgagcatctgtttcttctaattagaatacatctacaggagaagagggattttaattttcatgttgtagcgaatgtctaagggttgaccgggtattttggaggagtagttgtactttgatcatatttgtatttgcttttctggtcaggagcctggataaggaagcgccccctaacgggtgggtggagcagagggagtggggcgagagatggagaggaggggccggggcaaggaaggatccctaggtctgccttcctgtccacagcactgcccgccagccacagctcctgagtcaaaggctctgaagcaaagttgtatgatgaaccttggatttcctgtacaatttggctaactctagggtgatctctaataaagacaaaggccaggggacagaaatatctttcttttgctcctggcaaatcccattttgattctatctcaatctaactgtccagaaaattggattgaaagcaggacaccgccgggaggtaaatcagattagggcttcctctaccacagcctccagcagacatttcattttgcagtgtgcgtccctcatttatatgaagccgtgtatggcccctccatgcagcagggtgcgtccaagctgacccagcgaaccaagacatcaggtgaccctccaatttgattcactgaaaatactgccggtggcttcattttctccagagaactgtctgcacctctgttcctttctttttatttgggtgcctatgatgacctcattgaagtcttcatctttttcttagccaatgtagcgtttgctaaggagccagacctcagataggaatggagagccccagaatccaggtg

SEQ ID NO: 87808 - DNA, 1003 bp, Homo sapiens
tgcctgtcttggtggggagaagtccctggatctgctgtcctttttcattctcagcactagcgtcatttctgccacaagtcttccctgaactcaaggctgggctgagggctattccccaggcactcacaccttacattggcaagaccttcctccacttgtatgatcctgaaatgttctcttagtgactcttttccaaactaaaagctccaggggggcccctgagcgaagttgatctttacaaccaccagggcccagcaccatatctgggatgtagctattgctcgataaatatttgttgaccagaaggtaagtgaaccgagtactccctatccactgtgtgtctacattcctgccaacccctgtatatatatgacaacgactcttcagtcccaggcctaatagacttgccccagtcagctccttcctgatttcatgtaagagtgacacgattgaatacttcctccttcctgaaacgtttccccctgttggatgtcggggctcctgctctctgctcgcctctctcctaggcctgtctctgaggtttggccaactcctcttgtcacccctccagcactatgagcaaggaattctggttctccccacaccatcttttttgaaattgcattcgaggtctccagcatctcttctaggcagatacctgaagggactgggcttcatgtagtcctcccaggcctgccagactttctggccttcaactaggagcttcatgcgtgtctgtggaaggagtgaccaatggacaaacatacaactctattttgaaagtgggttggggctgggtgtggtggctcatgcctataatcccagcactttgggaggcagaggtgggtggatcacaaggtcgggagttcaagactagcctggccaacatggtgaaaccccatctctactaaaaatacaaaaattagctgggtgcggtggtgggcacctgtaatcccagctgtgtgggaggctgaggcaggagaatcacttgaacctgggaggc

SEQ ID NO: 87809 - DNA, 1434 bp, Homo sapiens
cttcatctctagtacaggaaggattctgtcacatgacgtcatgacaggttttgagatacagtggaattaactgagtttcttgatctgctgatgacagaaaaaggagacaaggatgaggaagtcttgtgtgagtttttctttttttgcggggggtagggtgtctcactccttttgcccaggcttgagtgcagtggggtggtcacagctcactgcggcctcaattctctgggctcaggtgatcctccccccatcagtctcccaagtagctgggactgcaggagtgcatcaccatacccagctaattttttatatttttagtagagatggggcctcgctatgttgccctggctggtcttgaactcctgggctgaagcaatccgcccacctcggctttgcagagtgttgggattacaggtgtgagtcaccatgcccagcaatgagtttttgtttttgttttttgtttttcttaaacaaggcttttcttttatctttaaacactttgttggttctctctgtttggtagttgtactatgtctaagttgtttattttgttaggagcattttgttgtaatcatgaaatattttgagattcaatacttgtgtttattcagtcataatattcttattatataatacttcctgatagtagatattaggattgattgaagcaaagcatgtgtattaataaactcagtattcattaaagcagcttgggttgcctgtagaaacggcagagcatccccaaggctgagggaggcggggctcctctgtgggtagcagacttcatctgcaggacaatgtgcagcacaggctgcgggtattaaaggagggatcaagaaactggtattaccaggggcacttgggaggataggggatcaggtaagccatagcatagagacccagaaaatgagccaggaatgttcagtgtgaaaaaaagaataaggctgggcgtggtggctcacccctgcaatcccagcactttggaaagccgaggcgggtgaatcacttgaggtcaggggttcgagacgagcctggccagcatggtgagaccccgtctctactaaaaatacaaaaattagccaggcgtgatggtgggtgcctgtaatcccagctacttgggaggttgaggctgcagaatcacttgaacctgggaggcagaggttgcagtgagctgagatcataccactgcactccagcctgggcaacagagcaagactctgtctaaaaaaaaaaagaataagttgcaggacttgatatgagagctgcctttctaggaagaagggtggactcaccttgggaactccatgtgctgacccagaccactgacaaggcgttatcaggggacagcattttatacaaccctgagaacaacctccagtgagtagatgtttccagcaacagaacaaggactgcagaacagggaggctgaggtgg

SEQ ID NO: 87810 - DNA, 1044 bp, Homo sapiens
ccagtctcagccaaattcaaatatcttgtagagaataaatgcctcttgggtttatggatttatgccatatgtgtgagaagagaaaatacggtcaagaattgttgtatttcttgactccttgaaaggcaagaacactggcttgggaaatagggacacctggtttctagtgttagataaatcttcagaatacagaatgctctttgaaataacaaaatacttgagtgaaggaaagaattgaggaatgaacttaaatttagctctgaaagaattctttcttcagtctgtggttcccttagctactattcaatctctcatttccatcttagccatattttagcttccaccctgtatgacagagacaggggtctttctcttggtttggagcacacatccctcaacatgtccagtagggagctcctgggcgacgggtcctgcaggtggatgtggaccaggagccccgtgggaggaacgtgcccctggggagagctggtggataccccgaatggcaggccacctggggcaaagccagtggaacctgactatggcaggatgagaacaccagtgttttataatgcccacttttttttcacttcttgcagtttctatgtttatttcctgttagcatttagtagtatctttatgagtttatctcagttatgctaggcagaaaggagctcttgtcagttggcaggaccgaaaggagagaataggcagggggaagaggggacagtaatcgaagtaggagcaccttgagcgaagtgaaatgtgggatggaaatggaagctcctgtttgtgatctcccagagaggctcagtccagcgccaggtgccgtgtgcttgtggaataaagagaccgaattccttctgtactgggggttcatgctgaaccccacctttgttgaaggggaggaaccagctgcccaaggcaaactagaagcatgcttgcaggagggaaggttaagacacacagtttatgtgcatagcagtgaaaaccatagtgtctgttctgaagtttgggaaaatagtgtgagactgtctagctggg

SEQ ID NO: 87811 - DNA, 1034 bp, Homo sapiens
cctgaaatcccagcactttgggaggtcaaggcgggcggatcacttgaggtctggagttcgagactagcctggccaacatggtgagatggtgagaccccgtctctactaaaaatacaagaattagccaggcgtggtggctactgtaagcccaggcatctgtaagcccagctactcaggaggctgaggcaggagaattgcttgaacccgggaggcagaggttgcagtgagctgacatggcaccactgcactccagcctgggtgacagagcaaacgaaactctgtctcaaaaaaaaaaaaaaaaaaaaaaagatgcataattgctgcaggtatgtgattgtaaccatagaataagtaggtatgtacatgtggtagatagaatgatgtgccttccccctgaagatatccatgtcctaatatccagaccctgtgagtgtttttcctacatggaaaagagcataatgcagatgtgattaagttaagggtctcgtgagagattaccctgggttatctgggtaggcccagtgtaatcacaaaggaccttctaagagtgagggatgaactcacaaaaggatgcagaagcagagttgggagggttgcccttcaaacatggaggaaggggccatgaaccaaggaatacaggtgacctcttaatactggaaaaggcaaggaagcaggggcccccggaactctgcgagcacctccattgtagccttatgagactcattttggaagtctgaccccaaaactgtgagataataaatttgtgttgctttaagtcactaagtttgtggtattatgttacagcagcaatgaaaaactaatatggcacataagactggaagggaagatattttaaaatgatagttggaagtacagtgtattttagtttgtgtattttgattgggtgcttgtgagtttactttggttggttaagactaagaggcaacagatgacttttaaatgttagaggagggaaaaatggtagagtttcaagttcacattcaagtacaaatgatgaataagcccagccaaat

SEQ ID NO: 87812 - DNA, 1084 bp, Homo sapiens
actgcagagtcctccgaggagctttcaaatgaagcatggcagcctgggcaggttgcaggtccattaaatccacatctccggggtgggagccggtggcatccttgctttgccagaactcccccattgaccctaatgtgaaacctgggctgagaggccctgcctaaagctcgattattttcacctgtggatgtaggcgatcgcttccttttgtggctgttgtcaggaggcagaaaatcccctgggttgttggctccctggagtcttatttttacagagtgccctgtttcaggtgcagcaacctgactgatgtttttacaaatcaccttttggtggcctcctgtcactgctgtctcccttcaagggttaaataagcctctctcacccattccttttcacacctgtgtcgtgtattattggcaggcctcagtcctcagggtgtcaaatggaactgatggatgccagacattgtggatatctgcaagtcctggttggtgaccagggacttgaagagtagactttcttctcaaacttatctttgtgctgttttccttccccagacctcatagtctggagcccatgtttccaggggtggaatttgattttcccagagaggagctgtgttcggcttctaggctgaggagctaagctgccgagcctctgccagccctctgtggattcgctcctgcattattcagcgcctttgctgacagagcaccatgttccactgctgagcagatcagggtgaatttccaagagggaacattgcagatggttttgcctttagggatggattttcttactcccaagtgactcacttctggtaaaattaaaaaaaaaaaaaagaacaaccttgagtcccttgagtctgtccccaccatctttgctcagagggaattaaggagccaattcagagctttaaaaaagtcacgtgatgattcattatctttttgctggttgtttcctgccccctccccccccacccccacccactgacttgtagtttttcataagcatttattcatccttgaattttattttatttttttatttttttttgagacagagtcttgctctgtcacccagg

SEQ ID NO: 87813 - DNA, 1071 bp, Homo sapiens
ctggccccaggagcctggagcacattggtaggtgtgctgagggcctcacagccgaatgacttctggtccaggtttggaattgaaggtttaagttgggatgttggctattcctcagaagtgaggatgtgttcttccaaataaatggtgatcaatccctgtgcattggagagctgatgggggtgtgcttggcggagagaggcatacccccagaggcttgaggagggcagttgtatttcacgtgctgaggagagtagtggtgtggttaaatcaggaataaaaaaaaaatatgaagaaattgtcagggagagcttcagctgggcccaaaggaaatcaagaaaagagcaaatgagaatgcaatttaaaatgtaaatacaaactgaaatcaaagccatttctatgaaacatttaagaacattctgtaagtattgctggtcaggaaagcacaaaaaattgtctgtgttttgagcccattgtcagtgtattatttagagggaagttctgatttttgctaaggggttattccgagttgcgaagtggtgtggtgttgggggaagaataccaccaactccaggccagctgctgcatctcctggaatctctgttttctcttctgtaagatgggagtcagggtggcctccatctgatcacactgaattgttgagtgactcaaaggagataatgtaccaaacactttgtaagccctatgacaccgttcaaagtctatttcctcccagctctgttttctaaaatcaggctgtatgttcgaatcacctgaggaacttaagactattaccagcgccaccactggcatttttcattctcttggacagcagaggttttccaaagccctggatgtcattctgctgggcaagtctggctgacggggctctgaggagttggagggcctgtccacccttgcctttgggaaaccagccagccagtggtccaaggagattgtcggctgtcttcccaagtcagcgccatcttccttcctgctcatttcctgtctcccagtttttccctggaacctttccatttaaatatgaattcagctgcagcctgcggggatctg

SEQ ID NO: 87814 - DNA, 1621 bp, Homo sapiens
acctgccagctgtttgtgagccctgaagatgttggggatttaaattttagatagatcattgtagctgcaaggggtaggacggataggtggggtatccagagtccttggataccttgtcttcctggaccctctctcagcacccttgggctaagatgcactcttgaacacatttcctctatggcccctttcagatctgctgatgatacctggattccttctttcagagtgacccagccccatcccagggaacgggcagatgggctctgttgcccatctcaaagttcccttactttttttcttttgaggttttatcagtccagaagtggaaagaagatggatgccattagctttagaaatattttttatgttttagggagaaagaagcagagaatatacttttagatgagcacactttaaaataccagtaagacagacttgttggaagacaggcattgtgaagaactgttgttgttttttggttttttttttttttttttttttgcaacagctttccccactttgggaaatgagaacttatgccctcctgaatgttgtatttgatgggacttagatccatgggggaattttattttattttttaggaaaaggtaacctactaagtatagttatatccttctagcatgaaatataatcatttattagaccagaactgtttgttaattcagcagtgtgtcttgaaaaagagccaccctcaaatttaaagtagaaatagattcttcattctacacctttttgacatcagatttgctttcctggtctcagtgcaggtgcccctactgtttggtgtttgggacacagcctccgagtaagtccaaggagagcttggggttaggcagtataggccatgagccccttgccagcctcccagggactttgagaggagctgtttggggcaagatgcttaatgaaaggatgttttgtaatttagagagaaaaaagaaatttatcccatagataactaaaccctcaatgggaatattagaaaatacaattgtcacattatgtaatatttgtacattttccactgcaagtaagaatgcgtcctttccttaattttaaaatatggaaaaggtcgacctttctgctaccgtaaggaaaatcaagggaaagggaggttttatacatgatatggggaacttggtataattatttagctcagtatgaaattctgccacaggaatataaggtaattaatttctctaagtatgaaatgcaatcttgaaaaactaggaaacaggtgccgaggtgacaagataggaagagaagctgagtgttgtgcagtggcaccgaacaacttctggaacattccagagcgtggctttgtagctggagagagcctcctggcttctgtgtggcgaccgagactgacccctgctggcagattgttgctaagccgtggctgttaatgaagcagggcaataaggcccttaagcaggagatcctgccaggccacaggcaggtctgtctccgaggctatgccttgtaccagcccttgatgctgttgcctgaattcccagtgggaagaaaaatggacccagcagtttttagtgttttggtctcagtttccaccatctctcccctttcccagtctgggatgtca

SEQ ID NO: 87815 - DNA, 1031 bp, Homo sapiens
gtgctgggtcctctgcttgttgctcagcagggtactggaggccaggaaggctggcgctgcagaaatctgtcttcagtgcacttactgctgttgccatggacagctcattcgtatagctggtgtggagctaatgaagtagggatgtttttaaaatgaaattttaaaaatggggtttgagaagtacataaacagttcattgtggcataaaatgacattataatcatttaattttgagatgatttaaaaatcatttcctcatgttccatgttctacagcttaccagtcaggaaaaaggataattttgtgggactcaatgaagtgatgaaattgagaacaaagcctttcatctttggacttacacttccatgttcctaaaagagttaggcagggatatgtaggtaaatcaaagactggaaacgtagggtctttggaaacttttttctgggtcatctttttagtcttaaagctaagccttcagttgccaagcagtggtttttttaatgaatgaggctggtcaataggatatctatattttaaaaacctcaaccacaagtaacaccctacacaaaaaccaattacagatagatagtagacctaattgtaaaacaataaatgttctagaaaatgacagagaacatgtttatgaagttgaggtacaaaataattttgtaaacaggatctaaatagaactaaccctaaaggaaaagattaatcaggcatttttgttaattgaaacatcaaagaatgaaaggtagactggtattgggggaagatatttgctacacttatacctgttaaagggcttgtgtcctgaatttaaaaaaaaggtcaggtgcggtggctcacacctgtaatcccagcactttggaggccgaggcaggcggggatcgcctgaggtcaggcgttcaagacagcctggccaacatggtgaaactctgtctctactaaaaatacaaaaattagccaggcatggtggcaggcacctgtaatcccagctacctgggaggctgagacaggagaatcgcttgaac

SEQ ID NO: 87816 - DNA, 1053 bp, Homo sapiens
tgtgtaatttaaaacttacaaattgggccaggtgtggtagctcatgcctgtgatcccagcattttgggaggccgcggtgggcggatcacctgaggtcaagagttctagaccagcatggccaacatgggtgaaaccccatctctactaaaaatacaaaaattagctgagcatggtggcgcacacctgtaatcccagctactcgggaggctgaggcaggagaatcacttgaacccgggaggcggaggttgcagtgagccgagatcgcatccttgcactccagcctgggtgacaagagcgaaactgtcttaaaaaaataaagttgtttatttctggaattttccttttaatatattcagactgaggctgaccacaggtaattgaaactggaaaacaaaaccacacatacagggattacttggaaacattgcctgttaccaccttatgcattggtgtgaggcttgaatggagtaacacctgagggcagtgtctggatagagtaaaccagcattccatgttagatgatattcttagtgttagtattagtacataaaacttagaaacaggaccgggcacgtggctcatgcctgtaatcccagcactttgggaggccaaggtgggtggatcatgaggtcaggagtttgagaccagcctaaccaacatggtgaaaccccatctctactaaaaatacaaaaattagccaggtgtggtgatgcatgcctgtaatcccagctactccggaggctgaggcaggagaagtgcttgaacctgggaggtggaggttgcagtgagccgagattgtgccactgcactccagcctgggcgacacacccagactccatctcaaacaaaaacttagaaacaaatattcatctaataactggaggaaaagcaaaataaatttcagatggaggctgtgctatgaagactgtcacagttggttacaacacagtgttcattgtaaggataccaaatttcatgtgcgcggttgctctaccaaaggatatgtgcatgggaagatgaagtaaaaggagatgtattccacaggtatagtac

SEQ ID NO: 87817 - DNA, 1093 bp, Homo sapiens
tctccccgtctcagtgtctcaaggaaaaacctcattaagcagacaccttaagaagtgtattatcttccctttaaacctccaaaagggagggaagaaaaggagggatgtgagagtgaagctgcctgtgtcatgtccagaagactatctggaagtcttttttacctttctttgctttcttaatcacctcgttgaggttataaagtcacgaaggagactagatttggtagttgttactttaaaacagcccaaaacatttataaaaacaggtttttggggggtaatgaaaaaaaatttaagtcagccacaccgtcacatgttcccttaaatagccacagtggggtcattggtaacatagacccataagcacatgctccatacagaatgggtcatgcagctttcaaagagcagcccttcctcaaggagctgtgttacgtgaatactcatcaaagaaattatccatgccgcttctttctaactcagtgaaaacttgatgaaatagataaaatccacaaagctgtttagcccttcattgaacagcctattttagctggtgcctattttcctgagattatgaaaaatccagttccctctttacaatagtcaccaaaaacctccatttccacaaagggagtaggattgcctctggtcagtaaatggcgattccacctctgggtaggcagaagaaaaggggaagcaataagtgggagggaagcacctataacaggaaaatgcaacttttctagaagtgtctaggagacttgtgttgagatctgactggccagagctatggcctgtggctaccgatagctgcaggagaatcggggaaatgtattttgttagctaaacatgtcatttcaacaaagctcagaaatctattcataaggggaaaaaaaatgaatggcttttggtcagaggcctagcagtgtctgctactggaagggaattcaggcccaggaagtgaaaaccgagtgattctatctaagaagtcaaagtgaacacagtgaatagtttgcatcccatacagatagctcactatcggcagtccacagaaagtgtacattgactgtatctggagggccaaaatttcagccaa

SEQ ID NO: 87818 - DNA, 1397 bp, Homo sapiens
agagcatgcacaatgcttcatacccttggggagaggagtcagaagatgctatctcattctttcctttggtgatcggagaaatgtaggataaaaaatgttttggggtgaatcttgagatagtcagcagtagaatttaaacaacattttaaaaattttggccgggcattgtggctcacacttgcaattccatcactttgggaagctgaggtgggaggattgcttgaacccaggaattgaagatgggcctggacatggtgaaatcgccatctctacccaaaaaaaacacagaaatgaccggtgtgatggcgtgtgtctgtagtcccagctactcgggaggctgaggtaggaggattgcttgagcacaggaggtcaaggctgtagtgagccatgatcacactactacactccagcctgggtggcagagtgagactctatctcaaaaataaatttaaaaaaattatagaaaaaataaatgcaaagaaaacagagtatagtaaaagagtgaaggctgggtgcaatgcctcatgcctgtaatcccagcactttgggaggccgaggtgggcagatcacaaggtcaggagttcgagaccagtctggccaacctagcaaaaccccatctctactaaaaatacaaaaaattagcctggtgtggtggtgtgcgcctgtaatcccagctacttgggaggctgaggtaggagaatggcctgaacccgggaggcagaggttgcagtgagccgagattgcaccattgcacaccagcccaggagacagtgggagactcatctcaaaaaaaaaaaaaaaaaaaaaaaagactgaaaacaaagcaagtaactaggagacagagggacaacaacaagtgaagctccacacgacagaggcagccaagaagtgggggggtttaagaatgtactggaatggggctgcctgtgttttcagcccctccccttgctagctgggtgaccttgtcctaggtactgcttaatctctccaagcctcagctttcctcgtctataaaatgtggataccaagtagggttattgcggaggttagttaatatgtccaaggtgctgagtaccttatcaggtacgtacttgtgggtacgaatattgaggataaggtaacagattaaactgcccaccattttcagatgggatgttttgctaaagttcagcgatatcctatgaatgagacctacacgtaaagtaaaatgacccataaacactgagaaaaaggatgggcagtgatttatgagatgaaagaaagaaagcagtggaagtagaattgccccaagtcaggaaactctgtgtacctggatggagaaagccgagtcgggggcttgtaccactaacatgcattggaaatctagaacaatttaaagtctaagcttgttgcacaaa

SEQ ID NO: 87819 - DNA, 1022 bp, Homo sapiens
gacttactttgtcctgggttctcttctaatgctttgcgtatatcaattcacttagttccacagcaaccctatgggttcggcactgttattttccctgttttacagatgaataaactgcgaagttgggtaatttatccaaagccatacagctaataagtggcagggcagagatttggccctagctgcccacgctcttggtccctaagtgatgctgcccctgagaagtcacccaccacctgcagcacccattcacgtgagatggcctgactttcccctgtgcaccatcagatgtgtatccctcactcgggtgcctgcaagcctttgtgagcgcaccttgcttctctcagggaaagcatagcggtcactcccgcctggcttcctgtctgggtccacatctccacttttcatcaagcaggctcttggcaaaatcactggcttcattgcctagcctgcactgtgccatctactgtggtgcacctgtggcttagattctccaatccggctagggcggcccagtcctgcgagctgaggagcagcccatctgcctgtatccccactccattcctgaacatttacttacaactctaaaactctcatgtcctgggttcccgagccacctgcatcggggatcactgggtaggtggttctccatcttcatcatcttatttgaatgggctttatccagaaatgacaggttacatgatcaggaaattatataaccttctaacccaggctggtttttctcagtgccgggcttgacagctgataatttcagagcagccatctgaagccaaaaaaatgagaatataattagtattctgtatttctattaaagttctggaattacagaacagactttctattctgaaatggccagtgccgtggcacagatgtatttcctcagcagatgtctcctcctcataaaggctgcagaactgctaatgagctgcaatagaaaagcattcttcccgcgttccctgccagggccttgggcccatttgggcagacctcggggagcagtc

SEQ ID NO: 87820 - DNA, 1065 bp, Homo sapiens
ggcttccttggcttggtcatgagctaatctttaccttgtggctttttctgaaaatagacttgtcaacactcagtccgagtctggcccccagtcactggttttctctgttgacaggctgcaaagaatcatgcaggaagggctctgtccatgaattcccaatggtcatgggtggtcagccagctcagagctgatggtttgggtgggggcaggcaggacacagccatagtctcagctcttactaggggtattcgttttgtgactcacattcccccaggtgctcacagcctgtagatacccttagggtcacaataattgtattaatttagactccctggctctctcctggcccattgacaaaacctctgttcacttccaaagcccagcagttgcagctgggagatcccaggagtatctcgtgcggtggtgaagtgatccgatcacacacctttcctctccggtgtgaggccctctgctttgaggccacttgcatcccagccatgttcccccccacccgctgcttcctttggggagaatgcccccttgtgagtccacgcccccctcaagctgccaggcctcatgcatggggccagagagctagggtgcaaataccatgtgtaaagggaaaagtgtcctgacctcagctgcccttgtgccctcaggcctgtgcccaccgttggagacaggaaacacctacctccaccttgccctcaggcagcccctcctgctggagaccagctcctcagtcctgtccaagtcccctgagggcagctgggaagcccctgtctttttaggagaggtctcactgttccaccccctcgtctcttcccccttcctggaatggaaatttgtcttctgacgctgccacctggcagcaggcgatggctgtggcgagactactcagaatggcagcagccaccagccccgagctctgatcactccctcaccactgcaggatggcgaggctcccaagcctgcaggacgagaaagggagtgttgacccattttacagatgaagaaacaggcctcagagaagtgtgcagtgcctttactggtgtcccagaccgc

SEQ ID NO: 87821 - DNA, 1076 bp, Homo sapiens
actggagaacagggagatccagccaccattcaagcccaaagtggtgagtccagaaaagcagcctgttttcggaaccccatgtccccaaattctgggagtatcccactcacctcttttcttggagagaggaggccggtgcccctggcttgtacagggtgaggaaacgggccaggtttcagccttgtcctcagtcctgtggcctcagcagccgggattcctgctgccttcagagagtaaggaccgataaggcagggaggggaaccctgtgcacacttcatcctccagctggacagctgcagagcacccccgcacgactagggagtgagggcagctgtgctttaggtctggactttgtggactcgcacccagcagggccgtattcacagccttcagtcctcagcaggactcaggcttcgtgtctgtctctggttttcctgggtttgcctggcaccgaagggagctctgaagcacaaccccgtcctagccagcaactaggcagggcctgggccccgccccctcttccaccactgcctccactgcggggagtgagtgtcagccaccaattctaatgttgtcagcttttttcacactctccctgtttgattcccatttttttcatttatttaaacactgtatgccaggccctgttctgagtgccttacgaatattaattcactcaatcatcccagcagccctgtgagatgggtactatggtccccagtttgcagtggaggaaacagtcacagagaggctgagtaacttgccagaagacacacagctgatagatggtgaaaccaggacgagtctttgtcctcacctactgcaccatcgctccatctcagcaactgccctgacgctgatgctgtgggccctaattgttgattgcggccagcaagtgcctttcatgtttatatctctagaggtaaactgagagcctttaagaagtcagcctgctcactcaccacctgccactttgcagagcctccaagggcgtcctgtttctaagggccgggcggactgtgccttccagctctgccaccatcttggccagcatcaggcagctccccattgtgcct

SEQ ID NO: 87822 - DNA, 1272 bp, Homo sapiens
accattcattgtggtgtgaaatctccttgggtgaagagtagatggttgcttattaaaatggaaataagcccagaggctggacgcggtggctcacacctgtaatcccagtactttgggaggccaaggccagcagattgcttgagcccaggagttcgagaccagcctgagcaacatggtgaaaccctgtcaatacaaaaaatgcaaaaaatagtcaggtgtggtggtgcgcacccgcagtcccagctactcaggaggctgaggtgggaggaacggttgagctcaggtgttgaggctgcagtgagtcgtgctcccaccactgcacaccagcctgggtgacagagtgagaccctgtctcaaaaaagaaaaaaaaattaataagcccagaaaggaaagctgtttgtcataaagaccttactttgaatttatgacatgctttccacctcaacaggtacttaggagcaggttttatttgatgaaaagtaggtgggaaaagggtaatgaaagtagcttcgtcgctgggcgtggtggctcatgcctgtaatcccagctactcgggaggctgaggcaggagaatcacttgaacccaggaggcagaggttacagtgagccgaggtcacgccactgcactctagtctgggcgacagagcaagactccatctcaaaaaaaaaaacgaaagtaggttctcaagcacacctcctagaagataaagtgtgaaaaaagagctgagaaagcacagcccgtgagactcaactgccttataaaaacactagcagcacgtgctggcctctcgcctcggctgggttctgtgcaaaaccccatacatttcaccttcctgacagccttgggcaggaggtgtgattgttctcccagtgttacagatgagcaaacttggtggaccccacttcacagttaatccagagctattctctgttagagacccaaggatgcctggttagtttgaaatgtgtgctagctcagagttaattcatattggccctgtggtgctagcagcaggtccaagggcagtaattggcagcatcttgaaaatcattcttaggatccttagtgaaactcccagctcttcctgcttcagagtcaccctgggctcccggggacttcaacacgccactacccttgtgggtggctgacaaggtgaagagaacactccttccccacttttggggtcaggctaccaagccgtgctgcctaagcggctgtgtgtctcagcgaccccagtgcaacagttctgcctggagtggaccctggaggag

SEQ ID NO: 87823 - DNA, 1044 bp, Homo sapiens
acccttcctagaaagcaagcagactgttgccccattttgggtacaatttgatatactttccataccctccatctgtggatttttcagcattggaatcccccaaccagagatgttaaagtgagcctgtcccaggaaacatctccacccaagacgtctttggaatccaagaacaggaagccaagagagtgagcagggagggattgggggtgggggaggcctcaaaataccgactgcgtccattctctgcctccatggaaacagcccctagaatctgaaaggccgggataaacctaatcactgttcccaaacattgacaaatcctaacccaaccatggtccagcagttaccagtttaaacaaaaaaacctcagatgagtgttgggtgaatctgtcatctggtaccctccttggttgataactgtcttgatacttttcattctttgtaagaggccaaatcgtctaaggacgttgctgaacaagcgtgtgaaatcatttcagatcaaggataagccagtgtgtacatatgttcattttaatctctgggagattatttttccatccagggtgccatcagtaatcatgccactactcaccagtgttgttcaccaacacccacccccacacacaccaacattttgctgcctaccttgttatccttctcaagaagctgaagtgtacgccctctccccttttgtgcttatttatttaataggctgcagtgtcgcttatgaaagtacgatgtacagtaacttaatggaagtgctgactctagcatcagcctctaccgattgattttcctcccttctctagccctggatgtccacttagggataaaaagaatatggttttggttcccatttctagttcacgttgaatgacaggcctggagctgtagaatcaggaaacccggatgcctaacagctcaaagatgttttgttaatagaaggattttaatacgttttgcaaatgcatcatgcaatgaattttgcatgtttataataaaccttaataacaagtgaatctatattattgatataatcgtatc

SEQ ID NO: 87824 - DNA, 1029 bp, Homo sapiens
ctggctcccctgtccctgcagccctgcaggtcagtgcatgatctgggttcgtgtcctgaccaggtgctcctcctttgatccgaggggaaagggactggtttatagaaagagcctaggagacaaaagggccagtccccctgcccagaatggagcagcagcaggacagacccccacgaggccccccagagaggaggaagatcccacggaggaacacatgaggttagggacccttgttcagcaccccaaacagcctgcctgtttaaagcaggcagcaggcttaggccttccctgcaaccccaacacccacaagtttgtttctctaggaaacacattcactgtctcagctggctgttactctctcagaccatatggcaaagttttccaagaaaatgccccgacaggggtgcccagcacactgcctgagggacaacagacatcagaacaaacccccagagagaaacagtcaaaatcagggcccggtgcagtgttgtcatgtggaacctgctttatccattgctgagtgttgaatgtgggtaatggttagggctttccagatctcagcagccaaagacagttattgttggaagactgtcatgtagataaccatgagcaatggctcgcctcagaatcagttcataaaattctatggtactggccccttcgtgggtattgtgtgaaatgagatggtggcgaggggtgcgctgtggaactgccgcagccacgcaggaggtccctgggggatgctttgggaagtccttgcccctgagcactgcctgattgccagggcctgtggaggtctaggccgcctggcagaatctagcaccgtccgaatccccgcaggacccatggagctatgaccacaccaggccattcaaatggctctgcattatcttcccttggaaggtggccactcctcggtggcagggcctttccctgaggctgcaggccgtgggctggcagcccgtctcttggcatttcaattgaaggtcaccaggtgctgggtttgaaaggaagtcactggagtgctgc

SEQ ID NO: 87825 - DNA, 1028 bp, Homo sapiens
cctctccctcctctcctcccctcaccttccctccttctctccttcctctcctcccctccccttccctcctcctcccttcccttcctctcttctccattcctctcttctctccttttctttcctcccttttcctctttctctttcagtctttgtctatgtctctctcccaatctgtttctcagtctctctgtgtcactatctctatctctttctcttttttctctccttccactgtgtgctagactggtcaccacagtcagtcatctccctgccttctgagacactcacctcattctttgtatctttggtgacacccagccaagcctgaggacataggaaaggggtagtaaacctttcttcaaggtttatcaaaggcatcaccaaccaacatttgttcaatctcatgcattctggaattcagtgggtacagaatgtaagcaaacatcacggaacatgtactcttgccagggacagaagagcccgtgtagacgtggaagggaagaggagactctgggcccagagggcagcagcttgtgccacatgccaaagccctgccacccacaccaactctagagaactcactagagccacccagtccccgtgctgccatcaggaaagctctccacccaaagagaagggtcctggcgcctcagccgtgcccctcccccaacctgatggagaaagctgcctccagcatgcccacagctctgccagggccttaatatagcagacttgatgccaggggtggcccccgcacctgttttgtgccagctctgtgctgggtactagtgggggaagttatggagaaggttctggaacctgagagtgaaggagttctttgccccagtcatgttcacgtgtctcacctgggcagcatcttgcacaccagtgtacccaacctttcttcccaccatggcacactgaggaagaggaagcattagccctgcaccctggggaggggattgagaagacagccatggatgtctcccaaggggccccagctgccccgagccccgcccaggtgccca

SEQ ID NO: 87826 - DNA, 1079 bp, Homo sapiens
gatggacttccttctttcggattcctctgacctgtctgcagaacgagggcattgaggggatgactgacctcaacttttctggccagcacagctcagaggcacatttcagaaacacaggaaacttcatcccagagcccgctgctgccagaaggcagagaggaatcggagaggaggaggcaccggagagaagaactgcatttaatgcccccagacaatctcctctctgtgaagcagggacacacactgatgcgttcacaaaaaaggagacaaaccctgccttcagaggagaggctgacagccctgaaacccgctcagctggctggggagggtggcgcctgccagtgcggcccgactcactgtcccctgcgggggccaccaagggtccatgcagccgagatttctacggggctgggagacagcaggtgcttgggaaaggccgagctctgggctttcctttcccaagccttgcttccctccctctcgccttcctcccagcccagatgctaagggaggggcaccctaagcccctactgggtgcttgacattttctcacagtaaccctccaatggggcatgttcatctcccaaggccattgtaacaaatgatcaaaactgcgtgacctgcaacagaaattcactgtcatggtgtggaagccagaagcccgaagtcaaggtgttgggggaccctgctttctctgaaggctctaggagaggaccattcctctcccagctttggaggtggttggcactccttggcccatggcagcagcattgggtctctgcctccgtcttcacagccccttctcccctgtgtcttctcctaaggttcttataaggatgctcgtcgttggatctagggcccaccggattcatcctggatgatctcagcttgagattcttaactgagtcacatctgcaagacctcttctttttttttttttttttttttttgagacagagtctcgctctgtcacccaggctggagtgcagtggcgcgatcttggctcactgcaagctccgcctcccgggttcacgccattctcctgcctcagcctcccaagtagctgggactacaggcac

SEQ ID NO: 87827 - DNA, 1066 bp, Homo sapiens
acttcatagatcagttacttagcaaattcatactgagtcttattttgggaagtcttcctgagggaagctgtacaaaactgaggtggtcaggttcatctcttcaaagtaccagttatacagccatctaaataggcataacttatggcaaaattataacaattttttttctttgcagtaaatgatacctcatctaagaggctctaatacctaaagagtttatccttaaaagtaaaagtgactttgtaccataaaataaccccaaagccactctctagggtttttattttcttctttctttgtctttatcttttctaacttagttttggaattacgttagctactttggttccatagaacaagttttcaacttggggtctacagttcctacagtgtgctcattgtctcagtgaagttcttttgttttcaaagattcatggtaacaaaatgtattttactgctacaactaaaatgtatttataataaaatgcctttttaataatttggagatgtgtttattatgtgtgaactataattctctgcttccttctgcccttaaggtcaaaggtctgactgaagttaagcacagccctttgattttattcctaatagtaaatggtaaaacgaatgtaactgagaactcagtgtgaatttgtaaagttctaactctactttccagacatttgtgacttggcttaaatcccctaacttcagcagtaatgcttttaagacttaaacgtgttacctgaaagtttaaagatctccagtggtcagtgagaaaataagcccttttcaaacagtcattcaacaaatatcttacaaatttaagaaaattatcctgaattactcttaacaagtcacttagttgttaatgcggcccagaatttatttgagaactcataaacctagtttgtagtgatatattatgtaggtataatcatgcacttcacagtaatgcgtgccaaacattaattcaacaatccaaaaaaaaaaaaaaatgctggttgtgcagaaaattgccctgagtcaaggtcttgtttttcttggggaaataattctttgcatctgc

SEQ ID NO: 87828 - DNA, 1081 bp, Homo sapiens
agtgttgggattacaggcatgagccactgcgcctggcaaatgttttagtttttatggttattattattttttttttttgtgggggagggtggtgagggcaaaggatttgtttttcaaattatgtgtttctcaggttaacaaagttattttagattctctgccatgccagcaggtgttagagagagcctgaagtgttacatatggcagaaaataaatgtctctgattactttgctacctttaaaaaaatctatatgtgtttgcaaaacagcctagggggatctaccacctacacagcatgaattattcataagtcataggtgcacatgtatgagcaagttatttttgagaaagaaactgcctataatataataaacctgtcaggtctttgggtattgtttaatttgtgtgttgttgctgttttatctggactgcatcttggggggtactgggctctgcttctggtttttagtttgcctttgaatttactgagctactagaaagacaaaaaaaagctatttttatggtaatagaatacagaatgacttaggtgtaaaagtacacgtgaagaccatcgtagaatatacagctttggagttttcttaagacacagtccttcctactgaaaaggcttgctcacctttggagaggattgtttatattttcagcctgggttcctttatgcagtcccaacttagaggggagcttcggtttatttacactttgctttgcacgataacttgtatgcgaagacctctttatatctttcagtaggtcagagggctctttgtcctggttgaagtcccaaagtgtcagtgcagctgagaatgtttctcagcctccccctttacagaggaagggtcctggattttcataaatccagaccatgcctgcttcctataaatccatgtatatgacattgtactgtatctgatttctgtgccagtcatctgacctgattctttaaaccccataaaggtactggctatatgtagtagttgtatcctaggtaaatatggtgattaaaatacttctcttctaaattataaagataatgagttttgcattttattaaagggtcct

SEQ ID NO: 87829 - DNA, 1057 bp, Homo sapiens
agcagatttttttctaagtgaggttaattgttcacataatgtctttttacatctttgtcctttgtatcactctgaagttttctttttcttgccagaatatttgtttcactttttaatttcagtgctacttgagattttctttttttttaacctgaaagacgatattttggatgatagagtttgtaaagtgagccttcatgctgaaaaaattcttttcatgatctaaaaatggtcttttgttacgatttgaagaacctcattccgtgtaacatggatattttcttgtgtgtctttaaagggggttttggttgtcatttgggcatatgctttgccaaattgttatagcagaactttgtttttgattaatcagtagttaattattgaccatttaaactaacatgaccttaattttcctttcctcacacagatgtgctttctatccaggtcattttttacacgtgaaataacaaactgctttgtgtagattttttttttttttaaatcatcagattttagaataagtttaggtttaatgtaaacatcaactggtcttttcagttcagagaactgcagaataagtaaaataagcagaattcccactgaataagcattacctaattaaacatagcaacatctaagaccaatttatgaaaatactctccttttttatggaggcattggagctgctgagaaagctaatgaatttcccaactttgggataattaatatatagtattgtgttgctctagtgtagttgattttatgtgtttaatatttttcatgtcaagagcaaagctgcagacgtaaaagatgtttctctagcccccttagctagagcgagccacctttgttaagagtcagggtgtgaagaacaatttcaagataaattttagtatttcaaccattgttattaagaaaattagacttactgaaatactcatttaaaaacagacaccttctatagcattgttttatagtggagttatttttaaaaagggaatcccagaaagaatctataaaaatacaaggttaaaactttaaatgtattgaaagatac

SEQ ID NO: 87830 - DNA, 1443 bp, Homo sapiens
ttgtgcaactataaaaaaaaaaaaaaaaagaaaagtttgtctaaaatgtatttaaaaagaaaaaaaaattgtaagtagcatttacatttattcaataatattaccacatgctgggtttctgtaccagaaatggccagttgatgtacaaatgtatgttatttttgcttaaattcatttaaattttttttaaaataaaggggcagcatcttctaaataagttttatcagctttttttttttttttggtgacacgatgctgcattctaaaacttttatagttttagactatgtatgatgtgttgttgtaatctccatccaccataggatagagttaaaggcattctttgcaggcatattttgtatgccactgttttttgaaatgtgaaaaaaacgttggcatacttagttattttttggacaagctacacttcaagcttgtttttaatgttaatttgatagtgtgtgtttttttttttaaacaaatcaagaagctgaaaaatttttaggattgttggtgcttagtagacttgataactattttaaaaatgcgtgaatttagtaaaattctttttttctcactatgcatgtgtaaatgtttgtaacctggcttccctcttctccagtggtataaagaattgtgccgctttaaggtttgggtttttttctctccagtaaaaattttggtaccttatttgatgtttacattaaaatgtgacattatacgtggcaattcaaatattttgctagctgtcttgtttgaggaacaccattaaagaagaaatataatgtttgtcaaaaatgtatcaaaattcatcagaatctggggcagaaaactacccttgtttttcatgtctttcaattcttctaaaataccccttattgaacttgtacacaatataaaatttaaatagccatcttaaatattctaccatctaaaaattgctttgaatgaattttggtaaaatccaaaggaagatgtttaccctcttgaaacttatggtcttgtcacacatttaaagcaatatatgtccttattttcctgaccttgtaatactacttttatatttcagaggtatctcgaaactacaatataaacttttaaaaaaaaataagatgaggctggggaacctttcgaatgaacccaatcttcctgatgatccattcaaaaacaggtttttggaagaccactttcgataggcaatcctataatcaaagtacatttttaaaatcaggttgtaaaatggcaaaggtaaagaaaaattactgacatttcttctatgattggagtttagtttatgttggccagctacaaccccttttaatcctcagacagtttgggataaaagagtgcctttggttaatggttagcaagctccaggataagcgctgcgtgcctcttgtattcagctctacctttctgctaagagtgcggttcatttgtgtg

SEQ ID NO: 87831 - DNA, 1006 bp, Homo sapiens
agggtagcattgtaaacaaatggaatcccatggcactattacttagctcagtaataaaagctgttttgaccaagagtctggatatgcagctcctttttatttaagagagagcatgtgcctgtttacaaactatgagcagttactagaataaatatcaaagtgtacagttacacaaactagttttttatttttcagcaagccttcagatttgaactttagtttttatatgttagctattccacttctcatggctgttttatgtgtctataagatagggacgtttggttggatgtgttgtgatttcagcattctatggcagaaggtgtctgtccttgtggctatactgtccttgagttcctggagatgagagccagttctgacacactgagtgaatgaggcacatgaacattgctgggctcatccttaaatctgtgtcactgttctctgcttttagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttat

SEQ ID NO: 87832 - DNA, 2823 bp, Homo sapiens
gatttcagtttggaagatacaaatgatataaattttctgtaaagtttaattgaatattctctcttatatcagccttccatttctttctgagttttcgttttcttcctttaagctttctggttcatatgtctattcattgtaaaaaggttatcgtttatactactggtttgtgtatgttcgttatttaatgaaaaggggcttataaagttaacgcctgaaattcatgagagtatatttagtgttctgtatcaccaggagacatggttatcataatctgctctttctgagcccatacccaacgttagttttgtactttagtattcacatatgaaaactttagaatgtaatcccctgaagattgtgactaaacactcgggatagtcatagaaagaaatactacatttcaattttaagagctaattgtcttcattacaaaccttgatttaaaaaaaaagacacgctgcgcagccattgtgatccagggttgtcaggcatagagcacacagtgcagtttagaaaggttacttattctactcactaccgtaattgaatgccttagacaaagaaatttcaattgtgctgattacattcctagttgacactaaattaatttggatggttaacattctagaaaaccaaatcaaattcataatgatttgaccattgaaaacaattgcctttaaagcagagtaaaattaaagatgaattgagatactgtgcttagaaacagatctataaaattatatgaaaaaagaaattaaccagatggcagtactacctcttgccttcctccattcaatagctaagactgtggaaatggaggcactcaaaacttaatagcgagagaattgctctcgtcacggctttcctgcctctccgcacaagggcagccagtccagacccattttcttccctagtttacatcctagtggttccatttactttaacttaatactctcagtgcttacccccacaattttcacatttaattggcttgataatgtctgcttgtgctattttatatttccagaagccatcctgttattgttatgccagttcatctctctgccttctttttaatccagcctccagttcctgatttccaattattgctaacaacagtggtgaaagtacaatttctgagagtcataactgaccacagactgaacagcagatttatcatttgctatccaaaaaagaaaagaggaaaaagaaaggggcaatgaaacaccaatcccattctgtcatttgagacggaacgtggaatcttatctttatatattacattaaaataattatatagcaatgaacccttcctgtgtgccaagaactgctgtacatgctatgcatccttatttaattctcccaacaatcccaagatatggggactgtgggtaattcatgttacaaagaagttaaatcagttgcccaaggtgacactgccaataaaagtcagagcctgaagtctaacccagacagtctagccttagatggaggctgatacctaaccactgctctacactgccttgccattagaattgactctgaatattgatcacaagtatctggcaagaacaaattgaacagcacttgggtaactataaaaaaatcttgacatggctgccacatagatcttgtcggaagggttaaaggaatttgggttgtgcaaatacagggagtttagggaggagaaaatatactaagttaattgggtttcaaacatataaaatattttttgactaaatgaatgagtatgctgtgtcatttgacgtttgactaaaagaaatgcagtggagtccagtcaagagtacttacgttggacaggaggaatcacatcttgccatcaggtctaaagaaaaataaattatgatgttatgaaggaagggcccaagagataagtgtagaatagctgactctgctcaagagggccatgactcaactgcctatactttacccatttaattttgagcggatttgctccttcgtgctttttcttaatctactattatctaaaatgtcaatagaattttagaactgaaaacaactacttcaattcccatattctacagataagaaaacagaatcagaaatcagacatatattgtcaggactatgcagtgaggaacacaactgagttttgagcccaggtcttctgacaccatgtccagagcctagcctgtacccttccccgccctttttctttttggtgggagtagggtggagggagggtttcacagtcacagtatattcttgacaatttttactttatatagtgagatattgctatggagtgaaaagagagaggactatggcacaaggtgcactgatttatgaaatgttctttttctttgtgtagtatgagcccagaggacctggtcggcccttgtaccaaagaagaatctcatctagctcagttcaaccttgttctgaagaagtaagcactcctcaagacagtctggctcagtgtaaagagcttcaggaccacagtaaccaatcttctttcaacttttcatccccggagtcctgggtaaacaccacctcatctactccttatcagaacattccgtgcaatggatccagcaggacagctcagcccagagagttgataggtaagacagagttggtggctaaaactaatctgtactcctcagctcccggatatctgtggagtttttcttctataccacctgcccccaatttgcattatcatctttgaacaatatttaatgatgctaatagctcataggtgtgcaatttaggactatattgattctatatatatatatatatatatatatatatatatttatatttatatttatt

SEQ ID NO: 87833 - DNA, 2543 bp, Homo sapiens
ttatattagttggcaagcctctgtggaattctgctaggtgaatcgtttcccttcttggggggtagctataatttcattcttcttccacagacaccattcctccatccagtctccatgtattctggaaatgtgtcctctattgatgacgaggctcatggtcttgattgttgtatatctataatattcatttattattattttagtggagtcttgggccagttgccaccattaactgggaatcatgcttttaaaaaatgattttgtaatttatcaagtgcttttcaatagattacatcacatgaacccatagatatgaacccacagatattactgttgtaaactacagtttattcatcacacgttatctggcttgttaataaattgattatttttagtcttatagtgatagtcctctccttgctccatctagttttttctctctagggaactgtactgatccaccaaactgtagcgtatttgctttaagcagaaaatgataatttgagggggagctaaattgaaataagttagtagaccctaagtgttctataatcaaggatttcttcctcaaatcttggggaaattaaatagattagttttaagtaaatgaagaaaaaaaatgcagcttattaaatctgatattataagagtgtccatgacatggaaagatacctatgatatttcagtgaaaaattaccaggcagtatgtaatgtctcattttaaattatatgtttaaagatgtacataatatccagttttcccactttagctatgttaagttgatcagtatgtttcagtgatcagatgatgtcattctgatctattgacgttaaaatttctagcaacctttcagattttagcagctgttgatggttgttgcttagatctattgtttcattagaatggcaaaatgattatttaaaacttctttgaatttcttttgtatttatttttcttttataaaggagaacttttcctcattgaatatttaattactacctaaaatatagtctatgtagaaagggaaggataaatgtttaatccttgccctttattagtcaattttcagagtaatgaattgaggccttagcaggcctcaggatgaccattgaggcttttttccccttcttttttcactttgaatattattatttgatatcattatgtatttgaatttttactttattgtagtccttatacattttcacaccttgtcccctatctttgaccaatggaaggttcttcattagaaatattagaaatgttttacattgagtgaaaatggaaatatagcctgtcctaatttgtgtaatgcagctcaagccatgtcagagggaaatttatagcttatattagaatttaaatttatagcttgtattagaatttaataaaagctttattagaaaagaagtaagatctcagatcaataatcaaaacttataccccaagaaattagaaaaggaagagcaaaataaattcaaatcaagcagagggaagggaatttcaaagatgagaacagaattcaatacaattcaaaacagaaaagcaataaaggaaaatcaataaaacccagttagttgttcggaaagattagtaaaattgataaacctttagcaagattgacaaagacaaaaagaggatacaaactacctatattaggaaggagactgggtcactacagacccagtagacattgaaaggatggtaataagggagcactacaaacaactctgtgcacatacattcagcaacatagataaaatgaaccacttccttaaaacctcaccaaagatgaaatagatggcatatggacagtcttataactgttaaagaaattgaatttgtaattaaaaccttccaaaaaagacatctctaggcccaaatggttttagcatggaattcctccaaaaatgtgaagaagaaaaccaccaacttacacaatcttttccagagaatagaacacttctcaatttattgtatatggccagcattactctgataccaaaactagataaaggcaatacaaacagagaaaatcacagatccacttccatgaatatcaatgtaagcatcctcagcaagacattagccatttgaatttagcaatatatgaaaagaatatactatgatcatggggggcttatctctagaatgcaaggctggtgtggtatttgaaaataaattaatgtaatacaccattctaacaatctaaagagaaaaatcacacaatcatatcaatagacatagaaaccacatgcatttgacaaaatgcatggtccactcaggatgaaactcttggtaaactagaaatggaaaggaacttcttcaccctgttaaagggcatctataacaattctgcagctaccatcatacttaatggtgagagatttagtgcttctaagattaggaataaggcaagacatttgttctcaacattcctcttcaacactgtgctggaagtcttagccagtgcaataaggcaagaaaataaatggcattagggattgggagggaagaaatgaagctgtctccattcacagat

SEQ ID NO: 87834 - DNA, 1892 bp, Homo sapiens
caaaagccatggcccttggctgcttggctaaggctggacattgtggtctggcagtactgcctgcatcctttcccacttccggtccttacaggtgtgatgggatgaggaggacaacaaagggcaaagtgccatcttctcctgagccaggcagtagaccatccccaattgccaatagattgataaattgctccaatttgattttaaatgccagtgtaagcttgggattagtgtttacattttctctagacgtttagccagttgtcttcctgtctttttggaattattacattctcactaaagagatgtcactttccaaattctttgcaatagcactgtatcatacttgctccgaggggtgggggtagtgcaaaatgaaatgcagagagaaacaacagaagttaattcttgacctctgagcttccaaaagttcagtttttagtaattttggcatgattaaggatttttcaaaggtaatttttatctgtgtgggatttttcactttgcatgataatttaatactctaacctctgagtaagatgtatttcttcattacatattgtgatctatttctggactttgtgtttttcttcatctataagtttctgtgctagaattatactgttttaagttttgagattttgtggcattctaacccagtagtttaaagtctcccttattactttttcccttccagtttctatatgtggggcatggagtggatgggggaggagggtcattctgtggttttactactaaaaaaaaatttaaaataactttatgaactctttcctcctcctctgtcccacctctacacacccttcttggctttttatttgaaatacattaaacttgtagcttaaattgagggaaattttatctttacaaatacttctcatttaatttatttccttctttcctccctccctttttctctcttcttctatttttccttttttttttttttttctgagacggagtctcgctctgtcacccaggctgcagtgcagtggcgctatctgggctcactgcaagctccgcctcccgggttcatgccattctcctgcctcagcctcccgagtagctgggactacaggtacccaccactgcgcccagctaattttttaatatttttaatatttttagtagagacgggggttcaccatgttagccaggatggtctcaatctcctgacctcgtgatccgcctgcctcagcctcccaaagtgctgggattacaggtgtgagccaccatgcctggcctctctcttctttctttctctctctctcttattttttgaatgttcctcttcaaaaatctgtagcatcttcatttaaatcttgagtatttccaatattcttagagtgatgtgttttgttttgtttttgttattaatgggaccttttttttccattatacttttcagtcattttatcttcagggacaaattctcaaaacgattatgtagcaatgttgatactggtgcaaaggaaagcttttgccatttaagatgtgcttcactatggagtagtttgattaaaagtgctcataaggaataaatagaaaatcctttttgaaggcatctttgtaaaagtctcggagttggcttgtgaaatggctcatttttgtgttgtgatattgtaatggctttctgataaaaatggaatgctagtaagtcacttactttgatcagctttcagtaaatcgacatttacttacatcatcttagagatgacatacatgtttcagtgatgtgtctgctttgaactatttcttgttctgtgtgttggtttttcaacagagacactttgagccatctattttcattttttctttcaaacaactcttgttttaaattagttgataattttaatttcaacatactgttgtctaat

SEQ ID NO: 87835 - DNA, 2803 bp, Homo sapiens
ttgggttaagattgaattgtttcttcaaataatgctagcaaaacccccccatttagtgtgataatcagaaactagttctaaatgctgtatgatagtatccagtggatgtcaggatcatcattatgtaagtgaggaagagttgtcatcatcatcaccataactgatttctggcaaatttagaaaacatttacttcttaccaaaaccaaatttgtagctacgtcctttgtctttgtggagaaaatatgttagtaaaaaactttaaataatgaacttgaaaccccaaattcataaaaaatttttcacaaatatttttgcagatcgtatacatgggagtgtcgctctggaaacattaaggcagcagcaggcacggttccagcagtggagcgagcatcatgcctttctcagtcagggcagcgctccatacccacaccatcaccatcctcacctccagcatcttcctcagccgcccctgggattacatcagccgccagtgagggcagactggaagctcaccagcagtgccgaagatgaagtggagaccacatactcaaggtattccagcggactgaaaatagcccctggaatgcgaccccctcactgttctcttttttgactgtagtccttttagcttcaagctggaatattgcctcagagaaattggatgctggccttccaagcacacgctacacagttctcttgttgactctaaaatacagaaaactcatttagaagtaactcttctacaaatttaggcatggatgatctactatgggttggaaattaacttgttcccttactttgtggtcttttctgcgagagaaacataccatcactgtgagcagctttttttatttagtagtaatacttgcaaagaatgaataaagacaggagtaaattcgtggttaaaagctaaaaattatatcattaattatttttatggtggcacagaattctacattcctataattccagctacatatgagtatttggtcctaactctaagcttgtttttgtggccagtgtcacatgaatgctctgaagtgtttcctaatcccttctgaataaggtccaccatcatggtgaccttttataacttccagttgtcaaagctgtatagagacaaggacagatgtttttaatacaatgggaacagaaagaaatcaggtaattgagcatatttaatttcttcacctcagcatctattgagtgttaatgcttacatctgagatgaattaatgccagttctagttattagtactatgattttgtttgttgaaaatacatgtgtagttgactaagctttccttaatgtgatggagccttttgttttctcctcatattttattgttttcatgtaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagaggtaaatgtcttcttattttccttttgttattagctgattgtgaaaaatatcagtatttattgatttgataataggaaggcacagatcttattgaatttaacagcgtattaaagataatcctttcttgggaattattttaattgccaccctcctattgtatttcaggttttgtaaagtggacacttttgttgaaacatgaagccccttaaaagtcttttattgctgtttaaagaaaatattgaatatctgaggactctattcaaggagctttgtctttttttaatctgaggaaatggcttttagtgattcttcttttcgctttaagttacatgtgttaattataaatttgttaatgagaactttccaaagatgctggcttttcagccagtgccagctccaagtgctgtgctccttctcctgccactcagcctggtgctttgttagacccagggactctgattcccaaatatcagaatttgcagatttttaacataaaattgactgtgctaaactaagcattttaagttaaactgaattttatcttaaaatacttagatatttctgccgggtgcagtggctcacgcttgtaatcccagcacttggggaggccgaggcgggcagatcacgaggtcaggagatcgagaccatcctggctaacacggtgaaaccccgtctctactaaaaatagaaaaaattagctgggcgtggtggcgggcgcctgtagtcccagctactcgggaggctgaggcaggagaatggcgtgaacccgggaggctgagcttgcagtgagccaagatatgccactgcactccagcgtgggcgacagagcaagactctgtctcaaaaaaaaaaataaataaataaagtaaaatacttagatatttctaaagagcatctttatggacttttttttcctatgaaaaactt

SEQ ID NO: 87836 - DNA, 1038 bp, Homo sapiens
aggaggcagaaattgcagtgagccaagatggtgccactgcactgcagcctgggagacagagttagactctgtctcaaaaaaaaacaaaacaaaacccaaacccaccctgaaatcagaaggaaaacacattttaatgatttatatcagaatgaaataaatggccatctttctaaggaagaaagtgtgaaattaaaaataatgccctgaaaggaattaaagtagatatgctaataaaatggcagtatcttttcttatgactcacatttaatatgctgttttttttctgtcatctttttaaattaaaaaaaaatttcctttatttgattgtgagaaagtaaataattgagcactcagctctcctgctggaagatatcaatgtatcatatcctttagatgtgttagggttgggaaaaggtggagagcaactgaatttgaatcttctgcagttaaaaaaggcttcttctttttttctaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggag

SEQ ID NO: 87837 - DNA, 1074 bp, Homo sapiens
acacctgattatgacctccttcatgtgaccaaactatgcatatcaacaatatcttctggaaaaaagtatatcccagctgaatataattttagtcattgaaaagatggagatttatggaggaaaatgtttgtttatgaagaaccttaatcaggttctgagacatctgaagagcaggcattgcatacttgggaaaactgagatagaattgtcgtgcttctcacttctttttgtagataatttatacatactcagtaatcttaagggcctaaaattggccaaatttaatggcaatccatttgagctagatgattagagatgaggatgcacttggcacacaatttgcatcacaaccatttgttgcaacaggttggtcaccaagtgtaccccagctgcaactcaggaacaagctgcttgttctgtttttggggagtggtcagttctatggctaatttaagagcctagggtgaggcaagtgctctgcaatcctcagtcactagctcatcagtgaaacttgtaaggagattgacgtgccaaatttatttacactccaagtaatgcatggagtgttttgacagagccggaaaagaaaaattgcctctttccatcttatattttatttttcacattgtcatcacttatgatcaaatttacatttcagaaggatgacaacactccccagcttaaaaactttttgtagttatcacagtttatggaattaaaaacaattactcagtattgaataattcagggtctcatgtgattgggctcttgtagtttcctctgatattgaaaagggaaaactaatatataaacaagtgaagttatagctctgcgtacacaaaacttcccatgctgtccgaatctgccatacttttcctttcttcaacctttgcataaactgttacctttacctagcatgtccttctctccttggaatattccacctctttttgtaagattcaactcgaatgtcatgacctctgtgaaaccttccttaattttctcaggcactacagttgcatcctcttacagtacctctagtgatatgtttacatattgttatcttctactgaa

SEQ ID NO: 87838 - DNA, 1075 bp, Homo sapiens
atttttttaaaaagataatttctttaaccttcatctcctttatagctactgcctcatttctcctttcttcctcacctcttatttgctctttaatccacatagtctacatttcactaaaactattgtgctcttacgaacatacttcaaatgtagtcttacttgacttttcttggtattaggcactgttttctacttctgtctttgaccatcttgtttctttcgttttctttgacacatttttacttttcacaatctctctaacatgacctccgtcttttttaaaaagttcctgctcagcctccccaagcatctgtctctagtccttaagctgggatttctcagagttctgtcctagtcccacctgtcttgcattctatggtttcttactataaaccagtgcaatccataattttaagtatccacttcatgataccgacttccaaatctgtatctccaacctcagcctagttttatttaagcagctattctctttattcagttacttatatcacataagcatctcttactcacagcttctatatatggaaggattcagtacccactggaggggctgcagtacaaatgaggcagccaagggaacctcctgatagataagtgggggctgcagtgaaagctgaagtggtacgtgtttgggaagtggtgcagagagagaacgagtggcatgtcaggatggtgcacctgcaccagcagcacatatagtcagaggcagcttgggacgaaaccaatcgcacgagtcttaggtgctctcagagcaactgaagccaagatatctaagtgtctctcatgtccttgttttaaaatttctgttaggattcttctctgttagagaactaggcaacctgaagacatgttttgttttctctcccaccctgatgctttgtcttggggcccaggaaaaataaaagaactagtcctggttcttttgactcagtgcctcctcagtattaagaggaaaatgatagaggagaatctgattctgatagtagcagatgcaggcttcttcagctcttaccattctctaccttgcttagggagccaattgtagtattgtaga

SEQ ID NO: 87839 - DNA, 1922 bp, Homo sapiens
ctttatttcactttcatttttaaaagatatttttgtagggtggagaattcttggttggcagtttttatcatttgatactttaatggtgttgttctaccattttctcacttgcgttttttccagtgagaaatctgatgccatccttatctgtgtttttctgtatgtaacaagtctttttctccctggctgcattatagattttctttttatactggttttatcagtttgattatgatatgccttgatgtagttttcttcctgtttcttgtgtttgaggtttgttgagttgctcagatctctgagtttataatttttatcaagtatgtaaatttttaaactttatatcttttcagatatttttttctgtgttgcccctaccactgttcttcagagattctaattacccatatattaggatgcttaaagtttttgcacagtttatgggtgctaatttttttaacattcttttttctcttcatgtttcattttgggtagtttctatttctgtgccttcaaatttgccagatttttcttctgtaatgtctattctgctggtaattccattcagtgctttcttcatctccgatactatagttttcatttcttgaagcttaatggtaaggtaattctggcatgataattcattttacaaagttccagtggaattccaaaaagaatgttttggaacaagaacctaaatcaaggattccttcaaggaacttaaactatccagtggttaattcttttgtagattaaaagcctttcccatgtatgaattgtctattataactgtgcttttttaaaaccttaattttgcctgctctactatttatcacccacttatacacggtttgatatctattacttttaagcagtataactacattactttctgaatatctttattatgtttagattcctttactaaattagattgaggcgttatttagatttttgcttaattgcatttataagtgaccaaagcattgagcctttataaataggcaagaaggcgaaggcctttaacacatctagtttaagcaaatgaggctgtaattcctggagattgggtagtttcctttgggattatttgatgctttaaggtttttcccttattaggctttgccttgtcaatgaagtttgcttcatttgtaagttttctttcttgcagagaaactgtaactctgaaaatttaagaacaaaacccaagtagtcatacactgatcataatgggtgaaaagtgtttaaagtattctgcctctttctctaatattggataagcattggaagtgtcatatccactggagaaaacttataaggatttttaaatattttcttaggtaaaagtgatacaaataattccggacctgaaattaataagattcgaacaccagagaaaaagccaacagaaccaaaacaggtatgctgcttagttactgtgttgtcctagtggatttagtctgattggtcatcttggaatcttgatgttttaaagaaaaatacctccctttgtacacttatcctttatgtttattttttcacagggatatagtgagccatattgccttctctttcttcatcttttctttggctgtgctatttcatgtatcagtatacttttctcaaattctgttattcagtgataaaattgaatttagagattttctatgataaggtagtaaatgaagacagagctacaggtgtgtcattacaagtgtgtcattatcgtgaagaaggagaacttcttcctcagagaggggaagacttactcaggtccctcaccttattctctcatcatacccactaagcccttaattctttatctgtccattcatctattttctctgcttctgtgcttataaactacttagagaaaatcaagtcactggttgaattagtgccactggaagttcttgttttct

SEQ ID NO: 87840 - DNA, 1435 bp, Homo sapiens
actacttaaaaacattactctatcctttgtaagactatagatttttagaggccgtccgtcttgtatataaacccattttctctttctttagaatttttgaatattttgttaatttgctgacacgagtattttcaattcaggagttttagccttggaaacaatttctttcatttaaggcaagcactgtaatttcaggctgagatgatcattgccaaaggtttttggcaaccttgcccacactccagaatgggaaaatgcttagctgcaaacatttctcagccacgttggtcaggatagttcacaatcatgacagccaaggagaatgactgtaaatgagaaatacgtaattcatgcccactccccatagacttcagactttggattttagcagttatttcttccagacagcttggcaacactatacatcatctgctttaaatagtaagtcccttaggatttttatttcactttactaggtcaaagagacttctattttgtaagatttctgagagtttgcatttaacagttataataaaataataggagcagtagctcagatgtcattgtatttattccttttgtgttaatatgcagagattatatatctagacacacttaaacaagttttctgtttttgtattttaaggtggagttgaattaaaagcacagatgacctatttgaattttacctataataaatgaacattaaatgatgtggttactcatattaagttggaataccagttttttgagttgagactccttaggctaagttcttccttaacttttccccctgtctattaaactatgtttctatgcaattatgactttaaaagattatttttatggtaatctgacatgtatacattcatatggaggggaaacaagtaaatactataaaatgatttaatgcctcaaggaataattaccaattttaagccctcagtttcttcctaatctgaaaaatgatctattttccattacatactaaaggtgcagggagctgttttttagccagttaagacacaattgttagtattagcatcaactttgtagttatttattttgagaaaattaacatctgtgtgtgtgtgtgtttgtatgtctttgtatgtttgcttttccctaatcagcagcactctagcagtttgccttccaaaatatacttaatgcatgtattttattttttaataacctaggtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaagttgtacttcgctgttctcctgtt

SEQ ID NO: 87841 - DNA, 1115 bp, Homo sapiens
tgatggaattggtaagtggaaaaattaccctatgaaaacttgcttttatgatgtaagagattttccccaaatttcaccacaagaaagaggagggtggggagatggtttctctctctctttctctctgacacacacacacacacacacacacacacacagtcactttggaacctctcaatttttttattcaacacttagggttttatcagtgcattgatatgttatttctgaaaaggggcaattttgtaggtattcatgtacatatccagaggttttgaggaaaaacatttaagccttttatgcaacataaattttcagaaaatatttatgtcctacaaatatcagatcataaatatttcaagataaaaaatgtacttaaattattttaaatattgcatagtcgtgcttttaaaataattccttaactttcatattgtatgtggttctgttacagttgtaagtcaaaactttattctgaagagttgtataattttttagatagaagactgtttactaggagtgtgtgcatagctttctctcttgaaagacacatcctgagttcctcagaaaatatttaaaattatgctagtttataaaaggaatgctttgtataattcaagttaattttagggagcattataaaaattttttttttttgtaatatgctttacttttccacactgataattctttgatgataagatatcttaggcaaacctgggaaatatattttgctgttgaatgatttaaattattttttctggatgactatgtacagctgttgagtgcatcctttttctgtttatttttcagttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaagtggacattcgaaatactttctattgaatcaagtaaaataggtttcactaaaatggttctaatcccaaatagcattctaccaacttcttttttaaaaaaaattttca

SEQ ID NO: 87842 - DNA, 1049 bp, Homo sapiens
gaggttaatggaccaactatgattttttagggggtctttttctgacttcatgaggcttttttatgactttctgacttcagctgcccttcctcactcataaccaattgaccttaaaccttctgtgtttactgctgatctgaatatttgctctttccaacagttagataggtaggtaaatcaaacatcattgtatttttgcttttgtcaagaatgatttttttttcctgctgtagacataatcccctctttagttttcagatgtaatttacaaatttacaaatttgtgtgtgtctaaaggtaagttgcgcaatgtgctacttttcctcaattggcttgatacgtgttacttttagcccatgggaagagagaattttttttttaatccagaaattcagaaccattgtctcttcaaatactgtttctgcccaaatgtcatcatttttaatggtagactaaatataccattatgtgaatttgctattgcttatttaataaatcctgcactgatgggcatgtagattgttaacatttattacacacataaaccatgctctctgtgcccaaatgcatgattacttcatttggataaatttctggaagtgcacttactgggttaacgtatgtacatttttgatgctgttgatatgtattgccatattgctgtctagcagttagctagattatctcacaagcaaataatgacagttccccttttcctgtttttgtttttttaaagtaaattttatactttaacacagcatgaattatactcaaaacgtcataaatcctaagccatatttgcattctttttattccgttaaaggttctcatcttgaagattaacatttttactttgaaaaacaacctctgtgtttcgtgatttgttagaaaatgtatagagaaactgcaattctatttctgcaaaggaataaaatttaaatcatgttgattgcgtatttcattttaatgaaaaatattcataaaaaaggaattttagatacccttaatttgaaactgagaaaacttgaggcccagcaatattatttgag

SEQ ID NO: 87843 - DNA, 1094 bp, Homo sapiens
cgtatgtatataaattagaattatgtgatttatattcattatattgaattttatatacatagtatatatatgtatgtagtaagtatgcctagaagtacaaattttgtgtgaaatgagttgccatcagttttgaaaacttattatatgggtaataaaaaagatcattttgaattagtgtggataggtgagtactgaccatattacttgcattgttgagccagaattaatggagagcctgttttatatgtactataatacaaggtatgactgtagtttcaaaatcaaacttctggagtcttgtgatctggtagaaagattttatctcaatcatagatgactattgggtttaaggatttgaggttgggggtggaatttgagattatctttagttatttatattcatttctgtgatctcatccattgaattgtaatctgatcttgtaaatcttttctgtaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggtaaagcctctgttaatgaaattgaagaggttaaagggagaaaacttcgcagaagtgccaaaggtttattgggatgcaagttactttaagtgttggaattgaaggttacatttggcggcaagcggtttctgcaaggagcttgtttagtgtggacatgtaagtgaaaatacagtatggtgtttagtcatgcttaatgttatgatcattctcaaacaatttttaatactgataacttctggtatcatttatataaaataaccttctaatcctctctactgatagagttgttttagtgagatgtgaataaaacaaagaagtttaaaagattatcacacttactaaaacatgtccttatattctttataaggaataatgttataataacgatatttgtataaagcaaataattctgaacctttactgatgaccaat

SEQ ID NO: 87844 - DNA, 1057 bp, Homo sapiens
aacaactagaaactattaggggagtaaatggatttaagaatagtgttccggccaggcgcagtggctcacacctgtaatcccagcactctgagaggccctggtgggcggattgcttgagctcaggagtttgagatcaccctgggcaacatggcaaaaccttgtctctacaaaaaatacaaactttagctgcgtgtggtggcatgtgcctgtggtcccagctactcaggaggctgaggtgggaggatcgtttgagcccaggaggttgaggctctagtgatcacgccactgtactccagcctgggtgacagagcaagaccctgtctcaaagaaaataaaaaaaagaatagtgtcaagccacattagttttgggctctccttataaataactccaaatatatttaccaacctgaatatttttaaagaaaccattacccctttcttaaagaatcatattatactgtgaattgcatgagatcagcatttttcatccattgtcttgacagaaatcattactttcttagagcaaatgggtgaataattcttcctgaggccatgttctcagaattatccagggctaatttttaacttcaaagctgagtctgcagttgcctgtttcttactactcagctgggaagtgtcaaggtatatacattaattgataagctaagcagaatattttcagggaagtaaatatattatgttgagtgaaaaaaaaacatacatttcatagttacatggcaatgttgattgtctgctttatttgtacagtttaatcatggctgtagcccaagaattgatagttggggcatatggatatttaagctttaatctcactaatttaattagatattaatttactctcacagtacaagtaagctcagagaatataatatgattcttgggtcctgtaaaaatggaagagtgagttctttgtagtttgagttcattaggactgttttcctgcttttttcatttaatattttcaaaaaaactaatatattcccaaatatcaatcaagtttttaaggaatacttactgtgtatattataccagttca

SEQ ID NO: 87845 - DNA, 1451 bp, Homo sapiens
cttttggctattgtgaataatgctgctatgaacgtggatatacagatatctgtttgagtcactcctttcagttcttttgagtatgtatgtaagcatggaattgctggatcatatggtagttctctgcctaaatttttgaagaactgccacactgttttccacagcagctgtaccattggacattctcaccagcagtgcataagggtttcagtttctccacatcttcgccaatgtttgttatttagcaataacattttaaaaaatgcaatgcttttattatatcagtggttcagaatgacaatcttaagtcttttcttaaaaaattttctttgtaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggtaattatgtgttaatgttgagacattaaaggggaaatgtgacatgatttgtatccctatgtgtatatttattcatatgaccttctggctaattaaaaacaggtttattgtagcctgatatccagtgggaacacaaaagcatattactttggatctatttattgtatgcataattgtgtattcattgagccattattcaagagatatttcctgagtgacttctaggttctaagcactcttccagcttctgaagatacatgagtgaacaaaatagacaaagatctctgcccttgtggggcttacattttattggtggggcttactttttactggtaaggagaggaagattaccgtaaactaaataggaatattatatagtattttacatggtaagttgaatggaaaggaaaatattaagaggaattaggaatgatgaggacggtgcagactagcttgtgattgtaaatagcgtggtgagagcagacctcactgagaagctgacttggaagtgagggagaagctatttgggttaaaagtgctccaggaagaagcaacaactagagcaggggtcctgagctggtttcatgcatgtgtttgtctttgatggatattaacttttatatcccttagtgcctcactttttcacttaattgttctaatttttgatgaatttccttctgtagtcttgctctctcaaggcttctcaatgtagataattctttgtatctggttaatccagaagatcttaacattagggggttagacgtggtcattacttgtctttcggtagcattattagtattcattagactttagttttaaggaacagtttctactaaatatggttaaaatatcaacctacacaccaaaatctttctttatacact

SEQ ID NO: 87846 - DNA, 1057 bp, Homo sapiens
ggtctgcttagttatatcagtgaggaaggggacaatgttagaccttgtactgctgggacttagtgatgtcactgatgacaggaagcttctagttggttggttagtttcattggcctgatctggagagagtggactgagaattactggggctgtgagaacttgccttccctagaatcatggcctgtctttttcccacacaggaacttgagcttgttcctccctacacaggaacttgggggccaatagcattgtccctgattttcatgttttcactggttgtattattggagaattttactgtttaaaatgtaaatgaaaaatttatattctcattcagttcacatcagcaaagcattactcccatttaggggtagtttttttttttttttaaatgacatctgctaaaatgggatcctttataaatcagttttagttacgatattattttctccaaacattggtgataactttaatatgtatgtgtgtgtttgtttttaaaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggtaagtgtcaattgaaatgaattcagtcattcaaatgcttaaatctaaagtgtgttcacattggatttttagtactcaagatctcttttctgaagttatgtgttcatttcatatcaagttctttaatgccaggtttggcaattaaaggttgaattcatttacatgtttattaagtttttatatccaaataaaataagtattaacaaatataccttttctgtgaccataattatatcaatgccacatagtatatgtatgctgtgaattacagtcataatagtatataacacattctgctgttatacggtatctgaggatgaatttcttcataaagatttttatgtatagacttttctaagtttatagttaacag

SEQ ID NO: 87847 - DNA, 1139 bp, Homo sapiens
tattttcttagtggtttctttagggcttacaatatatatcttaatttatcagaatctacttcaaatttttattaaatgaattccaatgggctatagaaactatactcctacatagctctattcccccttcctttctagggaatagaaaggttatatttctagacactagaaaatatgcacttaatacgaaagaaggcaataaagaagacacaggagatcaacctgtgctattatatataatatacctatatataacaaactcaatatatttttataattattactttatataattttatgttttttaaaaattctaagagaagggtggcaagtacatatttatggagtttgctgtattaaccttcacttctctttgtggatttgaattaccatctggtgtcattttttacctacctcctttgtgccgttactgtcaaacattacgttgttatatattatagcctaacaatacaattatatacatatgggtttttgcagttgctttttaaaccagttaagaggagaaagaagaaatatgttattatactgtctttataattacccacataattacctttaccaagattctttgtttgtgtggatttgaattattgtccggtatcacttgctttcagcctgaagaacttcctttagtatttcttataaggggagtctgcaagtgaggaattctcttaggttatgtttcatctgggcatgtctttattttgccctcatttttgaaaagtagaatataagattattggttgaattggttggattttttcttttagcacattgaaatatgttttcttactgctttctggcctctattgtttctgttgagaaatctgttagtcttactggaatttctttgtaagtgatgagttgtttttctcctgctgttttcaagattttatttttgtctttgactttagtttttaatatggttgtctgggtgtgggtctccttgtgtttatcttactcaaagttcattgagcttggatgtatagcttagtgttttccatcaaatatgacaaatttttagccattatttctttgaaccttttttctgctcctttccatctttgcgctcctcctgttctcccatcagatgcatgttggtgagcttaattggtgtt

SEQ ID NO: 87848 - DNA, 2041 bp, Homo sapiens
ttctgtgactaaatatataatctatatgaaaagctacatgctgtaataaatatattgacaaacagcatgatggtttgcttatgtctttggctatgttgtacaagtaatctgctttaaaagaaaggaagaaaggaaagaaagggagggacaaaaccatgaaacttattaataagttttaaagtatttctgttagctatagtatgcatctataaaggtatatatctcaacaactcagtggattgtcaccacctgcgtgcagcatgtaaccctaatccacatcaggaagcagaacatgaccagtgctccaaaagcccctttgtgctcctttccagtcactaccctgaccagaaacttacactataaaaaagtttagtataatttaataatattgattatgtcagccatgtgaaaaccatttttaggtttccctgaaagcaattggatagatataattgtatctctcaaaatgtgattcttttattattttcagtcatttgctacagtcactgatgagtcaagtactagatggtgtcttcatcagtaaagcgaattcattttacagttgacggcttgactgtctttcagttgtgtacattgttccagcatctgtatgtctttgtgtttgcatgtattagtacaatcatgggtcacattctgagaaatgtgtcattaggtgattttgttgttgtgtgaacatcacagagtgaacttacactaacctagatggcatagcctactacacatacaggttatatggtgtaaatggcctgttggctcctaggttacaaacctgtacaaagcatgctactgtactgaatactgtagataattgtaaaacaatggtaagtatttgtatatctaaacatggaaaaagtatggttaaaatacagtactatgatcttatgggaccatcatcatatgtactgtctattgttgactaaatcatcattatgtggtacatgattgtatgtgactcatttaaataaaaaaaaattaaccaaggaaatatacaggctagcaaatttcctcataaagtctcatcttgtattgaactgtcatcatttcttcctgttttggcttcgtaccttaccaaaatcattccatttaacaatattatgccaggaccctactcttgttatttatggagaaattcttggtatcacaagtattagatgattggagtaaaattaatcatggacataaggcaatattattagaatcgactgattttttttttcttatgggtgaaattaattttgatgtagattttcccccttttttctttttgtcttttactgcagttatacctctgagcttttctatgagggcaaactgatggccagtgggaagcagccagcacacaaagatttctacccactaactttctttacagcacgaggagaagatgtacaagaaaaaaatagcacagctttttataataatgcagaggtaccttaattctttttgtaaattgttaacattttctcagtcacatcgtctagttttgttaagcatttatttaaagttttgggttgacattgtattgcatattgacttcatttacatgtaaatagtatgtaaagtttattctttcttgtataacattgatttgttcagatgaatctcctatgggaagcaaaaactttgatttacattttgtcttatggtaagacaaaatacatgatttcattcaaaagaaaaaccaagattgttctcaattagatcattattgttaggtatctaaaatagactctgagtaagttttatagtgcatatgcaaatgaggtgtatcattttaaatgaataagacttgaattgcagaattctatgctccaaagagatcacagggacccagacagcgatgttgcaattccatgatgtgctccaacttatataattctcttgcaatttctgactttttaggttcagagagcatgtgagtagtttgaagggtcaggtcaggcagcagaccaaaaaaatggcaacgtcttcaggggctaacaaaccagaaaccctggagttaaggttctgtccgtcagga

SEQ ID NO: 87849 - DNA, 1054 bp, Homo sapiens
atcaaactagtgttatgtgaagtacagatgtaagatgtcaagaagttgttctgataaatatggcaaaacttaaccatcaaaaagcagtacaaatctggggccaggcgtggtggcttatgcttgtaatcccagcactttgggaggccgaggcaggcggatcacttgaggccaggagttcagccagactgggaaatacagtgaaaccttatctctacaaaaaagttcaaaaattagccaggccttatggcatatgcccgtagtctcagctacttgggaggctgaggttggaggatcacctgagcccgaggctacagtgagctgtgatcatatagcactgcactccagcctgggagacagagtgacaccctgtctcaaaaaaaaaaaaaaaaaaaaaaagaaagaaaataaataaataaaagtactcaatactcttagattagcaaactaaactctttacttagcagaaaagaaaataactatagtccttctgcctttgttgctgctctagcgtgctatcctgtgtttatgctgcattttctagggttttttacacacattctattagatgaagctgcccaggccatggagtgtgaaaccattatgcctctagcattagcaactcaaaacactcggattgtcttggctggtgatcacatgcaggtaagtgccctctgagttgctgtgttgaaagtaacttttaattatattttgatgtttaatattctatttctaaaacatcctatgacattatgccatgcattataactttagtacttcaaatagttctgtactaatagtgaaaaatactgttatttctgaagaaaaattactattctgctactcttttttcttttttggatagtctgtcactgttataattttcatgtttatttatttaagttctgttctttatagtatgaatatctgattcttacttttttttgtgaagtgaaatttaaatgatcattcctgtaggatcctggggaattgtaattccccagctcctgtctctattatttgtttacctgaaggagtaattttttttggtgtaata

SEQ ID NO: 87850 - DNA, 1398 bp, Homo sapiens
gtagctatcttgccccaggcattctcctgaactccaaacttatgtattgccttgcttactggatatatccacttggatatctactgaatatgcccaaaacgaaattctgaattcccaccccaaatccgttcctcttttttaccacctttgcaaacgccatcaccatttatccagtttcaaaggcgtggaatcattccttctctcaaattccacttctagttcatcagtaaattctgttggcgttactctcgaaatgcctagtgaatctgaccattttcatatctctattgttggcctaatccaagctaccatctgctcttgtctgcactcttaacagtaaccttgtaactggtctccttgcttctaccctctgctccttcctccgtgccgctcagtgttgtgttggagccaacttgtattggtttgttagagctaatcacgtgtacgacttctcaggttcatgttcagtgaaatgctggtagcttgaaattaccatgacagttttacaccacaaaaatcagcaaacactacaaaccggaatcctctccccttcctagccctggagccgggtgttaaaatatttaccagcacaccgctatccacccccaccatatatgttctgcccagagaaacagaatagtcctttaacaaaataagtcatgtcatgtcactgccctgttggaactctctgttggcttttcatcaaactcagagtaaacccaaggattgctcacaagccctatgtgatctgcctgtgtgctggagcatagtggatacctaatgaatctttgttacatgggtaggttagagatgggtgggtggatgagtagatggatggatgagtcatttctgtgtcattttaataatccattgcgtgaggcctattaatatttttcttttgcaaataatggaagtacttaagactttccagttgttcaaactttaaatttattcttaaatttccagaacctcagacagaggtctacttaagtataggtataagaatatattctaaaataaaatgaaaataacctttgaattcctgttataagtatgcaattcactgttttttgttagcataaatagttaaaatatgagtcaatgtatttttgtaagaacgttctagaaaaagataattccagaatgggaatgttttgaacttaaaaaattgtagtgcttataaatcttacgtttatgtgccattctgttgcaagattactctgaacacttaaaaataattaggtgtttattttgtggtactgcatatactttctatgtctgtcatttttttggtagagagtcacagtggttatagtggcaattgtgtgttaaattctaattcaatagagtgctaacggttaccagattcatttgtaacttttcagatattaccatctt

SEQ ID NO: 87851 - DNA, 4730 bp, Homo sapiens
ctcggatggttttagggtaaccatttcatctaatgctacatacattagatctggacttagccatcacctgaagcagttttttcatttatagaagatggaaaattgctggatactggcagaattatgaataaataagccggttaatgctgagggactctgaaataaaatgtttgagatttagcaaatggcaaatttcagaaaaaatattggcatgattacatggtcaaagtttgttttctaaggttttacattttttaaggagaattttgttggtttgagattatatgtcataatataacagttatatatatattgtagagatagggtcttgctgtgttgctcagggtggtcttgaactgctggtctcagatgacgctcctaccttggcctcccaaaatgctgggattataggcatgagccaccatgcctggccaggttataatttcttgaaaactgaaagcgttaagatttttcaaaaataaccaccttctgatttaagtacaatatagcctcacagagagaattttcctgtctaaactctgtcctctatttgagggttattttgcaggcacttttattttaaattttctaagagtttctttacacacccttactattttgattcacatccctctcatttttaccatagttgttgtgacgtatagtattttaacggtagttgtgagaaagaatgctgttgattctccactcagtttgatgtgtttcagtatctgctgtccatttaaatcttcaaaacttagccaagtcatagaagggacactagtaagatagatctcattacagtagccatctgtgcgactgtgacaggtgttctctactttgaccaatataatatgtgtattatttgtgtgtgtgtgcaaaaatattaaaaaacattttattttgtttggctttttatgcctttttaaaaaacttaatattttctacattaagatctttgtaaaaattaggatctcttaaccagggacatacagatttgttcttttcctcttgttttaaaccttaccaacagatcttttaaataattagaatttgaaattcagatagtttccctattgcatttcatttgttatgcaaaaaaacctactacttaattaatatcagtaaaaagttttctgatgcttttttgtaacagagggaaattacatttttgaaacattgccatttctacttaaagacctggcagcagctagattcgaagtatgtgatttccttagattagttaccaaaatctttttgtacgtagtgtaggacaagataaaattaattttgatttacacgttaaaacactctacactgactctgttgggtaactttataaaaagtagctttagaataagcatttgtttttatagatgctatgctatttcagtggttttaatggttcactgaaattcacgatactcgtgtgttatgttctatttattaacgagatgcatgtgtttaacataaatttttattttccatagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactaggtgagagggtgggaagcgtgctcatatttccctggtaggatactacctctgttcttgttttaaatacacaatgagggctagcaagacagttttcatgcagctcttaaacatgaaaaaaagagaaaaggaaaagccgtaaatccaaaccccagagcactaaaaatttgaattctcttaaaacatactgtttttagaattggtagtatagacagtaagttttaaaatagtttttaaatagccatcagaacaagtttgctatggaattgtggtatctattagagccagaagacttgggtttaaatatatgtgtatattttatatgatagacttaaaaataattttggggtacttcctttttaacttaaagagtagtgtaatttcctaaaggtatcactgaataatgctagggattactgagtagggtaagggaattgtataatattaggatggccactgcttttttttttggtattatactgcttgaatagttttgtgttttatcattctttttatttgcaccatttatttcagcaggattctcatttgcacccattctaatagtgctgctgatctctacataaaggattatttacatccatatgtagaagcaggcaatccccaggcaagacctctcaggtattttttttaaggcttattatgtatctgtatcatactttattattcttaagaaaaggtgtctgtaaagattttagtaactttggaaataccaaagtctttatgcattgacatttagaggttatgtcttttgaagaaactgtttaaattaaggaaaaatgtaaaaatctttgactattcatttcttaaacattaagtaagagaaagacatccttttttaagttttgtgtgtattgtttcaacctgagtagattttgatatgtacctctaaaagctagtatgatgaaataatataaatatgataacttaaattaaatctagttcagtaaaaattctaacatattttgcatggcagattagtcatgcagtggacagttctttatgaaaataaaattttggctgtgatcatgcaggtaatttcatagaagctacacattagataaacatgaaatactgaaatgatttctgcaacaaaatgtacttgactggtatttaacaacttttgctaccatttaagagacaaagtgtcaaagaaaatttaaggttgatatagaaaggtcctctgagtatatatggacatgaaatgtacttaaatataggatatgggggaataaaaatccttttcttcagaaaacaataaagaatcatcaaattgttatttattataccatttgctttcattgttatatgaattaatgtttagttttgccattttacaaactaatatgtcatgccctaggttgtttgaatacaattgtttataaattaatttctaactgcacttttgaatcataagtcactaacgttttatttctacttgagctcaagcatggaaaaatgaaattatgttatttaattcttcagtaatcataaccaaagctgtttgaatgatcttagagttccattaaaaaaacaaaagaggaaaaaagtggtgtgacccattaacacgggtttttatgccatattttatttttactttggaagattaagaagcagtaattattttaaatagaatctggttgtatttaatgagaaaatattacatatatacaatcactatcactgtaaatgaaaacatggtatttattgaaggatgcattcatcaataaatagtttgcttcagaatctaatctctgagcttgtaagtgaaagttgagtagttagcatttttgctataggtgttcttactttaatgatataagttgttttgttcacttatattgttggtagagtgagcatgtgtgtgttacataggaagtgtgaccttctcagttatcgtggtgtacttggtgtgaaaacagtggagtaaagccccctcaaatctcggtcgacttagcataggtcatttgacacttggggctgtagagctgttgctgatgaacactaaatccgtcactcgactagcttatatttagctttttccatgtaaaattattttttggaggttataatcaaacatgtggtgcatctagatatgcagaataagaagttatgttcagtagggtacatgtatagttgttgtggcccaagtatcgagactcgccctttaacttacagagagacttacacctgtctgtaagtctcgaaagtggttcagcccaagatggaaaaacatttataaatatattcaaatgcaaatttcatgtgatttcatttagtaaatggaataaagtaagaaaaagcctgacttcccaaatattttctttatgtagtcctgcatttttgccatagtttttctctttgggaaaggtgttaacttgcaaatgtatttcttaagaatattcatgcattgagttcagatttattagcactattattacattaactcattaatttataatttttctaatagacaacaaacatgggaggcatgtgaaatggaatagagaagattagaatgactgagtgctctgggaagattagctttatctgaattgtcccaggatgcagaggaaagaacacaagagggcactaagtgtctgctcatgaccatgaagatgggtgtctctagggagcaaggctcatgaagagtttgctctcttcatgatataggctggaacaggccctggaaagtgctatagtgtgaaaatagtcaaaacattacatagtgaatacagttgtaaatgtgcttaaatatacatacttcatggttaaaatttgtaaaattcttttagttgccaggagttgagctgaacttaaaatatttggagatggagattttagaaaccattttagatcatgtttagtttcagtttttacttcttcactagaactagaagattttaaaatggaatagaggggaaaatatttttgtgtgtggttctcaagatcagtatctggttctggcagatttatggctttgcagatagaggtcatctatggaggggtgtatttcctgctttctgggaaaatggaaggtaattg

SEQ ID NO: 87852 - DNA, 1032 bp, Homo sapiens
aattaccttgaagtttgtttaatttgccctgtacttatttgcctccttatctttatgttattctttttaaaaagtttttaattgtggtaaaatccacataacataaatgtaccctctttaccattttaagtgtacaattccatagtgttaaatatagtcacactgttgtgcaatctccagaactttttcgtcttgcagaactgatactatacacccatcggacaactcatttcccccttcctgcagccttgcctcctctttaagtgattttctgtctctcatataatctttgcccaatgttaattcactgaagatctctctatcctttaagattgagtccagctcatatgctctcttcctcaagcagatgaacctgacccttccatgtcaatattttaacaactatttattgagtgcctgacatgcgctaggctcagttttgtgttttcaagcataatttctctcagtttatcaattaattcgtgaacatttctagacagtttttctgggtaaactctgagctttgtacaggaagagactgcgtcttatttttctttgaataccaacagggttttacatattattcatattcggcacatttaagttcataagaatttcgagtttaaagaagaaaagtttcaattgtaaggccataccagtaagcttttaggcatttttcttgatatgctcacttctgaaaattacattgtatatgatgtagtatatttaaatactactgactgtaagttttaactgcaaaagtaagcaaactttcaagcaggaaaagatttttataccactgtaatttaaatagcaattaaaaggtatctgggtctaggaacatactgagaaactattagttgtaatggtaatgggctcacacctgtaatcccagcacttggggaggccgaggtgggaggattgcttaagttcaggagttagagtccagcctcagcaacatagaccccatctctatacataaagaaataaataggttgggtgcggtgggtcacgcctgtaatcccagcactt

SEQ ID NO: 87853 - DNA, 1035 bp, Homo sapiens
caaagcaaatattattcatcataattatgattagactatgattatactttaaaagaatctctaaacttactgtcccaaacagattcctcccaaagtattctagtgagctgccagcattgatgtttgctttcatgcagtttttaaaacattcattttgtctttcaggttgaacttcagtttcaattaaatcgattacccctctgtgaaatgcactatgcactagacaggatcaaggacaatggggttttgtttccagacatcagtatgactcccaccataccatggagtcctaacaggtacaaaaaggcgatatcttattaaaggaagttaggttaatattaaattgaatatctgtatcaaataactcaagcatacttttataagaaagtttgcctttgcttttcaggagatattggtttagaaaggagagtaaaagaacacttaaaatgaaacatttgaggttcatcattactttttctcagagtctaaatgaattctactgcttttctcaacagccttaatttgataggatgccaagcaatttaggaatatttccaagtagaagttgaatggggaaattagggcctttctaaagtggttccagtagttaatttaaaataatttttatttatttatttagagttggggtcttgctctgtcatgcaggctgaagtgtagtggcatgatcattgctcattacagccttgaactcccgggctcaagcaactctcctgcctcagcctctgagtagctaggattatagacacatgccactgtgtctggctgattaaaaaaaatttttttttgtagacaaggttcttgctgtcttgtccatgctggtctcgaaatcctggcctcaagagaccttcctgccttatcttgccagagttctgggatgtgagctactacacatgtcctaatttaaaataatttttaaagataggagagatttttagaaattatcaaaatggatgaagtacgatagaagaaactacttcagaaactgctctccagttaatggtcgtataaatattg

SEQ ID NO: 87854 - DNA, 1052 bp, Homo sapiens
tttcttcttaggttgttttagtgtgagatgtgtgtacgtgataaagataatactatatttcatataagttttagaaaatgcttttcttttgagatttgttttacttctcttatcctcagtcacatgttggtgtgtgttcaataatgattctactttgaagtgaaatctgtttgattttaagagatacattttcaaaggaaatgtgctttagctgaagctattgtgtccattaaactgtgcatgcctcattgggtcattgtgcctggcttctcagtgctaacagctggcatgacaggcctagtatggggtgcacatttcatcgttagatgggtgctgcttctgttggtgacaggcctagtgtggggtgcacatttcatcgttagatgggtgtggggtgcacatttcatcgttagatgggtgctgcttctgttggtgacaggtctagtgtggggtgcacatttcatcattagatgggtgctgcttctattggtgacacctcagttctgtcgctctgctttagtaaactcagggattgttttattactttgttagatttttattgttcatatagtcagaaatcacatgaaatgaaaaccctatataggtttgaaattttttgaaagttgcactcaagagatggaattgttactaaggttgatagagccatatttctcattagcatggaagtatctttttcagtctattgagtgttcagttggctgtaattctgtcattccctaaaaggttagggaattatgtaaactttaaggatgattttaaaatgtagcatgcaacaatggaaagatggtttttcttcttattaagaaatatctttcttaattgtaggatatattttctagtttaggtatttctgagttactaaatttcaaaaagtacatattttaatatttaagattactaacataattttagttttagcctgttaatcttttatacaaattaattattagtatagctataacctttactagaaagtctataatgtctgcatcttgaacatgtgatgaattttctgtgggaaaagctgcatt

SEQ ID NO: 87855 - DNA, 2450 bp, Homo sapiens
ttttttaatgatagttaattttatcgtatatttttattttatttttttagagacagggtctcactatgttgttcaatctagtcttgaactcctgacctcaagcgatcctcctgccttgacctcccaacgtgatggggttacaggcgggagctactgtgcgcagccccaatccagagtatttttaaagtgcaagtttttaataagcagaccatctttacatttgatggttataatggtatttgtgttgccctttgagaaataaaactggcatgtgaaaatggcttttcaaggagcaaaggttagaaattactaagattatttggataagctatttgccactattgagacattaatcttggtgaatgactaggctcatgtttataatatatatgtaacatttaaatgttgccaaatctctcactaaaaaagacatggcaattgtgcattatgttgtcatttcaaagatagtttaggataatttgtactttggagactgatctttgtctaacttttaattatttcttcctaaaattttaatctgagttgtgaaaccgtttttccaattatgttatgtcaaagtcttggtgtaatgtatcagtaaggttacattttttttttcttttggttaagttttcttttttaggtatatgtatgtttcactcaatagaaaagtaatacgcactacatatagagtgagccaacccagtgctcagagtttatgttactatggatttcatcttgtgctggtattgtgctactttttttcccctggtatgtcagaacttgaacagtcatttgttttgacattgtgccctacttacagtataatttaacgaaggctaacctggattttttggaaatgacatttgaatggcattgtactgcattttaataaggacttagcagtgttttacattaatattttcgaaaagatttttgtttatagtaagttgacttaaagatactgtagtttcattgtgctttatcacacaagaaaagatttaaccttttacagtttttgatcttctctttctataatgggatgggtattggtagtaggaagagaaagtgattatcatctgataaaacctatgaagaatttatcatatctttttcacgcagattcaaatttctcttgactgaagagttaagttctaaatgttaatctgtattttaaaaatgttaatttctagtatgtcctagcctgataaaaagttttttttttaaacatggatttatactaatgttattttgttttgttttgttttttgatatgggggaaatagtcaatgggtatttgcattgttttgtttttaagaatttgagctctagcatatacaattctcatacaaaaatatgtaatatagttaagaattttaatgttatttaaaaattttaatgttctgtttctttataaatgtgttttttgtttccatttagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagtaagttactttagaaacactttaaaacaaaaaatctcccctttggatggtatttctaatctttaaaatgaaagtgtgcctaagtgaagacaggtagtaaatggttgttattgaataactgtattctatctttaaaggaaatatgagcttcttaaggcaagaactgtctcatgctcaccatggtatccctgttatttagcacatagttcatttctataagaccttattaaacatctattaggggacaagctctttgccagatgccgggagtataaatccgtggttcctgctcttaagaagctttcagtcaatggtagtcatagcaagcactgaatgagtatttgttgaacagatatacaacaaccgaaagagaccacatattttgaaaagttgttttaggaatgaaattatttagattttcaggaaaacgggttaataaaacagctttatagcagtttataaatacgttaacatattttacattttatccatatgccacaggttaagaccaagtgcttaaatcaaaagcttatttgaattattttaggaaaaataatctcagaaaagaaagttagagtgagggaagattagtgaaatagttgtatttggtagtagctttctattaatatattttagataaactggagacaagccttaaaaactgaaccacaattatgagacctgaatacatttttataagtagttttacttttaaatacagctgaaccagcatatttttctt

SEQ ID NO: 87856 - DNA, 1093 bp, Homo sapiens
gtattcccaactaccaaagttgttggtaagttaagaacatattatatatctacatactgttacatgatcagaaaagtaatagaaaaatagacttaaatagtttgtcaataaaagaaactgaatagaagtatgtaaaaagcatgaggtatttcttaatgctcttactctgctgttttaactttttgttagcctctttcagagagagaaatagggacagttaacataggcaagctgagagagattcaccttgcttccatgtggcagtttgggtgaaagaaaggatatagaaatggatcactgaagcagtagtttgggattactgtgggattttattttattgttaatttgggcagtcaagatttgtaaagccacataccaaaatattttctaaggaagagtgtggtatctgattttggaattaggaagcatttcatctcattctctaagtcctagataaatatagcaggttttaataaattccatatttaacacccatttattacctgcctcttacatgtcaacccttgtgctgggtacttagaacactcgatttccccaccgcttattttcttcttatctaccttccaggtcctgttaaaggtatttttcaagtctgctatactatatacttcaagacgaaacaaacccaccctttggatgctttattagaatagtaaagatgtggttgaaatgcaagcactgctattctcagggtcagaaggccaagggaagttgggaaatgtatcttgtgttagagtagttatttcaaccttgaattctatttttgatagcggaaccccttcaaaagactgttatcttcaaaagattaggtgtattctaattatctttaacttatggatttctattaaaatctgtttatagtttttgcctagcacatctcagggtaacacattccataggtctgtaatttctgtcaggtttgctttgagatttattattgtaagaattggttaataagtcactgttaaagttaaattcctaaatggttttatgaatattgatcctaacctgctcacttctcatctttctgttttttttgatactgagtcttgctttgtcacccaggctagaa

SEQ ID NO: 87857 - DNA, 3054 bp, Homo sapiens
cttaaacaatgaacttgagtcttgactttattgtgtgctctattttggtttatttccttatcttctttgcaaagaacttgattctgatagaatgatgtttttagtagctatagtagacccatttgttaaaatgaagagcagaactaaaccacttgtttggagatttgcctgtactgtattaattaccttcattcaggcagtttttgagtgccatttttgtggtggtggttaattttcttttctctcttattttagctttactatattttgttcttgtcaaaattactgaaaatgaaggtataaaatactttggtctgtaaacagttccatcatcatcttaactgttgacatttattttccatgctaaaagattttgtttgtgcccttagcaataaaaacataacataaattgctgtctgttttcagcttagtgaatgtatagaaggagtaaaggtagagcacaatcctgacctgtcagttactgtcagcaccaaaaaatcccaccagacatggacctttgctctcacttgtaaggtatgaattttgtgctagttaaagcataaaagttgtgtttaattttctgaacgtttttttgacctttgaatctctgtgttaaagaatattgaaaatattttaatctaagtacattatatataggttctatattgtactaaagtatatttctgtactttgatcattaaaagtacaattttaaaaatacttttagatgagatctttgtagatatttagggtgctttcatatttatttatttggtaaagagatctttgacatattgtcttctaaacttgggacataggatggggttcatggcttgtaattaactacttaaaaattgtttattctagtagttctaagatttttaaaccataacaacttgtttttatatttgatatgatgaagtcacaaattctgtgataatgggtttttaatatggggcattttctgcagtgcttcccatcttaaattatagtagtcaaagtttaagatcgaagcaaagtaaaaagtttctgtgagtatgctcagtggaaaagtttttgtcttttttgtggcatttcttctgctgtactttctgtatctggagatgaaaaatctaagaacagttagcttcagccttgaacccaatccagtgctttcagaggtaactgccctcttacgaaggcttcctacttgaggctacatgaaacttctgtaggtgaagagtatggaaagtttgaaggttgatggttatatagggtgatagcttttgccacagtgaaaaatgaacatgtcacaggaagagaagggaggctagcgatatagcataaataaataattttaacaactgattttaaaaaaccattctgatttttttcttaaatggctatagtatcttagaagcttggggaagtaaaagtcccttatggaaatattttcattgaagagcccaattacaattggatttttcacccccttgtactcaatgaattattttaacttccttgtagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaaggtaatatttagacttttttcccccgatacaatgtgttaaaaagcaacattcaaagatatgtattggcccctgaatatattccatggataggaagagaatagtaataaagaaaaaaatcccaacttaattgactcatttactgtgtaatgggcttataatgattcacactgtgccctgatttcttcacagagccaccaggtaaagcttgaactttgaggttccccaaacttgtatgagtagatgatcagacctgttttggtctaccagtttcatttcacagtaagatggttttagcacagtaatatctttcaatattagtttgggtagaatatcattttaatggtaattgtgtatatacctacaatgtttattttcatgtcctattgactagttaactttgctgatgttagtacattgtttctgaatgaaaagtcttgagtataataagccttcataaatcagtttgtgcatccactagtgttaaggaggccaagggtgcctttaatcaaatctgctctttgtttttgggaagaggtccctggtttcatcatgtaagcatgacataaggaattactttgtacattgtcaatttattgcctatatctaaattttatgccaagatccaacaggacaaagaaaggacatgttagcccacatttcctttgctcttggttggatttataggtgttctattctatttaacaaaaactttttatttaacaaacacttcaaaaagcagagctgtgtgaaacttgcttttgtattgactataactaaccatattgtggaggacgttttttactatgtaccataatgtcccattcatgagaacctagaagtagtttttctcattagcgaatgctagaattttattttttttcacatagtgaaaaggtgaaattggtctgtcttcctctttactttagctgctagtaaggttgaaacaacgatggtgcccaaatttaacagttaggtgacatcttcttctacgtgtgctaagattacccagacttcactttacccttatttcccactgactttgatcccttttacttgtttttattctgtagtatgtatttttgtcatcttttcagtactctttggaatcagaataaattaatttccatagctaaatagatatggtagttgataaaataaaaataaagtatttggcttatatatattagcatagtatttggcaaattctttctgcagagggccagacggttaatattttaggtgttgcaggg

SEQ ID NO: 87858 - DNA, 1176 bp, Homo sapiens
cgcaatctctgcctcccaggctcaaatgatcctctcacctcagcctcccaagtagctgggactacaggcgtgtgccaccaagcctggctgatttttgtattttttttgtagagatggggtttcaccatgttgctcaggctggttttgaactcctgagctcaagcaatcctcctgccttggcctcccaaaatgctgggattacagatgtgagccaccacacctggccatggccatttgttaatgtgaaatttacttaggttgtggtgattgaagttgacaatactttatgtaaaaagtagagcataaaatagataaagaaatgttaaattgttttaacctttctgaaaaatattatcttcatgtaattcttatgtagaatttatgaataattcataatgaagggctaacctttcaaaatttaataattatttattaatgtggaaggaatgattaaagttacagttaaaatggtaaactcttcggttctttttgtaagaacttgtaactagtgggatttttagatataaattctcaccgcctctttagattacttttgatagcgaaggaaatttgctacatggttttgattattgaatagtcaggaaactaatgtgtaagtattgaaaatcctagtggtgttatgttgtagaagagacagaacacaatcctatgaaaaggaaatatgagaagatttgaagtacagataagaatataacactttcactttttagggaaataatttaaagccaagcaatagaaagacaaagatttggcccattaagacatattgaaaagaaacataaaatgattttaaatgtgtcttcaaaagtgtaagagaatttaataaatagtataattttaagttcaagtactttgttgtaccatcaggaaaagttttaaatatactcattttttcaaatacggtgaaccatttgaaaattcatattgtgctgtggttcatttcttatttcttactatccatattttttccaattgaaaaatggtctgtaatataacatctctcttttgctatttatagttttatattatatttacatttaattatgtatttttttttatttttgagacagagttttgctcttgttgcccaggctggagtgcaatggcatgatctcggcttactgcaacctccgcctcccgggttcaagcgattct

SEQ ID NO: 87859 - DNA, 1073 bp, Homo sapiens
ggaacttcttctcactgtgcagtagtggaatttgttatgtaagctttccttccaggatacaatgatttttttcatccctgaaggaattcctgatagacaaacatcccatgcctaagaaatgacaagtatgccagccacccgccttgtgttgttagggaagagattgcactggaaacctgtccaccagttgctaggacagagtcagagtcaccagcttgattttaactaactgctgggaaactgcctcttcagtgattcctatgttttatgtagttgattggtagattactttttggtagaggcaagtatgtcatgttcttttttacatcatatgggatgatgtatgtggagggattgtagtatctcttacacattaaaatatcagaattactggctagcctcaaatgataagactatatcctaattactccctagggtcttgtaatggttggcatttccgcccaccacctaggggaatcacaagcagcgaggaatatactttgtgtaaaaggtaatgtgaatttttttgtttttaaacaatgacatgtcttgttgaaaggacagataattttccttatctaatggagtaaaatggtttattttcaatttgaaacagaagccataaaggtcattatcattaagtaataaaagtcaaaaccatattgatgagttctcttcctttaattctaaacagcaatgatctaaatgcaggttgttaagactgttcagtagtcttttattttttatctatttattttttttgagatggagtctcgccctattgcccaggctagaatgcagtggcacaatcttggctcacggcaacctctgcctcccggctttaagtgattctcctgcctcagcctcctgagtatctgggattacaggcatgtgccaccacactggctaattttttgtatgtttagtagagacagggtttcactatgttggccaggctggtcttgaactcctgatcttgtgatgtgcccactttggcctcccaaagtgctgggattagaggcgtgagccactgtgcctggcctcagtagtcttttataataccagttgtatta

SEQ ID NO: 87860 - DNA, 1368 bp, Homo sapiens
agaaggctgaggcaggagaatcacttgaacccggggggtggaggttgcagtgagctgagtttgcgccacttcactccagcctgggcaaaagagcaagactttgtcccaaaaaaaaaaaaaaaaagaaaaaaaaaaaaaggaaaagaaacctctgtaatcagacattttctaggtgttatgaagaggagagtaaagtgaataaatggatggaaggtgctagcctgtgaggttcaagactggggacttggacttctcttctgctgccagctaatttctatgtaggaggcctctatcagcttccttaatgagagcctcacaaatatgttttccatatttaattatagtttaacgtagaaaaaaacaaaaatcattggcaacatattaatgttattaaaaatttctgagtattccaacttcacctttgttttaatattgaaaatgttcaagtttagttcagcatcaacgttattcttgtttaaaaaattctttcatttggaaaattgcagacagcaactagtaacgccctctctggatatcacgtggaagacttagatgagggtaagtgccaaatgctgtgtaacttctggtagctgtgaataagggctttgcttttattaattattgggagaaaatttactgagttacagtacatataagtggagatgtaggagagaatataagattttaattttaagaagtaggtgtagttgaaagcaattttctccctggcaccttttcatagaataatggagtaatggaggtaggaggtaacttcagaggtcatttagtttattttcttgcctccgtgtaggactaaatttaaacatcattcttaacaatctatagagggaagacttttcttctctctctgtcctaagctagtacagttattactttttggaagttttgatctgtgagctgagttgttcctgccctaatgaaactctgtgatctcctctcctctcaccagaggaaagggaaaagaagaacattcattgagtgcctgctgaatgctgtgtactatgggcattggctttcacaaaacatgtactgacttagagtccttctgcatctttttgacaggtgatgaaactgacattaaggtttatgagttgccctaaagtcacacagctagtatagagatgaagcacagctttaaactcaacctggctgaatatctttcttttccttttctggggggcatagtgacttgtgagggagtagaaaatggctataagttccttgaaacttgttgctgctcaacctctataaagttctagcctttttttctcattatccttattttccctggtttatttggaaactcctatccaaacaaatcaaagctcattgtattcacaagtaagt

SEQ ID NO: 87861 - DNA, 1058 bp, Homo sapiens
aaggtgaaaggtacatctcacatggcggcagacaagagaagaatgagagtcaagtgaaaggggtttccccttataaaaccattagatgttatcagacttactcactaccacaagaacgatatgggggaaattgcccccatgattcagttatctcccactgggtccctcccacaacacaagggaattatgggagctacaattcaagatgagatttgggtgggaacacagccaaaccatatcacttagtaaagacccacaggtgacttgatataaggcaagattggcaagctgtcagttggttcagggataaatgagacaagcggtaatgagggctttacctaggacagtggcagtgggaggagagaatgtaagagagatgagagacattctagacctgtttggacaagatttggagaatattcagagcaggatagaagagggaggagttcaagatggctttgaaaatttcagcttggctctctttgggtaagaagaatccattaacttgtgataaggagcactgaagaaggatcaactttaggataaagttgatgaattttgctttgggcccattgcatttaaagtgcttaggtgaatcatccatttatccatccacccacccacccaaccacctacccatgttcccatccacccacccatgttcccatccacccacccatgcacccatccatccatccatccatccatccatccatccaactaaccaaccatctatctgtttatccacccacccactcatccaacatttactgagcacccattattatgtgccagatactttgagaggtgcaagaatatagaaaggcagttacagactgctgacagcagatgtgtatatcgctgataacgatctagcatgtaaaatactacagaatagtttagaaaaagtgctatggttggcgctttgttgaaattggaagtgtagagcttagggtaaagttagagccaaatgcgctgattggtggtttatctgaggatgttagagtgaatggatccctagccttggactcctctgtgggagaagggctcatctcaga

SEQ ID NO: 87862 - DNA, 1051 bp, Homo sapiens
tggccagagtagagtgcacgcggtggagaggtgggaggaccaaagcctgtggggcctgctggctcgtgataaagactttggtttttattctctgtgagttggggagctattgcagggctttgggcagaggagtggtgtgatctaatttaacagaaattgtttgacttttgtgctgagaataaactgtaaagggataagcgttgatgcaaggagactagattggagactattagaataatccaggccagagtggctcagatcaaaatggtagcagtggagatagtgagaagtaactaggttttggtttatacattgaaaatagaagcaatcaggtttcctaatgtattgaatgcagggaatgagggggagcagtcgcagttacttacctcgatactttttgtctgagcaattggaagaatgatgtttccttcaactgaggttagaaggctacagctggggaggaggttttgtgggggaaggtgggagttcagttttggacgtactgagtttgagatgtcattcagatacccagctgaagatgctgagtaagcagtcagatatgcacgtatggaatttgggagagagattcattgaagactgtgggatagaagtgctatatgatgtcttgagccagcgtagaatcaccaagggaaaatgagcatcatagagaagaggcgaggactgagggccgagtcttgggctgctgcagtgtcaagaggttggggagcagagcaacaaccagcaaagcaacctaaagagcaaccctgaggaaaggggaaagtgtgagaggaaggagtcctggtagccgcgtgaaggaaggaagtgtgtccaagtgaggaaatgaggagtagtgtcagcagctgccaagaaagccatgagaatgtgtctgagtgggcacatgtgaatcgtgtgggtccacatggatgcagtggaggtcactggtgatctcttgagagtggcttccttggagtagtgggtgaaagtctgcttaaaaagagggcttaggagagaattgggggaaggaattgaaatacatcaacatagacaactc

SEQ ID NO: 87863 - DNA, 1739 bp, Homo sapiens
tttcatcgtgttccattgcctgtggaataaaacccttgcttcttgttgtggcatttgaggtcattcatagcttctcttactcctctgatgtaccttgagtttaggctgtgtattttctccccttggtgatttcacttgaactcgtctctctgaaaagctcacatttgctctccctgtcatctgtatggtgaactcctgttcaccttttgcaatcagctcatgcctttaggcagatggaataagtcttttttgtaattgttcatttgtgctttgcctgtcttgctagaatctgagtttcttgaaagcagagatgacatgccctgtctttgcattcattgctgctagcacagggcctggccctcgagaaatgtttgttgaattgaattaatggacagttcatacagttccaaccagttttttaattggtgggaaataatcctgcatggtatagattttggttttttgcaatcatggtcacagaactgtgagactgaaattaggaaactgaaatttggagatttggatatgaaacgtttctgtccctttggttaagaaaggggatcctttatggtttgttgtatactttgcggtattcacagtcatgtttcatttctaaatttgcctcatttataaatttgttatattgttggtatgatcctggcttatgattgacattttgcttgaatcttagtaaagacttcataaaatatcaaagagaagtatagattttgtagcatcaatagctgctgcttagctgtgaccttgatcaaaaggctagctgagagtattcagatagataattaagccagctgagataggaatggggctagaatttataattaataagtttaaaaaaccttctcttgttctttctccctgtctgtaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctcatttttgcaactggtgagtaaacactgtcaataagccaatgctgaactatgtaaaatggcctttttcattgaggggtgacgatacaaatagctaattctgggccaaagagatgtgagtgaagtggctggtgattgctgaatatatttgatggcaaggtaactacgtttttgaaccttgaaaactgttctactttagggcattttggattatgcactcactcaacaagtatttattgagtatgtactgtgtactagacactgttctaggttcttgttatatatattgatgaaagagaaagaaaagtctcttctttatgatactttttctagtaggggaacagaaaataaacaataagcattataaaaaataaacaccggctgggcgtggtggctcatacctgtaatcccagcactttgggaggccaagccaggtggatcatgaggtcaggagtttgagttggcctaaccaacatggtgaaaccctgtctctactaaaaatacaaaaattagccaggcgtggtagcgcgtgcctataatcccagctactcaggaggctgagccaggaggatcgcttgaacccaggaggcagaggttgcagggagccgaggttgcaccactgccctccagcctgggcaaca

SEQ ID NO: 87864 - DNA, 1416 bp, Homo sapiens
tggcttttaaggggctgtgatagtactggtggtagtagtaatgtgattctgtgtctacacagataatctggaagcaaaaatcaagaaacaaaaagaatagacaatgttttatagtaatataattttcttggcaagcagtaaccttttctagaagtcagccttttagtataatttgcttgcttttttttttttttttttgagatggagtctcactctgccaccaggctggagtacaatgccgcgatcttagctcactgcaacctctgcctcccaggttcaagcgattctcctgcctcagcttcccaagtagctgggattacaggaatgcaccaccaaccccagctaattttttgtgtttttagtagagacagggtttcaccatgttggccaggatggtctccatctcttgacctcgtgatccgcctgcctcggcctcccaaagtgctgggattacaggcatgagccactgtgcccagccttgcttgcttcttaagtatgggttttttgtttcttcatatcttttaaattaataagcatgttaagtgatttgggaagaggctcaaactcttcaagaaacaatttggaattcttgaaactaagaaggctagctccagaattgctggaaaccctgaaaaatggatcaggaaaaatcaaagtaatagatggaaaaaaaatctcaattttagctgttgatataatttttagaaaattcagtttatctcagtcattaaaacagatggcagaaggcccatcaggatatttcttttatgtatttaaaacattctatactctactaaattccacttattctaaaatttaagagaatttacctctttatgaaaatgattattcaaaagagaccacggttgatgatcttagtttctagttttcttctctgtaggcttagtctctcttctaatgcttcttgcatactcagtgattttatgttttagagaaaaatgcaagtctggctgaatattaagtacagtacaatgagtaaaactactttgcagactattttgcctgtgtatactataggactatatagattccagttttggaaaaatgcagatgaactaaaaggtaataaaacatgcctctttgtgacttgacatgctaatgagaactgaatttggtacaggacagttcttggtatgcttggcatttaggtcatctttgggaaatttaattatttatggaatggttttagtgaattgaatggttgtcatggggataaagatggtataaaatggattctaatttataagatagttgtgttgggcagataaggcattttacacgatgcatttaactcaagataatagatgattcagaggccaattaattctataggaagtaatgctattttagttttgggaggagagcatcttagagaagtagatgttgaagcattcg

SEQ ID NO: 87865 - DNA, 1194 bp, Homo sapiens
atctgctgtgagcccctttgtatcactgctcctctgagtggttctcaagttcttgtgatggcatgtgctgggttgaagcaggacactgcttgaggcttgaccatttgtgggttctggcttctgttgtctctctcttttttttttttttgtgagggagtctcgctctgttgcccaggctggagtacagtgacacgatctcgactcactgcagcctccgcctccctggttcaagtgattttcctgcctcagcctcctgagtatctgggattacaggtgcgcactaccatgccctgctaatttttgtatttttagtagagacggggtttcaccatgttgttcaggctggtcttgaacttctgacctcgtgatccacccgccttggcctcccaaagtgctgggattacaggtgtgagccaccgcgcccggccttctgttgtctctttgtggctgcttggattgctgagaagaccaccactgtctaggccatctttaactcattcagggcataccagtgtgccatggcacaccctttgagaagctctgttctgagggatccaaacatgaaggaaacattgttccgttgacaaggaactaattatctgtagagagaatggggcaccccaaaatgaaaggactaataggaatttcataggtgccattgaagggggccatacaaggtacttcgggattaagtggagggagcgatactgccttcttggggatatcagggaacacttccactgaagaggtggcatttaaatcacaccaccaggaagccgagaagcaaagggaagagggcattctggagggaagtctgggggttatgtcagaaatgtgggtgtcaggaaattgcatatccaagtttcctgggtcctaggatacataaaggaatataatggaaggtaagactgccaataggtcaggactgggttttggggagttttttttttaatatttaactttttgttatttttattttttataaagttaggggtcttgctatgttccccaggctgtcttgaactcctggcctgaagcacttggcctcccaaagtgctgggattacaggcctgagccaccacgcttggccttggaatttcttgaatgttagagtaaggatgagtatgatggattgtagggaagagaactgagagacagggcctttagttgggttcatagtagtctaagtgaggg

SEQ ID NO: 87866 - DNA, 1010 bp, Homo sapiens
taacctctgcctcttgggttcaagtgattctcctgcctcagcctcccaagtagctgggactataggtgtgcgctaccacgcctgactaattttgtatttttactggagatgggggttcaccatgttggtcaggctggtctcgaactcctgacctcaagtgatccacccgccttggcctcccaaagagctgggattacaggtgtgagccactgtgccgggctagcttcagctcttaataaaatgactttccatcctcccttttgcactctggctaagacttaaaagaatatctccagctatttttttactcatctggtttaagctggactttttagctttgtgttttttgtagttaaaaaaaaaatctatctacattttgcttttaattgttctcaggtctcctggcccctggttctttgattgtctgagtccacactgccttttaactgatacagtccactgctaagtcagcaagttagccttgagaatcccagagactttaatgtggcaatattgtatatttttagggtttacagtgaaacttgggctgactacttgctgattggttaaagtaataaataagtaaattgttaaagtaataaatgttaaactaataaataaatcaaaaaaattgttttttttcgagacagagtctcactctgtcgcccaggctggagtacactggtgggatctcggctcactgcaacctctgcctcctgggttcaagcgattctcttgcctcagcctccctagtagcttgggactttgccatgttggtcagactggtctcgaattcctgacctcaggtgatccacccgccttggcctcccaaagtgctgggattacaggcgtgaaccactacgcccggccaggttctttgtttcttgagtgttcgcttgttttgcatgatttgtctcccacgggttcatagggatgatcagaggaccaattgaggcagttggctggtccttgaaaaactggggtttgggttagtataggtcatcatgacc

SEQ ID NO: 87867 - DNA, 1013 bp, Homo sapiens
ctcatcatctcctttaattctcatagcaactcacgagatagttatttccattttacaaaggaagaaattcaggcttaagtgtgactcaactaatgtaacgtcacgagaccagtaaagtagtggagctggtgttcttcctggaaagcctgtgctcttctttctctagctagtctaagtgacttattttccagataaggaaatataggcctgaagaaattaaatgagttgctcaaggtcacacagctcagtagtagcaacattaaaccaagcttgtttttaatctttggaggcttatctcaagactcttggtctagtgctggtcatgctacattttattgaactagtgtggaccaaaagaccatatgctgggaatattggatacaaatgctttggaactgatatcttggtgaatggtgttttctactatgtattaaaaaaactttcttctttgtctttcagaaattataaagagctctgatgggctatttgggtgatacccagtgcagtgaactgcaggtgagtaaggtttagaactttatttagaaaacaagaattttataatgcctgaaagaataaggtgggacaagggtgaagtgatacagggctgtagtgaaacagtggtaacctgaaggcacagatcctaacggaatcggttacttctggaacagactgaatgatgaacaagctccgaagagactgcctgctgccttgtcaggttagtgtgtgaaatgagtgagggtaggttaatcttccacttctgttcagatgagtaactgcataggggctcagcttatctgcgtgctattggaacttgagaggtccttcagtttttgtgtcagcattcttgagtggcgattactttgtgctccagtgaacttggttaagtattgaattgtttttcctgttatctgctatttacatagtgtcatgaatgactgtatatatctgcagttttgaggatctaaatatggagaacatatcaatagaaacaaaaggttgaactttttttccta

SEQ ID NO: 87868 - DNA, 1059 bp, Homo sapiens
acctacaagtaagtagcccagatcttacagatgcatgtgttctctatttaagcagtaggcttggcattaatattgaatgtagattagtctataattgtctgtcagagaccctaagatccaaatacaggccccatacaagaaataaggacctttgcctgttgtttcaaatgtatagaagatttcgggccaggtgtatcaacaacagttatccaagagatggggaggaactacttaaaaaattataagcaaatttttaggtttaattttcataaacttaggtgaatatacatgcagatgtaattggatttctaagtaatgttttgaaatgttttctagaagaaaagtgatacaagtggagagtatgccatactatcttaccattcatttcagttgatgagtgcagtcagggttacttctgtagcattggctagaagcagcatataacatgatggtttattgctttgagggtggctgggataatagttttcagtaatcttgaatctgttagaagtgaatattcctctttttaaaagaccactgtagatgtaacaggaagaattttatttatatatacatgtaataactattttggtcaacttttaattattcaaaagaaatggaaagtttttcaactaataccaacagtcataccaacttgtttacttttgtgaattgtactgggtcagtttctccaagtaagagcaggaagttgtttggtaaagcagagtgtatacatatatcttgtctttgaacaaaaaagaacttgattcatcgtcaggttcttcaaagaatgcatggcatctttgttgactgaactattctgaagtgtgaatgtttgtgatttttgtcatttctgtgctatattttaggtgttcttgtcacatctgaatttgcctttttgcttccttctgcagaaattatctttgttgtgatgaaaatgtcctataatgcgagcttcctgtcagtaggcaacgtgtttaactaatacagttttaaaaaattatttacttttatgcaaaactcctgtatgcttatggtaaacaaatttgagcagtactt

SEQ ID NO: 87869 - DNA, 1032 bp, Homo sapiens
ttttgtttgcagttcaaaaattgtcattccttctccctcacaacttaacacttctcaggcaaatcattaatataataaaaagtgtaacttcagagacagtggattcctggagcgggggaaggagggaggagttgtctgtcttgcctagtttgttcttaattttgctctctcttaaactcatattaatgaaatttcctctccttcatttctttatgtttttgaaagtaaggtcagtctgtgttgaaaaagatgattttattatgtttttgagttttaagagcattgtataatctattcttttaccttactgaaaggaaatgttttaaggtcaaaaaccagactcatttgcaaagctgcacactgtaccatttttgtaactttttccattttaaatgtagatgccctttcacttcaggctgataaaatgtttgctactgataatgtctgttactggtgttgtatggaaacatcttttctatttgcctcaggatttggatgaagtaatggatcactaatgaactacagtgctggtgagatgtgtaaggtgagactgcagttaaaaatgatttcctttttttccttctttattttaatcaactggtaagagtaaggctgaaactgagtaatttgatggggccatctttgttttccaaatgtatcactcagtcagtgggtctatgggcagggctagatttagaaaggaaaaatatgttgaatgtaccaatcttttcagttgctccaacatactcaaacatagtggtacttaactaagagccaaatgttacttgcagctattcttgatcagtatcttcaccagggataattatagtttgcctattcaaattttcttgcgtaactttacttggatgtcttaattttatttgtgttttggtgtctatcacctactgtacgtttagtcccggtgattatgtatatggattttgtgtgtacctggtttgtgggactcgtaaagtataccctttccgttagaaagaattaggcaggtcaatcactcctgcttttattttctga

SEQ ID NO: 87870 - DNA, 1133 bp, Homo sapiens
cattggtgcgatctcagctcacttcaacctctacctcccagggttcaggcgattctcctgcctcagcctcctgagtagctgggactacaggcgtgtgccaccatgcctggctaattttggtatttttagtagagatggggtttcaccatgttgctcaggctggtcttgaactcctgacctcaagtgattcacccaattcagcctcccaaagtgctgggattacaggtgtgagccaccacacccagctgagtgttactaactcttaagaatgaattcccctgcatattcttggatgaagagttcagaaaatgcttttctgaagttttgtttattgtctgtaatttatcctgtcttaatccaatttatctttctctcttgcaggagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagctatcagtcatttagtagaatagaaaagcaacatagagcatacaagaacatttgggatagagttgtgatttgtgaagaatttgtactttgatattgtggcggaaagtctag

SEQ ID NO: 87871 - DNA, 1050 bp, Homo sapiens
ttggtctcctggcctcaaacagtcttcttgcctcagcctcccaaagtgctgggattacaggtgtgagtccctgcacccgatcgatctccaatcattttttagattttagcctttaaaacatttgtgttataattagaaaatcttaactttagattcttgcactcagcaaaaatatttcagtacaattataatttttaaccactagttaagacaggcatatattttgactatatatttaaagagctgtgtagaatattcatagtaattcagaataactacagaaaccaaaatatctaagtatttagttttgttattgaaacttagaactagctttgctccagtgatggactgtagaaaaataaaagctctgagtctaacattttaagtaaacttacttggatatgaaaataaatggacttttagacttactgacaaatgttacgtgttctccctgctctctatcctctccccagaatattagaataatggccaagtattatactcggataacaatgaaaaggatggcacagcttctggatctatctgttgatgtaagtagtaatcaactttgagttatttgtaggcattccttttgaatgttgacttgtaaaaattgagtaagaaaatcaatgttatgatttaattttatgtttaggtaatagagtaatagtttcccaagcaatcttgagtaccaaaaactaacttaagtatcaagtgatcctaggtcttgttggaacagtgttgtctttaggtccatgtttctatgttgacaaaatgcatagcacacaaagaggagttaacccaagtgtgtagtaatggcctgaaagccatttctgtccccagaaggatctgtgacagtttaggtggtaagactcatggaacattagagttggaaggtttgttccttgatcagcttgtcagctcttgtcacttatgaatgagagtaccagagtccttagaagtcaagtgtcttgtccgtggtacatacttgccaagtagcagagcatatattctaacccagcatttctggaaacaaattaactgtaccat

SEQ ID NO: 87872 - DNA, 2108 bp, Homo sapiens
gctcactgcaagctcctcctcccaggttcacaccattctcctgcctcagcctcccgagtatctgggactacaggcacccgcccccacgcccggccaattttttgtattttttagtagagacagggtttcaccgtattagccaggatggtctcgatctcctgacctcaggtgatccgcccgcctgggcctcccgaagtgctgggattataggcgtgaaccaccgtgcccggcctaatttttttttatttttgtatttttagtagagatggggtttcactgtgttagccaggatagcctcgatctgacctcaggagatctgcccaccttggcctcccaaagtgctgggattacagacgtgagccactgcgcccggccaagactttaaaatttgaaatggatatatagttattccatgattgttcagtttttgtcaaagtttccattatgtccagtcttgcatataacttgttgtacaactcttttaggctctgaagagtgttgtactctatgttatcctggctccttttgacaatgaacagtcagatttggttcaccgaataagtggtgacaagaagttagaagaaattcccaaatacaagtaagtacttttgaaattagcatgatatatctcagtcgaaacaccattttgaaagaaaattggctaacctaagtgtatacttctgtgtatacttctttttttgagatggagttttactattgttgcccacactggagtgtaatggtgtaatctcagctcactgcaacttctgcctcctgggttcaagtgattcttctgcctcaaccttccgagtagccgggattacaggcacccgctaccatgccgagctaatttttgtatttttagtagagacagggtttcaccatgttggccaggctggtctcgaattcctgaccccaggtgatccgcccacctcggccacccaaagtgctgggattacaggcttgagccactgcgcctggcctaagtgtgtacttcttaattggttactgatagcgtatactagagaataaaactagagaggataacgtggtggaatttttttttagcattgcatcagcagtaaatgagattataacatactttcttctaaattgcttatcaagtggaagtttcatatcaggtctacatttgcagcttttgattaattatttgatagagtttcatcattagtagtttagagctttgtgattttcagaaatacatacttgtgaaaatctattatataaaatagacttgcttcatcataaacacaacaggctcttatttctgtttgtttcatgagtacatttacattcagttatttcagaaattgacagtgcagaagagagcagagtgttaagtgggagaatgctgtattctgaactactgtgggaaaaatggtaataaagttggtaaaatacacaataatcatatggtgtctcattctactaaataaaatttaacgaaaacagtctttgctgaattttttgaactttgctattatattagttaatacttaatttttacagatttggaatattaagatgtatacaattttcagggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacatgtaagaatctgtcatagagatgacaatttttattttaacctttagtgaatttactttttagaattaaattttggcaattttgagcataaactatttcatttgtcacatttgataaccaaatgttcatttaggatgttatgtgtttaattcttcacttaggatattttttttctatgcccactgtagtagtgatgcacatttggtgttcagatgtttactctgcatttcccaaagcatattggaatgtatctcactcatcttgggttttttccctatttttggcttttcagaaaagatagctatattttagcttgcttcattgtgagagaacctcttaagaatccaaaatttatagtatataaaccagacag

SEQ ID NO: 87873 - DNA, 1078 bp, Homo sapiens
gttcagaatagctttatttgtgatagtaaaaagataaaatcagctcagatatccttcaacaggtgaataaactgtggtatgtctgtacgatggaatactactaagcaataaaagtaaatgaactattgatgtataacttgagtgaatcttacaatttaggccattatacagagtgaataaagacagcctcaaagagttacatactatatttgacattcttgaaaagacaaatttgtagtgatgaagtacagatcactggatgtcttaggagggcttatgagtgggggaagtgtgtgattataaagggacagtatgaggaagatttttggggttctgtgtcttcattgtgatgatggttatgcaaatcactacatgagttaaaattcatagaattttataccaaaagggggaaaatccattataaattgtaattttctagcggtaactagcttttaatgtaattgtcaacactctccctatatacatgaaggttcttattatttaacaaggatgaatattttaatatctatttcattttattgcaattcacaaaattgcaaagtattataaacttatttggggaattactgtgctaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagaggtgagcatatctgtgaccacatgtttactttaaaagtatgaataaaacccataaaccccaatttgttttgtcaacttttttgcagaaattaaagttgaagtactataatttaatgattcagctggatcaacatgagggatcctatttgtctatttgtaagcactacagagcaatatatgatactccctgtatacaggcagaaagtgaaaaatggcagcaggtaagaatatattcgtgtaattgacatggcttcttattcagaagagtaatttgctttttttattttcaaatctttttaactgcaatagttagatgcaattgtatggtgctgc

SEQ ID NO: 87874 - DNA, 1227 bp, Homo sapiens
gggtgtggtggggcactcctgtagtcccacctgctccggaggctgaggcatgagaatcgctagaacccgggaggtggaggttgcagtgagccgagatggtgccactgcacttcagcctgggtgaaagagtgagactctgtctcaaaaaaaaaaagaacaagataaacaggtgttaccacactgagttgataaattagaatccaaaacaaagacttgatgttttcttaggtgttacatgattgttatatgttcagtttctcttaggcatttaaaaatattaaaaatagcttatgggcttcaagtagggaaccactgactgatggaacccactagagaaggaagcactatcatgaaaaggagagaaacaaaactagttatgggtagtccttttcctctagaagaggctgttgatttttccttttctgtgtcaaaaccatttcattttagactagttatttgcattttgtgtgtttttttattgttcattttcatcttttgttttaggaaggaagacttcaagaagtcattgaaacccttctctctctggaaaagcagactcgtactgtgagtagtttacaggggaaagctcagttaccattaatttcattgaacattcttccattaactttcaatatatttttacccttacaggcttccgatatggtatcgacatcccgtatcttagttgcagtagtgaagatgtgctatgaggctaaagaatgggatttacttaatgaaaatattatgcttttgtccaaaaggcggagtcagttaaaacaagtgagttcatgatcatgtctgctccaaacacaaaagcatttgtatttcagaacttttcacaagctcttctataagtctgtttaaaatgtgttaagtcaacgttgtaacatcctagagggtgttttaaaattcagtctacattctcacaatgatatgactgttttctgttttttcttctagtctttatatgtttgcatatttttaaaaattgtgttgtacttagagtgttcatacagctttgttctattttggtattgctacttttattttttccttatttatttacttattttgagacagggtctcactctgtcacccaggctggagtgcagtggtatgattacaactgactgcagcctcaacctcctgggctcaagcagtcttcccacctcagcccccaagcagctgggactgtaagcgcatgccgccacacctggccaatttttt

SEQ ID NO: 87875 - DNA, 1035 bp, Homo sapiens
accactttgcttattaaatgactgagctgctgccatatcttctcttaggagctttcagagatcccacagagtaagccaccaagattctcaagtagataaaaccttagaattttctattttaaggtttattttagcctcctgatgtagagatgagaaaaccgagatccaagaaaagcgactggccacggtcctgagaaatcatatttcgaagcaggggtgtagggatatatgagatggtctgttctattacactcgcttttctcatcgcaaattttaggtaaaaagtctgatgttcccagagacaaaacctgacgctgcaggctggagtggcgagtcccgccccgcgcgcctcaagccccacccccaggctgtccgcggcagtgcctgagtggcaaccagcgccggggacctcgaggggtcctttgcgtgggctcccgatgggctgcctgagcgggtgcgcgggcaacttccggtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggtgaggagaggccggctggctgttggcgggcgccaggggctgagtcacggcgcggagcctgcttaggcctcagggggcctgcgggctggagcgtgcaccccccaatgcctgtccagccctagttgggcctgcacgagtgggagaccccaggtcggcccggccagggctgcggagtacgccagcgcctatagcttcccagaccctccccaaaacagatggtcacttccctccgtgggacttagggctccgtttaactttttgccgtttcttggatgctgtttaagtgatatttaccttagtagtttcccaggggttaaggccgcttcagtattaaggctagatcagagagtttcgttctgttgctgttgctcaatcaatttatgtcgttacatcgt

SEQ ID NO: 87876 - DNA, 1020 bp, Homo sapiens
cttgggcgcagctcccggcacgtccgcccttcgaggctcgggacccggctgtgtcctttcgcaaaccgcctggctcggaaactttctgcgtctcttgtttcttccgccgcggggagcggcgcgcgagccgggagcggcgggggctgcgacgcggccacaggagggcgctccagcacgtggtgccggggccgcggctgccggctgggggcgccgggcgcggggcgggggctcgtcctccaagcgcggctctgctgtccttctcccgatcctgcgaagccgcgagctccagtattcaggaagtggtgactcagataggattattccggccccggcttccctttcttccccttcttcctccccacctttgtggtgattccacgactgctgagcgtctctgtccagggacagcgagggagcccaaagccaagcaaggcaacgtgaaactcactagtgtggtttggtgtggcaacacacatgaaatcagccacccagaccgtctttatatttaaatctggtgcctcgaaactatcagatatgtttttgagccactacttggtgagaggggcgatgtgctttgggagagaaaaagatgcataactgagaacatggctgagctcacaggggctgtccgtatttgccatctggaccaagggttaaggtaagacccaagtacaatccaagacaagatcaaagtagctgcaagtttacaaaacgcatcacggggacacaggctgccaaggagggagagatcagcttccaccagaatgaacaaccgagttttggagttcgttggcatttgaggaggtagcatttaagcagggtctggaagggtggatgccaggtgggtagacagagattcgagttgcatatgaccttgtaagtggagaagcaggacatagctttgtggagaaagagaagggcaaatgaatgggactggttaataggagtctttccagaaaaggtggagattgtcccaccttgtgggcagttgagctagagtaattcagctgggaggcatgg

SEQ ID NO: 87877 - DNA, 2309 bp, Homo sapiens
ttgtgtttttagtagagatggggtttcaccatgttggtcaggctggtctcgaactcctgagagttcatgcccggtgagccatttcattttataatgaagtctagacctgtagtaggtgcagttaagttgtctacctcattgacaaactctaggctagaaccaggtctgatttaaggctcaaggctgttctactatatggaattctccctcctctgagattccttggtggaagaaaatattctcctgaggacccatgtgtaaagcaggtacactggctctactctctagttgaaggtggctggggactccaaccttgtgtctgcttagcgggacacatagggtagccccattggaacctattggaagggtggcccacctcctcccgcagccactcggtcccagtgagcgacctgctcaccaaggaggctccttggagcacagtctgaagatcaccctgcacctgccaccctcgccacagaggtacttgttagtaaaatgagcgtctctcaagagacgctaagcacatcctaatattatctaaggcaggaatccttttgttttcattgctttctttactgtttaaccgttctggccaggcgcggtggctcatgcctgtaatcccagcactttgggaggctgaggcgggtggatcacctgaggtcgggagtttgagaccagcctgactaacatgagaaaccccgtctctactaaaaatacaaaattagccaggcgtggtggcgcatgcctgtaatcccaggtacttgggagggtgaggcaggagaattacttgaaccagggaggtggaggttgtggtgagctgagatcgcaccatcgcactccagcctgggcaacaagagcaaaactctgtctcaaaaaaacaaaaacaaacgaacaaacaaaccaaaaaccagttcttgtttaacagttcctgttctgactgcattcacataaatgtgtatacttttagggattgatttgtggtctctagggatatggtgcacaatgcagaaaaatagaaacactcccctcccctccgagaaaagagaaggaaaggaaagaaaagaaaaacaactttttcatacagaatattattttcttttttgccctggcagggagccagtgcacttcatccaggcacccccagggtccccagagagttttcttgcgcacatttctgagaacggatttgggatcagggtggtgctgcctctggaatgacatgaatggaaatgccaaaatgcccaacagtgttccttgttctctttttttttttttttgagacggagtctcgctctttcgcccaggccagagtgcagtggcgcgatctcggctcactgcaagctccgcctcccgggttcacgccattctcctgcctcagcttcccgagtatctgggattacaggcgcccgccactgcgcccagctgattttttgtatttttagtagagacggggtttcacccttttaaccaggatggtctcgatctcctgacctcgtgatctgcccgcctcggcctcccaaagtgctgggattacaggcatgagccactgcgccgggccttgttctcagttttaaaccattttcctgaaatgcatctgcaaacatatcaaggcagaaattattgaaaggaagagattttaagtttgctgctggcgtcaatacctctgaatataaaggataaagactccttggattaatctcacagactttccccaaggtttcttgtaaatgtaatttggaaaatgttttccttgtctggtataaaaattttattctgaataagataattctataaaaagttttctcaagaacgagcacaattttgagaggttgttttattttattttaaattttctgttgagaagggaccaaggtcagggtcatgcgtgtgatttctgtgtgatccaggtggtttccttggtggcttgttctgggaggtgaagccagttggacttcttggtccggtggggacttggagaacttttctgtcttacaagaggattgtaaaatgcaccaatcagcgctctgtagctagctagagatttctaaaatacgctaatcagcaggctgcaaaaacgcaccaatcaggtctctgtggctagctagcggtttctaaaatgcgctaatcagcactctgcaaaaacgcaccaatcagctctctgtggctagctagaggtttgtaaaatggaccaatcagtgctcagtaaaatgcaccaatcagtgctctgtaaaatggagcaatcagcactctgtaaaatggaccaatcagcaggacatgggcggggacaaataagggaataatggctgacc

SEQ ID NO: 87878 - DNA, 1163 bp, Homo sapiens
ttttccctgacttaaaataataacagtgatgctggtgctgatgaaaagactgatgtggcccttacatcccacatgaatcatcattcgggattattgtagcctccataaaagtgacgcagtggatgaaagtggtttttctcaatacttaaaaacactgtgaaaatgagataggtttaaagatataaatgtgattttttaaatcctgcccccccacccaagtgccaggagtttggtaactagaattgcatttagtcatcggggtacagattgtactgtgcgggctggagactcaaaccctgggctattgaaggccatgacaaatgctcattttttaatattatgtttttgctgctcatgaagaagcatcatgttcaaaatgaaaaatctttagattcaggacttaatagttcacctcttttggattgcgtttgacggaaacttggacacagctgagtgtaattatgcttttcagcagcatgacttatagtactgcagatatgggcatactttgagatttttctttttgccaaaatttgtctgaaaaggagcttggtggtggttgtgtgtgcttgtgtgtttttaaggtaattaggctattagaggtccaaatggaataatccccttaagccttttcaggaaaaacactttggaaaggttaagtaaatttaaaattagccattatttacgtaggtgctcagccttttgaccatgttctctaggagttgtttcttttacatttaggttatgtttgtcagaaaccatcttattttttatttttatttttctttctttctttatttttgagatggagtctcattctgttgcccaggctggagtgcagtggcgtgatctcagctcactgcaacctctgccctcaggttcaagcaattctcctgccttagcctcccaagtagctgggattacaggcaccggccaccacacctggctaatttttgtattttagtagggacggggtttcatcatgttggccaggctggtcttgaactcctgacctcaggtgatccaccagcctcggcctcccaaagtgctgtgattacaggcgtgagccaccacacctggccttatttttattttttgagatggggtctctctgttgcccagactggagtgcagtggtgcaatcactgctcgctgcagccttc

SEQ ID NO: 87879 - DNA, 1015 bp, Homo sapiens
tagctgggaccacaggtgtgtgccactacactgggctaattaaaaaaaaaagtttagagacagggtcttgctatgttgcccaggctgtttttcaactcctgggctcaaggaatcctcctgcctcatcctcccaaagtgctgggattacaggtataagccatttcacctggcaaccatcttatttttttaaatttatttttatttatttattttttgagacgaagtctcactcttatcccctaggctggagtgcgatggtgtgatctcagctcactgcaacctctgcctcccaggttcaagcgattctcctgcctcagcctcccaagtagctgggattacaggcgcctgccaccacgcccggctaatttttgtatttttagtatagacggggtttctccatgttggccaggctggtctcgaactcctgacctcaggtaatccacccgcctcggcctctcaaagtgctgagattgcaggcgtcagccaccacgcctggccgtgaccatcttatttttttaaagagagagttcagtactggttctgagatcaaaagcagccagatccctggtatcacagaagcttcatcacggattcatctatttttcatctccagaatggccacctcagtgctgtcctggccaaaaatctgttctctagacctggagaaggaactgccctgagggtcttccacacctctctttttgagaaaagttaagaacaaagtaaaaagatgcagtggagaaatgacgtcgggggttaatggattgggattttagggctggagtccaggcttatgttgctctctgctgagctcaggatctgcactgaacatctctctaaatcatgggctggggtaaaacctgcttacactggctcagaccggaggactttgcagccacctcaagacacacgtttgggtgtgtcccatctccaatcaggatgttcaacttgctttcttggatctttttgaattgcgaatttggccatagctgaccacttgtttttgcatcaatac

SEQ ID NO: 87880 - DNA, 1054 bp, Homo sapiens
tcatcttcaaggctctcgtctcctttgaaaaacttcttgaaccactactgcactgtgcattctttagccattcctgggggcaaatgcgttgttgatgttgagagttgtctccgctgctttaccacacattttgaactcgaataagaaaatcgcttgaatttgctttttgtctaacatcatttccatagtctaaaataaaataaacagcaagtaataagtcattagcaaaaaaagtgaaagaatgtgcattaaaatgatgtataacataaccacatttatttaagaatgtattccaatatcaaatggcaaattccaacagtgcaaaaacttacccctgaaaacaggcatagtcactttcaaacttgatttttctttcattttactctaccttttcatttgatgaaacacctttgcattttatctccctgagccaaagtacctgtaagttgcccggagttggggttggtgcaatactgtggaagagtgtggacacggaagacctagtcagtccttgctgtgtgatatcaatgatttgattgagaaagactcattttcctgggcctcacctgtcaattttctcaactgtcaaatgccctcttttggcctgtattaggggctgatctcatgcaatacggagcctactctgcaaatacaaggggtcatggtcattgtccatttgtggggagtgtgaaaacacctggtgatcatgatgggctaggtactgtttcacactttaaaatgcctttattttagggggaccctctagtgccataggtattttggagtctctgctttccaaatggcctatgggaaatcctgagatgtccgtgggatctaactttgcccagtgggaatgttgtgtcatagtcataaaggcttaaggattagtttatttccagccctgcaggggctataaattgctactttaaatttcattccagcaccctgatgtttatgttgctatggtggtgtgtctcttgctcgggtgacaagattgccattggaaataggccaaaataacagcctaacaggtggctgtgctttgggaagtcat

SEQ ID NO: 87881 - DNA, 1055 bp, Homo sapiens
gacaacatggtgagaccctgtctctacaaaaaataaaaaaaattagctgggagtggtggcacacatctgtagtcccacctacttgggaggctgagatgggaggatcacttgagcccaggaggtccaggctgcagtggacgtccagccactgtactctagcctgggtgacagagcaagaccctgtctggaagaaaaaaagtcaatggaacaaggcagcgtattgaaatattctttccttgggaaatgtatgtcataaatccttttaccaacagatgatttggatctttaaggctcccaggcacatgactttattctcaggagatggttaggcagtagattaagatctgcttattgccttgagactatataaagctcccaatacctatttttattggagaccaaatttctaacttgttcaattggtctgcttatggcagtgctgctctcccagtcatgggagaagacagttttacatttaaatggaatattctaactttgcttagtaagtaaatactgacccaaagataaacaatgggagaaaatggaatttcagtgtttcatgcaaaaagttcctatcacaagggaatcgcagttttcattctttgggtaggtaggtagatttctccatgttctgtgaaactgtgttgttgcggggaaggaagcaaaagaacaaatcaatagctgaggatgggggcatattaggaatttttttttttctttttgagatggagttttgctctgtcacccaggctggagtgcagtggtatgtcttgtctcggctcactgcaacctccacctcctgggttctagctattctcctgcctcagcctcccgagtagctggaattacaggcccccaccatcacgccaggctaatttttgtatttttagtagggatggggtttcaccatgttggccaggctggtctcgaactcctgacctcaggtgattcacctgcctcggcctcccaaactgccgggattacaggcgtgagccactctgcctggccgtgagccaccccaccgggcctgaattttgcttaatagaatcatgatg

SEQ ID NO: 87882 - DNA, 1190 bp, Homo sapiens
tgggttcagtacctcctttaatgtaagagctggcccgtcttccctacctacttgggacactttctagttttgaccttaagtagggtatcaggaaaattccgagaaagggaagacactctttttcctgaattacagaatagaccaactcattagaaaaaataaattaaagaggccaggcgcagtggctcaagcgtatgatcccagcactttgggaggccgacgcaggcggataacttgaggtcaggagttcgagaccagcttggccaacatggcgaaaccccgtctctactaaaaatacaaaaattagtcgggtatggtggcaagcacctgtaatcctagctactcgggaggctgaggcagaagaattgcttaaacccgggaggtggaagttgcagtgagccgagactgtgccgctgcactccagcctgagtgaggctggagacccagagcaagaccctgtctcaaaaaaaaaaagagagagagagagaaaaccagaacccctttgtttcaaaaccatccacatctgtctatccatccgtaaagcacaaagttatcagagacaaatcatggtctcattttgcttcatgcattttggacctgacatgagtccgtctttgatccctgaggggtggtagaaacaagcaatgcttttcagagtgaagctaaaaaaggcactctgtggaagagaatatattttatagatcagtgattagtgagtcttttcatgacaagttttgtattaattatgatttgaaaacctccagtgcagggttctcaggaattactaagtgcccctgggtacagcaagaagcactggaataaagaatctcaatgtgtgaccaaatttctaaattcttgggggtgtacagaaattagccacttctattttctctctctctttctctctctccttccttccttcctccctcccctccctccctccctcccttccttccttccttcctcttctcttctcttttcttttctttctttttttctttcttgagtctttctctgttgccaggctggagctcggtggcgctatctcggctcactgcaacctccacctccttgggtcaagcgagcctctcactcaccctcctaagcagctgggattacagtcatccaccaccacgcctggctgatttttatatttttagtagagacggggttttgctatgttggccagg

SEQ ID NO: 87883 - DNA, 1021 bp, Homo sapiens
cactgcaacctctgcctcctgggttcaagcgattctcctgcctcagcctcctgagtagctgggattacaggcactcatcaccacgcctggctaatttgtgtatttttactagagatggggttttaccatgttgcccaggctggtcttgaactcctgacctcaggtgatccacctgcctcggcctcccaaagtgctgggattgcaggtgtgagccactgtaccaggctagaatggtaacttttgaaacccatttttgttattctaaagtcttcacggtgtggtgttgggaaggctgggttgctgtgtcagatgggtaccctcaccccagttatggctgttctcacatccaattccaggaagcctcattcttgtgtggtcatagaaaagcaaccttaattttcctgtgtcttagtttccttacctcctagaaatgtggcaaagatgcagaatctgtttatttagtaaatatttatcaagttctgggaatacagcggcgaataagccaccaaatccttccttgatgggactcaccctctaacacagccaaggcaatgagagaccttccaggaataacattgagaggcaaattatgcatgtaggtgacacatgaggccaacaggaaatgacctcgaattgaagttgaaatttacagtgcgagatgagccaagaatctgtgaacccttagaactcaggcaaggtgagctggtgtgacttgcaggaagtatgactcaattgtgactgtacccaagaaggcttaaaccacatcatctgaaagaaggatgtgccaacatacgcttccaatgactaaaaggaggggcagagggaaaaacaaaacagcatgttcccaggcccatcctaggaggaaggaaggctattaatacattcctttgacattgtctacttaccattgcatagagttggaggtgagtggcatatggagagacagagatttggagacagactgagtttgaatcccaattttgtcttattaggccgtggacaagtcatttcaactctctaa

SEQ ID NO: 87884 - DNA, 1027 bp, Homo sapiens
cactccagcctggatgaaagagcaaaactctgtttcaaaaaaaaaaaaacttacaaagtaattatttctaccaccattattcttttattcatttgtcatttaaaatcttgtttttatgaattttatgatttgagagaattttcatgtcaaaatatcctttcttttctgaaagaatattttagcattaaatattagaaggaatacaatttcagtagttatgtgatgaataaatttagctttctgaaaacagaccgcacttgctttgttttttccatttggcaatgaacctgtgcactagcatttaggaatcatttaggaattatcagtgtagtggaaacagccttgctttgaaacaacacaattttacttccagttctgaatcatttaatttttctgaacttctttttacccatctgcaaaagaggaatctcagaggtatagcaataaggtttataaagggtttaagacagttctgaatgcgcaggagtttatagatggtaacgtcttttctctggatcattaattctccttactactctgtgattttaaaaacttagaatgttggctagtgtggtggctcatgccagtaatcccagcactttgggaggctgaggtgggagggtcacttgaggtcaggagttcaagaccagcctggccaacgtggtgaatccctgtctctactaagacacaaaaaaattagtctataatcccagctacttgggaggctgaggcaggaggatcgcttgaactcgggaggtggaggttgcagtgagctgagatcatgccactgcactcgagcctctgtgacagaacaagactctgtctcaaaaacaaaaacaaaaacaaacttagaatgttggccagtgtggtggctcatgcctataatcccagtgctctaggaggcagaatgctctagagggtggaagcgggaggattgcttgaggtcaggagtttgaaaccagcctaggcaaggtagtgagacctctgtctctaaacaacaacaacaaaacagctgggcgtggtggtg

SEQ ID NO: 87885 - DNA, 1199 bp, Homo sapiens
cctgggctcaagaaatctgcccacctcagcctcccaaagtgctaggattacagacgtgagccatcacgcctaacctcttgcaggacttttggggtggtttaaaaattacgcctgtgtagcactgggaacattatgacacccaataaataccaaataaacaacagctttaaatattataattcataatgattcacagagtattaagatccccaggcgatgcaaccaggtagtacctaagtgtatcagtcttgggtgcatctgtcagggttaacctggctttgtttttaactttacaggacatatcagagtatagctattgtgcctgtgctttgaacactcaaacatccgctcaactgctaagtaactgatttcctgtttagtcacagctccttgtctgggaccagccactggcagcaaattgtcatcttctgtatctccctctcaaagcaactcagccttctgaagacgtgtagaagttaggtctcgcaggcttgtatttattaagcccccccccgccacccatcagtccccagttattttgagtgtctcaaacgcatttcccacacctgatgattcatctgaggacgactcacccttgttgtcactgacactgtccacagcccagagctcagcctctgatttgctcggcagagatggggctatgtacatatcgtgtgagacggaagctaacataagcagaggagaaatcacggaagcaaagtgaagtgggaatccagttaatacttggaacagaaaactggaaagcagctcattcattctctccgattgtaaaaggcggatggaaacaacacttttgtcagcctttcttctaatccgatcacagctgtaaagaccataaagccaagccccgacgtcaattattcttctccctgttcctaagaatgtgaaattagatggggaaaagtgacagaagagtgtcactaaaataacttattacactttgagggtcttagtcgtcattaatagttgttactttttgaatattcatcagtgcgccctgctgttcggcaagagaggctgtatgaagtaggaactgcacacgcctggcttcagtcatgtatgccttggatttaagctcttcttttccacttaattagttaacaggaacttactgagctgggtgcaaaatgatacagaagaataggagaatgggattgtaacccctgaagcgtttgtga

SEQ ID NO: 87886 - DNA, 1503 bp, Homo sapiens
gcctgagccaccacgcctggccgagactggcttcttttactcaacataaagtttttgagttcattcgtgttgttgaatgcatcagtggttgggttttttttttgttgttgttttttgagatagggtctcactgtgatcacccaggctagagtgcaatcacagttcactgcagcctccacctcctgggctcaagtgatcctcccaacgtcatcctcctgagtagctgggactacaggcacatgccaccacacctggctaatttttgtatttttgttttgtatagacgggggtctcactatgtttcccaggctagtctcgaactcctgagctcaagcagtctgcctgcctcagcctcccaaagtgctgggactacaggcgggagccatcatgcctggccaatagctggttcttgttttactgctaatagcattccattatagggatgtaccacattttgtttattcatcaccagttgatagagatttgtttctaattcggggctactgtgaatattgctgctgtgatcatttgtatacaattcttggatggacatgtgctttcgttcctcttgggaagatactttaaggagtggaattgctggggtttttttttttttttgagatggagtctcactctgtcgccaggctggagtcactgcaacctcctcctcctgggttcaagtgattcacctgcctcagcctcccaagtagctgggactacaggcgtgcgccaccacgcccagctaatttttgtatttttagtagagacagggtttcaccatgttggccaggatggtcacgaactcctcatgatccacccacctcggcctcccaaagtgttgtgattacaggcgtgagccactgggcctggccactgggtcttatattaaacttatgtttaacttataaagaaattgccaggctgttttccaaagtagttcttgcatttttttactctcactagcaacatatgagcgttttgggtttgccacatccttgtcagtacttggtattatccgtcttttgtttgtagcgattctaatgagtgtgtggtggtatctcactgtggttttactttgcatttcctgtactcttttaaaactgctttccattatagaacatgttgtgttgtgctgttatatatataaagcttctgctcacctgtgagctactctgtctagctgattgatccagtattgtgtccgggggcagggtacatggaaaatgcttagggtttgttgagtgaatgagcaaactgatactttgtaggagtggccaattttcaaatattttaggtaacagaaaacagtggtgaatcaactcaaaagatgaggtaccagtcaaatctcttcccttttgtcagtttctaagtagtattaaacttgagtgaactaagttttacttttttttcctttgctttgcttaccccttggtgagaggtaatggagaaaatatagacagagcaggaggaggaaagaaactcaatctcgaaatgactaagagc

SEQ ID NO: 87887 - DNA, 1031 bp, Homo sapiens
attcttctacaaagcttctctgatatgcagtggtcttccctcctgagaattcaccagaatgtactggcttgatttgcccttgatttgttggggaacttttcacatgggggaagcacattaagagtacaggctcgggctgggcgtggtggctcacgtcggtaatcgccagcattttgggaggccaaggcgggcagatcgcctgaggtcaggagttggagaccaccctggccaacatggtgaaaccccgtctctactaaaaatacaaaaattacctgggcctggtggcgggcacctgtaatcccagctacttgggaggctgaggcaggagaatcgcttgaacacgggaggcagaggttgcagtgagccaagattgtgccactgcactatagcctgggacacagagcaagactccgttctcaaaaaaaaaaaaacaaaacccaaaagaggacaggctctagggtaagactctggggtctgaattccagctcaacaacttattaactatgtgatctttcactacttacataacccatctaaaagctttggtttcctgatctataaaatgaataatagtacctatttcacagagttgctgtatagattaaacacaaagatttagaatgacatattatactttttattcttcttttgattttttttcaaccatttaaaaatgtaaaaccattcttaagtcatgggcagtatgaaaacgggtggcagggcctgcaggatatagtttgtggaccctgcattggagtatgaacttgaattattgccgtttactttagaaacgatgattgcttttttcctaattgcaaagcaccatatgttcactgcagaaaacttggaaaacacaaaaaagcacaataaaacaaaagccattcagaatctccaccatccagagacgtttcatgagtagtatgttgccccatagccttccagacaattgtgtacataatacacatatttcattattttttattttcctttttttttttttttttgagtcagggtctcactgtgtcacccag

SEQ ID NO: 87888 - DNA, 1004 bp, Homo sapiens
gcgcgacggtggctcactgcaacctccacctctcagattcaagtgattctcctgcctcagcctcagtagctgggattataggcgcgcgccaccatgcctggctaatttttatatttttagtagagatgaggtttcaccatgttggccaggctggtcttgaactcctgacctcaggtgatccacctgcctcagctcccagagtgctgggattgtacaggcgtgagccactgcgcccggccagtgtgaccaaaactttcttacagctgtgttgcactctgagtctcttcctacccggtactcctttcttttctctccatcatacctaggccatggtctgaaggttctccctgcctcctcctgcttcttctctgctaccatccacactcactgtgtccatgaaaagaccagattccactggtacttcagatttctcaaatgagaagtaaaacatattctataagttttgaaaatgcttctataaaatgcttctggaatcttcctactggaagtcaaatagataataggtccccatagaatagcacgggacaatagtacagcttcgggggcggtgcccagggaaatctgggctgagttagatgaaggatactaagcatcctatgggaactcatgcagcagggagtctccttcgcttaaggggaccacatacatatcacacaggatgtgtctttcttgtttttctccaaacccatcccgttgtgttggagggtgatgaagtttttccagcaaccacagtgcagtctggtgaatcagaatcagtgtcattgagcctcagcaacacccagatatccaagagattgtcttaaagaatcttagaactgtaggctgggtgtggtggctcacacctgtaattccaaaactttgggaggccaagaggatcgcttgagagcaggagttcaagaggatggcttgagggcagaagtctgaggctgcagtgagctgtgactgcaccattgcactccagcctgggtgactgagggagaccc

SEQ ID NO: 87889 - DNA, 1082 bp, Homo sapiens
agagtagcaggcattacaggtgcatgccacctcacctggctaataaatgtttttggagggatgtgttgagcctatgcaggtatcctgtttccccttaaagtttgcccatgaacttaacattcctcagtggaccctgcctgcagctattattactgtaatgttctcctggtgattttctattctcccatgccttctgcctttattacatggaattcttctgtaagggaaatttgtttcttctccaggtatttgtttatctatcctctcatttatttatatcagtgtggactcacaagtacttattttattctctgggtgagagatgtttttaagatgggaaaatggactactttaagttaacctaactgtgagccaggtagcaggaggtgtggggaggaggagcatagatgctgggggaggaatgggcggtggatggagcgaagttcctaggaaggtcagtgagaaggagatccggaggtgggggtcttggcaaaaacaagggacaccctgttcccacaaatgggtaagaggaaagtttgggagggtcgatttccatgtcaggaaggagaacttgaaggagttccaactaattagcttttgtcttctccgtcaagatgttttctgtgacgacaatgggaagttgacttttggaattttaattgtcttggccaaaattcctggcctctagagtaacgtttctcaacctcagccctgccgacatttggagcagataattcattgttgtgggagccgtcttgtgcattgcaggctgtgtcgcagcatccctggcctctaccctctagatgctttagtgccctctcctgtttccccagcagtgaccaccaaaatgtctccaggcagtgtcaaatgtgccctggggagcaaaatcgccccatgctgagaaccacagatctaaaattaacacacacaattctggcaatccgtaggattcttcttctctttatttttatttttttgtctccctctgttgccaaggctggagtgcagtggcatgatccatagctcattgcagccttgacctcccgggctcaaacaatcctcccacctcagcctcctgagaa

SEQ ID NO: 87890 - DNA, 1192 bp, Homo sapiens
cactcttattgcccaggctggagtgcaatggcacagtcttcactcactgcaacctctgcctcccgggttcaagcgattctcctgcctcagcctcccaagtagctgggattacaggcatatgccactacaccagctgattttgtatttttagtagagatggggtttcactatgttggttaaactggtctcgaactcctgacctcagctgatccacccatcttggcctcccaaaatgctgggattacagacgtgagccaccgtgtccagcctgcccagctcatttttatttatttatttattttttggtagagacagggtcttgctatgttgcccaggctggtcttgaactcctggccttaagtgatcctccacctcagccccccaaagtacttggattacagattacaggcataagccaccgcatcaggtctgtttaatttttaccattcagacagcactcaaggcctagtgtgagtggcctccatcgagggccctgggcttccctctaccctgagggttccatgtgcctcccaggttgaagccatgagagagtccagaactacccccaccccaaaaaaagtcttgctcatggccagctgagtgttccacagcccttgatttctgggtgtgtcataatgtagtcaccaagtcaggcctgtgggctgcctctgggtccttcctgttgagagtgatggcatgtcactgctggcttccccgaggatgagaggttcaacttgtttggttcggcccctaagattctcttacattacctctagctcagacactctgcttgtattggaaaactgggaggcagtgccttttcctctttcttcctttctgaaatagaaggtactcagtagatgttggatttggaatattggaatgaaatgaaggctgtgtgggcctctgggcagcctttggtgttagaaacaggcttcatccctgctggacttgagtttcagttgaggagctcctatctgggcagcactcttcaccagcaaaggctgtccgtggtcttttgaaaagagatcttttttagttcatttcttaaaatccagtgctatatgagagccagtctgatcttttctaaatctgtactttcattttgggtagcgcctaaaagagacacagcagtccctgttcaacctcttttcgggaaaccaagagccttggctgcttattcatcccttct

SEQ ID NO: 87891 - DNA, 1083 bp, Homo sapiens
aaatgagcacttgatgacttgattcctgacacttattcttgtgattcttttgaatctcaattagtaagactttctttctcatagaatgccatacggcttcttggaacaaaggacaaacgggtagaatgcttgaaacagaccaaatcaaagattatgatttttttttctgaagggaagaaaaaaataaaattggaaaaataaaaataaggcttatcatgatatcctgccgtctgatttctaaaagtacagttcctttaggttctaaggactggcatgttctttgtgatatttgtcaatgacatgtgaaatgtgctctgagtaaaggcattttcttctgcaatgttcatttctatttcaatggtctgcctcagtacttttctttaattaatactgtttatgctcactgatgaataattcagagttgtacaagcaacagatgtcagcggattcaaaatgactttccctgaattatttattatttccaaaaaagtaacaggtttgttgaacaagtaattggcaacacagatgtagatcaaggtttgtcagcaggcaacaagtttcactactgtttccccttttgtgcatgttgataaccaggatggcattgtctaggagcgggggtctgcctgataccactgcttagggagtcattgacccatcctgttgctgacttggagagctggaaccttagttggtttccaggttgtctaacgatgaaacatgaatggaaattcatccaaaaatgtaattaatgaatgtaggcttgtaaatatctcgcagacagaatgacttaatacaggtgcccagaaagagggaacatctttgtttgcagggatatgttaagaatagagacctagaagaaaaataatttgacagatatgtaaaggtttatgtataagaatgttctctgcagtgctgtttatgacagaatttttgcaaggagacaactcaacgtccaacaatgaaagactggttagataaattctggtagatccaagcagtgaaatattatatcaccactgtaatgatatatatgtatttttgatctggaaaaatgtcaacatattaaataaaagatgatat

SEQ ID NO: 87892 - DNA, 1105 bp, Homo sapiens
ctcatagaatgccatacctcttcttggaacaaagcacacatgggtagaaggctaagctgctgtaacaagagatccaacaacattgtgacttaaagaaataaatctcaggctgggtactgtggctcatgcctgtaatcccagcaatttgggaggctgaggtgggcggagcacctgacatcaggagttcgagaccagcctggccagcatggcaaaaccccatctctacaaaaaatacaaaaattagctgggcgcagtggtgcacgcctgtaaccccagctacttaggaggctgaggcaggagaatcccttgaacccaggaggcggaggttgcagtgcgctgagatcgtgccactgcacctccagcctaggcgacagagcgagacctggcctgccttgttatcttctaaagagccaagtctgggtgctgtcgtgagaaggaaacatgggtatggaagaggcacaacttgccgtctcaaggccctggtccaaaagtggcccatatcactcctgctcccagcccttagcagggacataggcacatggccatactccactgccagctgcaaagcaggctgggaacaaaatccttacaggcatttatgtgaccagcaatagctctgtgctatggagaaaagagaaaaggaattttgctgggacagctttcggtctctgctaaatttattgattgattttcaaattttttttagatatgaggtcttgctttgttgcccaggtaggtcttgaactcctgggctcaagcgattcccccaccttggcctcccaaagtgggattacaggcatgagctaccatgcccagctgctactaaatttattacccgtaaaataaaaataaaaataaatttaaaaaggaagttgagttttgattcgatgtcttcagagggcatttccttttggaattaatcatacagaagatgtatactctgaagcaatttgaagatttaaaaaaaaaaaaaggaaaggtataaaatgtggacactgccttccagggatttacagtctgattgagaaaccggaccaataacaattcgaagtagtatatgcaaaaggccagagagtgttcagataagtgcagaggagcaaattgg

SEQ ID NO: 87893 - DNA, 1022 bp, Homo sapiens
ctgtatgagccacaagctgaaggctgtcttctgggggcggcttaaatgcattagattagtctgcaatgtggattaagggaccgtgggatttaataacttgcgtattaaagaatggctctgcaaatgttaccctaacataaaaatgtaagcattctaattgaatttagaagcaatagtattaaaatttcttctggtgatgctccttagacgcattaaataaaatatcaaaagtcacaattgattaaactgaaactttagcatgagagttattaagcattaaattctgctgctagaggtttttattttattttttcctgacatgtactcagaaaattctccctttacataatttatggtcattctgctgtttaaatgtgccaaaaaatgttctcggagttttggcagtgttttgaaatagagtatattatcttagtcttgggctatatatatataatgaacactcaatatatattgatggtggtgttttcatgagttgaagtctcgctgtgggcaaaggaaggaataggctattctattacatctgatgcttagcctgcctttaatgagtaatgtagaaaaatagacctcttcttcctcctatggcaagtctgtatgtagtcttgctaagcttgtgtctgcccacaaatcctaatgagaagatggcattgatcggagatggtagcaaagtacagctgggatactgctgtccatatgttccatggttccagaattccaaggactacagacagccttgtagaaatcacaaagcatgagtgatagttataagcaaagaggtcttctcctttttatccaaggacaagcaaatggcagggaggcagaaaggtgacgttttgaatctgtagacacataacgaggaatgtggttgactgaaaagtgtctatgcatttagggcggtgagagcagacagttaggggcatccaggaaacctcctcctctcttgcctttcagggtgtctcctggagtcccgagtgtggcatgttctgcattcaagagtattgtgg

SEQ ID NO: 87894 - DNA, 1050 bp, Homo sapiens
tagctctgacataccacgactctgaatgaacaggtggaattgatggggagtgaggaggcttggagagagagcccccgggtgtgaacccatcctgttctaacaataatgagctttgggatgaagagcctccccgcaggcaggggactgctgggagtttctggtgtcccagaagaagccttcagggcagctctgatcagtaaataaaaggatacgaaataaaaatctcaaaggatccgtaatgaataagaaagcaggaatgtcgtccccagggagaaatgagttgggggctttgtcagtcacgagagaacatagcacaggactctgggtccaatggagctgaacgtcagcgcctctgtccccacgaaaatagtaacttccctgacaccatccacctgatgccaagagctgtttatatcaacatttcttctcgggattctttcaaactttatacttacttctctcctcctctgattctattcaaggaatgtgaatggctgaggttttgttttgttttgttttcctctctagattagcacagctaatacagtggaattgtgatgccagggtctattagtgtagagaaacaaagaatgcagtcctgccctgggcaccagggtttacttccatggtgacttcttcttaagcccatgggaaagtgagagggaggtgacctcctcacagtcggctcagcctctggagcccggagccggagccagccccatagtgtgtggccatcaggatgacgcagagaggcgtgtgaacgcagccggccactgcagctggtgcacttgactctgggcagcgcgttcccaggaacccgcaggacactgaggaccgtgcgtgatgtaacccagatctgccagatgtgggagccagcatgagtcacaatgccgggccgttcattaagaaatgctttctgggtcatctgggtgcagggcactgctgcttccctgctgtccagggttggaggcatcaagtctgcccaccaggaatccccaagttcatgaacatctgtctaaaattatagcctggttttctgagctgatgtgg

SEQ ID NO: 87895 - DNA, 1037 bp, Homo sapiens
agatgtgcaagatgccttatggtgaataacaagtatatttctgagaagttgtaaactaactccttaaaaaaaatccttatggatataagacatacagtcagaaaagttcatgcatgcatccctgggtaaaatctgacacccaagtaactgtagcaagttgaagggtggccccttaaatatcccccagagcctgtgaatatgatcttatttggaaggagacctttgcagacataattcaatcaaggatcttgagatgagatcattctggattacctaagtggaccctaaatccaatgacaagtgtccttacaagagacagaagaggagaagacacagacacacaggaaggaaacatatgaagcaggaggcagggattagagcactggagctgcaaggaacagctgagccaccagaaaccaaaagaggcaacaaacgggtggtcccctcgtgcctttggagggagcctggccctgctgacaccttgatttcttttttctggcatccagaactgtgagccagtaaactctgttgtgtgaagccaccaagtttgtggtgatttgataaggaaactaataaaatcatcacacctagatgaagaagcagaatgtttccaaaaccctggaaactccccctcaagcctagtttctgttttcacaccgccccaggacagctactgtcctgatttctaacgccggggataggttttatgccatttgaacataataaatggaatcttacggtgcatcgtcttctgtgtcagatttcttcccctccacgctttgtgagatgtgtttatcctgttgtgtgtttgatgattctcactgctgcttagttgtagtgttccacggtgtgaatataccacgatttatttactcttctcctgttgggggcatttgagtttggggctacgacaaagagtgctgttacaaattctgtttcgttcctttctgatgaatatacgtgggcgcttttgtgagttacattctcaggagctgaattgttgggtcataggctatctgtgtgttcagcttcagtag

SEQ ID NO: 87896 - DNA, 1053 bp, Homo sapiens
ttctgtccaggtgtgttgactgaattcaggctttctttacgcgatatgagttcagttaatgaaaacacaggggagtgaccagaagtgattgtttccttctttggcatttctgtcttcctctttttttgttctattcccttattttgcaaccttttggatgttaccctttggaagttaccctcttgtaacttccacattaaaagtttgggggctggcagatagaaggaactccagagaacaacttgattctgtgctttgggagagacagagaaatgaggggtgtggaggaaggtcagagagaccctgaggcttctgcctcacttcagcatgtcaaagcaccctattttggggtattgctttctgagccccaacatctccagccttccaggagtctgtggcatatccttccccaaaggagtaggatcacttgaccactctactgaacctaagttgtttttcattttcttttgcatctgccttgaagtctagagcaaatgaaaatacaacaacactgtgtaaacaaaacacacaaaaaagctgctctgatctttctgttttctcaggtgcaaaacaggtcttatctaaagcaactgaaaaggcatggaggtagcaattgctttgctattccaggaactagtagccaccacatgtgtaaaactattgaagaacaagttttcaaccttctgctgtgaaaaggtacacaggaatggctaaagtctctctagaacccgtaccttcctggagcaaagggaagacctgggaaacgttttgacaaagcaatgcttacgatatttttcaatatcaggggaattcagtcagtcttctttcttttttgtttggccagtttagctaaagttttgtcaattttgttgatcctttcaaagagccaacttttggttttgttcagtttctctgttatttttctattctctagttcattagttaattaatttaggttaattaattaatttaggtttgacttgctttttttgttccgctgtcttcaggtggaaggttaagttattgatgcgaaatctttttcttttttaatat

SEQ ID NO: 87897 - DNA, 1023 bp, Homo sapiens
gagacaccatgcccaggcagaagatagattttttttaaatgtagcaatttctggaaatataccaaacttactgttttccctgtcttcactgacgacctcaggagagcaggagttgacacccatttgctttcctcaatctgctatctgcttctttttaccaaggaggaaacactcttaggccaactatggcctaagaatgaatggtgcctccctgcaaccagccatacaccctctctggctacaagtgccatccatgcctctggaacctggagcttctcctaagtagggtgagcaaagatgctggaactttccaagtctcaatctacatatacaatccacatatataaccctctcccagccttgctaggtagttaccagaaccccaaaaccacttgccaagccagtcagcatttaggtaagcaaaggagtccagtgaccctcaaatatcactgagatcttgtttgtctaggcatgaagtgccttgaataactctttcaagacattaagaactcccgctgttcaattgtacctgaagcagcaagtgcttctctttgcatttcctttaccctctgttctcagaaggtctcaaagatgctgaaactaattgctgtcattcctgaaagatttctgcttttaagtggtactgcggcttcccttgatgctaccagccgttttcattaaggatttcatgaagggttgatgggtgcattaggcttcacaaacaacggttcttttcatcctggaaaggccttgctaccttggtagtggatggacctctctgctgcgaacatctctgtttatggggctaaggttacagagatgacaaagaggtcacaagcggatggcgcaggatatgtgtcctgggaaagctctatcttgattttccctctttttggtcttgtgattgactgtgggtttatgttctgtagtaaacacaagagccttgattgcttactaaaggtcagacttgtcagcaaacctctccattaacttgagttgcgatcggtttcacatttcctggca

SEQ ID NO: 87898 - DNA, 1050 bp, Homo sapiens
tctaatgctccctgttcagcaattttgctaattaggcagaaagcaggggcagaaatcacacaccctcggctgtcttgggccaaaccaagcaggactttagctccatttaaccctgtagaatgcaaagggagactccagtgtcccccttcccaaggtttggtcagctgccaaagcttacagactgccagccacccggccgagcatttgccaaggtgatgtaaaatattcacgggaacacgccgtctcgatgttctactcacaactggttctctccctagctcccgaggaaaagtaacatgaggcccatgtggctgccttctcttctcagcagaaggtgctgatgttattagtggcttgccaagctatggttggagggggatgtcaggggcacgctgtggggctgacctttctgtctctgactctgttttgtagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacaggtgagtcatggcagcctgcgttctgcacagaagccccctcccacctgaccccatggtgtgacagtggaggcagtgggtgtctgggatgaaaaggtcacttggaaagtaactacgtccaccgtctacgaccaccaatctcattgtttttgaaaacagaatctgcccgagcgaggtggctcatgcctgtaatcccaatgtttttaggaggccaaggtgggaggatggcttgaggccaggagtttgaggctacagtgagctatactcacagtactgcactccagcctggggtgacagagcaagaccctgactgtaaaaaatattactacataaaataaaataaacgaaatgaatctccccctccccaccttgcattctgcaaaatcgtcctcaactgcgtttccattaagaggagctttcggctcatctttcccacggctttgatgacgtgttacagcgaaatgtgatctta

SEQ ID NO: 87899 - DNA, 1609 bp, Homo sapiens
cttcctttcagttcctttctgaaaccttcggaatatttgtggttagatgccatatgaaatatatcttattggcaaagtgtggtggctcacacctataatcccagcactttgggaggctgaaggtggtagatcactttaggtcaggagttcaaaaccagcctgggtaacatggcgaaaccccatctctactaaaaatgcaaaaattagctgggcatggtggtgcgcacctacagccccagctacttggaaggctgaggtgggaggatcgcttgagcctgggaggttgagggctgcagtgagctgagatcatgccactgtactccagcttgggtgacacagtgagaccttgtctcaaaaaaaaagaaaagaaaagaaaagaaaagaataaagaaaaaaaagaaatatattttattgaaattaactgtccattccagcaaacaagtcttacgtcagccatttcatgaatacttttacccctacctgtggcctctccgattggcccatatgtgattatccagaaagtatttccaacaccctagctgggcagtgccccagtttattcactgacaccagtgactgtccattctcagggcctcggacgtggttagacatctctgagaggaaccatatttagattcccattctcgccttgaccccactccccagcagcttgaattggactattccttcttgatgggagactttgcttcctgtcactagggtggatggaattctcccagacccgtgtcctgacagtgaagggcatgagctgattaaactgatgttttaatttgcccagagatgcagtaccagggaattcctgagtcatgatgaaatgcaaatgagattgatcccattcatctattagtagctgtgaattcccaggctttggaaccagttcagtgtccagccagctgttgatttgcaggggcagctgagctctgggtctgtcctgagcatggcttttttacagagacaggtttctcaacatgctgctttggcattcttagcgtggagggtgtaaatcaaatactgagcaagtttctcctcggggatcacctctgcagggcaaagagaagtgaggaagatgccagaaaatagaaacctatggaaaattccatttcttggcatacaattgcattctctcaagttattacctggagaatgttccttatatatgaaaatcaggaagaattttaggaactttgtaagttttgctgaaacacaataagaggcatccagctctccctgtcatgtctgttttgtcatatcatatttatatcatatttatttaaaagaagagtaataaacattagtaagagggaaatttgttataaatagatgtggacttccagtaatagtaaggaaaaagattaatggggaccctccaccacttcccatgacaaacacaggatgaaatataactatgtaaagaagctgagctcaaaacaaagaaagggaaatcctccgaggctagaaataaacaggcaaactgaaaccagagtggaaagcagacccgttaatgctaaggaagggcatcggggggacatcagaacagagtgtgggttctgacatctagggactgggcatgtcatgcccatggggaaca

SEQ ID NO: 87900 - DNA, 1078 bp, Homo sapiens
agagtcataattcattaaacgagtatttgctgaaatgtacgacgtacaacacattgtgcaggcattggagagaatcccttaagaaataagccatggtcatggttcttgcctcctgatcaaggtagggtccaaggcattttcataagtccacagggcagtgggtcctgattgttggaccggccgtaactaagatgttcccagtgcccatttaataatgtacacagacaattatcattgacctatggacctgaacgcatgagccggcatagtgagtggattctcttccttacatcaatctgtatgggaagtcaaaccacattcagaaactgccttattgattacctaaagtaattattagaggcactggaaatattcaaagcctgtgtaatcacagcctactctccagttaatgtggaaatgagaaagttgctcaaaggggagttagagtccacaataattattatcactaagcaaagatagtgtaaacatccatctatcgaccactggtgtgctttggctggtggttatgttgtctgtgggggatgagtggcagacaggccaaaaaggaggcgtgaggctttagcagttaaggtccacagttgccagcaagagaaactgagtctcttgagcagaaaggacatttcatggaaagatgttaggagccctcaggatcatctggaggcttaagagtgggcagaaatcaacagccccatgatgacagccatctttaagtagagccagatggcgtcattctgccctcatcaccccctacctctgctgcctgcagccatcagcaccgcagctgccctgagtagatctgaattgtcctgtttttctttccaccacttgttccaaaatcccaaacacaagtgtcccattgggttcccagaccaagccctgggctaccagtgaatgggagaaaggaactgctaaaccgttttccaaagtggctgcactgttttatattcccaccaggaatgcaatagggctccaatttctccacataatcactgacgcttgctattgttgtctttttgatgatagccatcctagtgggtgtgaagtggtatctcgctgt

SEQ ID NO: 87901 - DNA, 1045 bp, Homo sapiens
caggcagatcacttgaggtcaggcgtttgagaccagcctggccaacaaggtgaaaccctagctctactaaaaatacaaaaattaaccaggtgtggtggcatgcctgtagtcccagctactctggaggctgaggcatgagaattgcttgaacccaggaggtggaggttgcagcgagctgagattgcatcactgcattccagcctgggtgacagagcaagactctgtctcaaaataaataacataaaatatgggtctctctatccatttattcatttatttttatttttttaccaaaatatataagctgctgcccatgctatgtttgaaagatggctccttatctagtaatagctggtcaagttacttgactatgtgaatattagactgtatacatagtctatacatatatatatacacacacatacacagacggagagacagaaacacctgctgggcatcacacaccgttctaggtgctggggttgcaatagtgaacagagcaaacatccctgccctggtgggacttgcattccactcgggagtgacagtgcacaatagccataataaagaacagtatattggccaggtgcggtggctcacccctataatcccagcactttgggagcccgaggtgggtggatcaagaccatcctggctaacatgatgaaacgccatctctaggaaaaatacaaaaaattaaccgggagtggtgtcccgcgcctgtagtcccagctactcgggaggctgaggcaggagaatcacttgaacctgggaggtggaggtcatgccactgcactccagcctgggtgacaaagtgagactccatctcaaaaacaaaaacaaaaacaaaaacaaaaacaaaacagtatatcgtctagaatatatacttttatatagtctgtatacttatgtatattacatattatttatatagggagactatatatgtatatatatatatatatatatttagaaggtgataagtgttatggaaaataatagagcacatggggtgcttccttccaacctttcagtccatgctatc

SEQ ID NO: 87902 - DNA, 1048 bp, Homo sapiens
ctatctctaagttgctgctctctgttggttttgtccattttcaaaatgtcacttgtatgagttgcttaggctgacatctatctctaagattagcttcctctccctgccagtgtttgggcttaaacattccgtgataccactcctaggaggcaaaggtcaggctggccaaccctccaaacatggaacccttcaggccctgaattctcatgtctttgcaaatccaaagaggacaggctgacagtctgatggagtcccccaccaggctgtagccttctgtctttacacattttgagagcacttgaatatgcacgggaaaaagttaactatgacaaagaccgaagagatggggaaagggcagctgtggagaaaagagatgccccagaatccccctgatttctccagcattttatccagaaagatgtggtagtgtggtgagactctgaacagactccaattgtcttttttctttctttcctcttagcaaactgcctagttgggctagagctgttgtccccaaaatattttatgtgacagagaaggcttggaactattatccctacacaattacaggtaagtccttagtacaaccatatggcacatgtagtgagtgcaaggacatagcatagttgaatttcactgatttacagtggattatccaagcagggccttgtgggagccccgtagtatccctctttttttttttggtttcttacttgtaggttatcaacacttctaacacagacacagagatggcaggtgacaggggggttaagctaagccattccatcttcgttcttagagttacaataaatagtttacggagggccaggcgcagtggctcactcctgtaatcccagcactttgggaggccgaggcaggtggattacgtgaggtcaggagttcgagaccagcctgcccaacatggtgaaaccccgtctctactaaaaatacaaaaccaggaggtggaggttgcagtgagccaagattgtgccactgcacgccagcctgggcaacacagcgagactccgtcaaaaaaaaaaaaaaaaaa

SEQ ID NO: 87903 - DNA, 1076 bp, Homo sapiens
agcctggccaacatggtgaaaccctgtctctactaaaaatacaaaaaaaaaaaaaaaaaaaaaggtagttgggtgtggtggcgggcgcctataatcccagctacttgggaggctgagacaggagaatcatttgaacccaggaggcagaggttgcagtgagctgagatcacaccactgcactccagcctgggcaacagagtgagagtccatctcaaaaataaaaaattaaaaaattaagtcaacggtcatttattaggcatcagtgaggtacaaaacatcatgctagatggcataactgagcaattatctctgtcatttggggtcacaatctggttggaaatagctggacattccagtcaaagcctggcagtcatcagcaagtgctgggcttttctggaggcaagaggggacttagccaaggaaacaagctggcctcagacctgtccactgggctggataagctctgaactgagctgccagcagagattcagacctcagcagagggcagaatcaatgactctggggaatccaaccagataaagcagttgcaatgtgaaaagaagggtgctggcctctgcattggggccttgagttttggggacagggctacagtccccaatgtgggagacaggaagaaaagtacacagcactcaaggaggttactcagtatcatggtgctggggagataaggttgtcaaccttagtaagtgaaaatacagaatgtccaggtaactttgaattttcagataaacagtaaataatatttagtataagagtgtcccacatgttgcatgggacataattatgccaaaagattgttgtctcatattttgtctggcaaatttatgggagagagatggtggtgtggaagaactggtctcagagactcaagtacaaaaatcagttatgagaacagggcacactgatgggccaagggaagggaggggtccagaagtatgtaatgtgggaacccatcctgcaattgacatgccataggaactctaaggtcagaccagagattcagccatctggtctgaatctctgctggcagctcagctcagagcttgtccagctca

SEQ ID NO: 87904 - DNA, 1060 bp, Homo sapiens
ggaaaggctgctcacagctgagagtctgtcatcagtcaccccaggtgaacccgggttatctgcccaggagtggccatggggagaatgaggtatgtttctgaaagccactaaactatctgggataggaattgccctcacagtctgggccttatcaagctcccccagtaatccaaagagctgataggtgctgtgtttagagaccagtgacccccattcctcccaagccccgtctcctttcttaagcctttcttccccgcaccttcccctgagtcccagccaaggggcagtacaaaccactgtatttcataactaggaacacaggaacaagtccagggaagattatgtttattataccagacctctaggattgggcttgttaggaaattaaagaaaaaaaatctggctatctcatctacgatgtaagctaagagggtgaaagtccctaagagtcccttctttgaggccatggagtcaggagttagcgggttaggaaataacttttatctatgtatcacaattaaccctcgatatttagtgcagtacataattttttttagacaaagggaaatatcctttttttagggaccaggccaaagaaacagtcctccagttgggggcactgatgagcaaggcagcaattaggcacgggcctgaaaagcacccttgtggagaagaggacagtaaggccaggtgtggtggctgatgccagtaatcccagcatttcaggaggctgagataggcggatcacttgaggtcaggagtttgagaccagcctggccaacatggtgaaaccttgtctcgactaaaaatacaaacattagctgtgcatggtgacgcatgcctgtaatcccagctcctcgggaggctgaccttgaacccaggaagtggaggttgcagtgagccgggatcatgccactgcactccagcctgggtgacagagcaagaccctgtctcaaaaacaaaaaataaacaaacaaaaaaacccaaaaacaaagaagattatgtgagaccggtgtcatcacagagccagaacgaccaagctcaaaaatcgtcacagttc

SEQ ID NO: 87905 - DNA, 1048 bp, Homo sapiens
ggtgaggagcagcggagaggcccgcgtgcatttccatgctgtagctggaatacaagcagctgttttccggctgtgtttcggagctctgccttccacacagtcccttcctctcaccctcctccacatctctttcaggtcccaccattcctcttggccacatttttcttcctatgcagcatatatttaggaagtcactctgattcatcctcatctctattatttacatgcaattccttttcttcctttcctctttccttgaaaagtctactttttttttccccacttgagttcttcttctcacttttgtggaactatcttctttgcaatttttttctccaactaccctgtcaccataaccacccaccttatttgtatctaaagtcatacgtaaccctcacaaggcagaagggcgaagggagctcaaatatctccccttatttcctttgcatctttgcctgtatgataactaaggttctgagtagagggtgacggccagacatttacctttttgaaattgatgtgtgtattaaagatcttctgtgcacaaaacagaaatttatattttgccttccaagcgtggggtaaaatttctatcaaaatggggagataaaaattttttaatgaataaaggaagctgaaaggtattttaagatctaggttctaccaactgtctgtatacacatttatcatccactttcttctacttttcaagcaacacaggcttttctcatttattttccagtagctccagcctcagagtcctggaagataataagccctaaactctatgcctgccctcattagcactgtggaacattctggatgtgagtctcctgttggtgaacagaggaaacacttgcaaatctagttttattaatgatcccatcttaagttgcaattcccagtgtggctttggagcacagttaatatgacaatatagaatacagtaccagagaatcgatgtcatctacaggggaactccattagagagaaagtcaagtctgtatagagtttcgtgcttgtggatagcagggaacacgttctacat

SEQ ID NO: 87906 - DNA, 1055 bp, Homo sapiens
tatcgtctctctccctatgcaggtgctgagacagaaataagggctgccagcaccacccagaaactgactatgaaatccccaatgtgtctgaccctttctctttaagactttggtttgcttacatttcattttgttcctgtaagtgtttcttattgccatagcaaccctaatcgatcactggaccaaaaatagctctttcatgttttccaaagcatgtctgtagtgaattggaaattcagttctgccgtgcattttgcatatgctgctttcatttcccgacactgaacctgggagggcttgtgtctggaaattattcttgcagagacccagaaacctcacttgtctttcctggcgttcttcttccccactgcagatccacccgtcacttccaaaagctacaagtagctgcatttaaatgttccaccatcacttttctgcacattgagttttgggtgctggaggttttacaggtaccagaatatcacttttcaataagaggttcatcctggtggattccgttgggtttggaaggccaattatagatgcttagacaccagataaaaggaagagggtcatggcagggagcagatggcagcaacacctataagattcctctggcttacgtggatctaagctagaaaatcaaagatgagatgacaggagagctcctgccttgactccctgacttcttcctaacactgctactgtttttagggggttggggcaaaataaacactggatgtaattaagtgaatattttctatgatgctttctctgctttattctccctgccaagctgtgcctttagtcaagaagagggagagagagataaaaaagaaaagatttttcatgagaaagaggattcgagacctggagtgagcccagaggaggaagaagaggtggagagggacagaaatgactcactgatttcccccaggctccagggacaggcgtgcttttttgcctccccctctgcctgtaagcagagtcatctctgtggcctcaagggttcccaacttctgttttatgcttctgtttcttaacttctttgagcc

SEQ ID NO: 87907 - DNA, 1050 bp, Homo sapiens
gagaattgcttgaacccgggaggcagaggttgccgtgagcagagattgcgccactgcactccagcctgggtgacaagagtgaaactctgtctcaaaaaaaaagaaaagaaaagaaaaggagggctgcatccgtttccattcatacttgttaatacttcaaaatctgaacataagaagtatatatttatctaacaattctttaattactaaacgctagctttatctagccagggattcaaaactggtgttttaagccaaggagtgtgctggtgtgctctttttctgtcctgggttgagtgtggagtttttggtgggaggcagagttgctaaggaaagcagtgcagtagtggataattctcttgtctcaccgcgtttccaaactatttaataaactcagttcatttctttgcactttctgggtgtacactcttatcattcagctaccatccttcatactgctatctgcactgtttcctcccctacctgccaaaaatttaatgaaattgatgacgataagaagcaataattaaattgaaagaggctgctgatagtcatattgatgatagtggttgaatcgagtacatgttgttatcctattatcaattaccatataagtaattttttgacgtgacccaatatctagtaaaaaaaaaaaaaatagtggcagtatgagtaaatatcttccttgttaaaaataaaaccagtatacgtatgattgtgaaaacctgcaaactgtgattacattaaccaggatgcaatggggaagttgtcttaaactgaggcccatttattttatgcacatacttatgagaattacttgggccttcattcgtgctagggaggacggcaccgtgccaaggtaaggttccgttgtttatccaaggccataaatctaggcctgtgagagtccgtgcttagcactgcctggttcagctgaatgagaggctgcccatgtggtgacggctgccaggttactggtgttcaatggggttaatgggggcagccttgctactttacttcctcttccaaacaaagcaggcaccatttaaa

SEQ ID NO: 87908 - DNA, 1044 bp, Homo sapiens
gatttcaaagcaatttctgccttttgatgcgctgaaatcattgcttccatctgctcccctacttgtacacagggctctgctttttaaccatgcagtgtgtcagctgttgcccaccaaattctgcacttgatcttctgagactgatggcgattctctatgaataatattaagctattaaatcacatttaaatcctatttctccactaatacctattgaaggcctgtttatattccatcagatttttatggccatttggtacataaatttgttaaatataaacttcatggagcttcatctgaaaatgtttcatcttgttcccagtcctgtaaagacatggtcataaatacctttggactatgcaaaccattatctagagtaattttaattatctttagctatgccgatcagatgataataaatagatgttgaaaagcatcagcaaaatgccatcatggaagagatactcaggggtaaaaccaaataattgaccatttggtgctgaaacattttattatcattcctacaaaggttcagaaatctatcatgagattgggtttgttatgaactcaacatcaccttggttgggatgtcaaaactagagtaaattattgaaatgaaatatgaaacatattaaggaacgtcctcgggaatgaaggacactggaaagactgaattttctagtaacttaatttcgatctatgggtgaagctttgttttcagcacccagctatatttgcttggaaccatctgggtctcttggaatagataatgttaaaccagatacactagttgtacacgtggtatgtctttattgggggcttttggtaacagtttaagatagaaaaaaaagtattgctttaaaaaaaaagtgatccttggtactcacgggtaacaacattctgctttggctaagagtttacgtaactgcatactgttccctatttctttgttgttgttgttgttttgtatttttgttgttattgtttttcttttgagatagagtctcgctctgtcgtccaggctggagtgcagtggcccgatct

SEQ ID NO: 87909 - DNA, 1058 bp, Homo sapiens
gggcatgcgcctgtagtcccagctactcgggaggctgaggcaggagaatcgtttgaacccgaggggcggaggttgcagtgagccgagattgcgccactgcactccagcctggcgacagggtgagactctgtctcaaaaaaaaaaaaaaaagaaaaagaaaagaaaaaaatattattttctaaactttgacatctgctgctacttgttggctaacaagatgtcatctgctggcaaacaaaatgagtaaactactaggaaataaatggtaatgttaaaattcaacatacctggtgttcagtctaacagttcagttcaacaacagcaaaaaataaaaattaaaactttgagtgttaagcttctattaatgtatgagatactagaagaaggtctgagggatgcatagatgaatgagatatattgtatagcttattccccatgactgtaaggccacatgtgcctgtagtactggggcactgaatggtacttcagcaatgaccatccttttattagaatccttgggatgctactagtctggatttgcagaattcaccaaaatgaatgacttttgctattacctgtcaagttgatttcatcttctgtgtccagacagctatccaaaccaatataaccaggaaatttactctggattcctcagatcaatagatgaatggttttgttgttgttttgttgttgtttgagacggagttttgttcttgttgccctggttgcccaggctggagtgcagtggcgtgacctcagctcaccgcaacctccgcctcctgggttcaagcaattctcctgcctcagcctcccgagtagctgggattacaggcatgtgccaccaccacacccagctaattttgtatttttagtagagacggggtttctccatgttgatcaggctggtcttgaacccccgacctcaggtgttccacccacctcagccttccaaagtgctgggattacaggcatgagccacccggccaatgaatggtttttaaaacaaaaatcacaatgagcctgttgccttttattggctttggttttaggaggagaaa

SEQ ID NO: 87910 - DNA, 1510 bp, Homo sapiens
aaaggagggtgatccagggaggtgagttgatgagaggaggcagatgtactaagtccatacatgagtgcagtatttgacagtttgcaaagcaccttcatacccactatctcaccaggtcctgctagctcagtgatgaggtgggacacctaacgtcctcacttccaggtgatgaaatggaggcctggaggagtttctaaagtcgtacaactcctaagtggtggagccaggattagaatgagatattttgacctctggacactgctctttccaccataaactgatatgttccaggagcattgaagaaagcttcctagcatattgggaagaaaactcatggttggggtgtggctgggtggatggatgggcggatggatggatggatggatggatggatggatggatggatggatggatggatggatcaatgggtggatgtggagatcagagtctcaagagaaaaagagttaagagtccagcagttgtgcaggtgagatgggggattcaaacgtctatcaggaaggtggatttgtgagatacagaggcagtggagtgaatagaacttcatgtctgaccacatgtgagaatgagaaagaaataagagtgtaatggccggacacagtggttcaggcctataatcacagcacttcgggaggctgaggtgggcagatcacctgaggtcgggagtttgagactagcctgaccaatgtggagaaaccctgtctctactaaaaatacaaaaaattagctgggagtggtggcgcatgcctgtaatcccagctactcaggatgctgaggcaggagaatcacttgaacccaggaggcagtggttgcggtgagccgagatcacgccattgcactccagcctgggcagcaagagcgatcaaaaaaagaaataagaatgtaggataacacccaagttttgaccttggatgattaaaggaccacaaaggaaaacaaacttaaaccttacagccaaagtggtaaaggtagagatgatgaatgttaacttcgaatatgtctaatagtcagttgatatcaatggatctggaattcaggaaaagtgtctgagatatccaggagattcattaggtcatcagcgatcaaaggttagcattttattatagatgttcactgtgttattataaataacgttaaaaaagagaaaaataaaaaggaaaggtcttaaacatgtaacagttgcagattggctcatttatgttacagccatatattgaaatgcaattcagaccttaaaaatgagtgctggctttgggaggccaaagtgggcagattacttgaggtcaagagtttgaggccagcctggtcaacatggtgaaacctcatctctaccaaaatacaaaaattaaccaggtgtagtggcatgtgtctgtaatcccagctgcttaggaggctgagtgaggcaggagaattgcttgaacccaagaggcagaggttgcagtgagctgagatggtaccactgcactccagcctgggcaacagagtgagactc

SEQ ID NO: 87911 - DNA, 1035 bp, Homo sapiens
gaattcctaaatgccagatcaaaagcagagaatctaagtctctgccaggagtgcagttgctgattgtggcattgtgggtcattgaatcaatagaaagagcccttgggggccaggtgcagtggctcacgcctgtaatcccagcactttgggacgccaaggcaggcagatcacttgaggtcaggagttcgagaccatggcaaaaccctgtctactaaaaatacgaaaattagctgggcatggcggcacgcacctgtagtcctaggtactagggaggctgaggcacgagaattgcttgaatccgggaggcggaggtggcagtgagctgagatcgcgccactgcactccagcctggacaacagagtgagactttgtctcaaaaaagaaagaaagaaagaacccttggggaaatcaccctatcaccctatatcccaaaaggaacagaccagggagggaagaattcatccaagcaaaacattcatggaagggagaaacagttgggcttttcatagagggatctgtgcaaaagataacccctagaacctatgaattgggattcccaacttgtgtgctctgtgtctagatgattcagccctaatgtggtgagggccctggctctgggagcctcccaggcggtcacagccactgcatttgatcatcatcaattctgtgtctgagtccctccctcccttccaaagaatggacagatggacagatgggatggagaagtgagatgacgtcaaaggcaaggcatggaaagtgaccagcacagtccctggcacacagtaagcatttcataagtgttcccttctctctgctttgaccctggcttcgagctctgcagatgggttgcaggaatggtggctccgtggaaaccatgtgtctttggaaagtggccaccgtgagtggcgtcacaggagtttgtttgcgtgtcgcttttcccttgtcggtgtgagtggagaacaggagcagaggtgtgataccaatagctccagctctcaggatcatgggatcctccgccggctcagcaagatcctg

SEQ ID NO: 87912 - DNA, 1056 bp, Homo sapiens
cctgatctatctgcctcggcctcccaaagtgctgggattacagacatgacccaccgtgcccggccggcatgttcattttgtagcagaatcccacttggtgaagagtcatattttctcagggtttctaacatgactctgtccctcatgggagaaaaaaatgggaaatgcaatgttgagcattgccctttgtagctgctctcattttcataagaataaatactacccaaattgtctctacattccagataggctggttatctgtttatttttccacttaaaaactgataagagtagcttgccaaaattattttggagtcactggaatttaaccttaatgcactgagctttttgttacttagatggatttgtctattgagattgggggccagttaacaataaaaagtttaattctggaatttaggtccaagaactagactgccagtctcttgaaccctcataactcaggctcacggtaatggcagactctggcacaaacatgagagccctgggtgttttcttgaacagagaagcatgccactcctttcccgtgctccagaacccagccagccagccaggagccagaatgaaatgtgatacgtagaaatcaagctccaggatctcctgttttcctcctgtgtcctgattattgcacaggaaagcaattgcagctcccaaagtaaatgttttccagcctcagctttgtgtctatctaaggcagtgtcttccttggtttcccacagcatccctttttgtgtgtggctttttaaggtaaaaagacttcctcttactagggccactatcatagtattattttgttttgttttgtttttttgagatggagtctcaatctgttgcccaggctggagtgcagtgacatgatctcggctcactgcaacctccacctcccaggttcaagcaattcttgtgcctgagcctcctgagtagctgaggcacaggtgcatgccaccacaccaggctaacttttgtattattagtagagacggggtttcaccatgttagccaggccagtctcgaactcctaaccttaagtgattt

SEQ ID NO: 87913 - DNA, 1043 bp, Homo sapiens
cccagccctactctcaaataagacaaagagatgaatatactgcaagtgtgtgtacaccatggggaagggctggaggtgtgtgagcactataggacctataggcagcctgtaattgtcatcacctatggacagagggattaagaactctgtaatcaccaagatccccagaattgttaacaacttgtcttccagatagttttcatcaaagatgctattatttcagtctccttcttttactttttaggtggtccgagacattctgctgattggacatagacaggcttttgcatgggttgatgagtggtatggtaagtcaatttctccaaaataacttgtagaacaacttcatgttgtctcgggctttctgtccatttggcttcaactgctacctagaaggacaacaacaaaggcaaggccgctgcttcctgtgttggaaatagcactgtctgccaagcataatgaagatgtaattatagaagcttggtctaaaataaccacagaattattgactaagtaggaacctcaggatgtttgatgcttacatagttgatacgcatggctccatcattctctgttagatgggtttcaaacccatcctaatttatcccaaacttcaagatcaaagctgtctgaagcatcctgtcaagtaaaagcagtcctttgattcagacaacatttgaaaccaccccttgccgggcgcagtggctcacgcctgtaatcccagcactttgggaggccgaggcgggcagatcacgaggtcaggagatcgagaccatcctggctaacacggtgaaaccccgtctctactaaataatacaaaaaattagccgggcatggtggcaggcacctgtagtcccagctactcaggaggctgaggcaggagaatggcatgaacctgggaggcggagtttgcagtgagccgagatcgcaccactgcactccagcctgggggacagagcgagactccgtctcggaaaaaaaaaaaaaagaaagaaagaaactacccctcaacaaatatatacaggttctgcaagaatttaagg

SEQ ID NO: 87914 - DNA, 1048 bp, Homo sapiens
ggctataaatagaaaggaacacgccccaccggtgacttaggttagatctgattttcaggtcgattgtctaatgaaatgcccttctccttggccttttccaaagtcacattaaatttgttctgagtataacctagattgcattttggtccttttctgtcattgtttcaccaactccctcccttttctgagcagaaggtaccaaagtaaaaggacacgttagacggaaggggcaaagacagtcattattattaatattgttagctatttctgagccacatttaaaaggcatggttctataagctatgggcttttcttttttttttctttttttcttacctccttttgcagttttcccagatctgcaccttctgaagagcaaatgcaccttcctgggtttgtccaaatgcagatcatttatgctctcttatcacacacccacagaatgccgctctcataccgcaaaagcactggcttgccacattgtcatgtagtctcccagagacctgtctatttctagttgtgttttgtgaggcaggcaggagagtctcctgtgattacttcctctgatccttaaataaatctttctggttgtttttttctggggcgcttttctccgattctcagagggagcacagaccccaagaaaggataagaacttctggtctctcccagcttgtgctcctcagagctcatggtttccttgctaccaacaccaaggaaatatcaaaaggatatttaaagaatcataggtgcaaactgattagaagtttggcaaaaagagaggtacctgaagggccaaaaatctgccactttgaaaaccaacacacagggcacttggataggtttctctctgttgccagagtgccaaagaagatttttcagctaaaagaatagccgggctctgatcaagaggacagaataataaaaagggtttgattagaggcaggatataggaagaaaacccagtgtgggtgggtatctagtaaatgaaaggccaggaaggcgatggggcctgacttttccatctcagctgagcctagggcaagga

SEQ ID NO: 87915 - DNA, 1037 bp, Homo sapiens
ccaacatggtgaaactccgtctctactgaaaatacaaaagttagctaggcgtggttgcgggcacctgtaatcccagctactcaggaggctgaggtaggagaatcgcttgaacccgggaggcagaggttgcagtgagctgagatcgcaccattgcactccagcctgggcaacaagagtgaaactctgtctcaaaaaaaaaaaaaaaaatcacaactatagattacagttctagatcttagtggtctgaattatgtggaaaaggtatacaccacacttcgaggactggctactttcactacaaaaaaatggagtcaccctaagctttttgtaagaagcatgtattgaatttgtaatcattgtaaagggtttaaaaaatggcatttctcaaaggatggctaccattttgctggagccaaagaagtatccattcttatttatgatttctggggcctccctgacccaactacttgttcaagacttttattttgacttagaatgatgtaaaaatgacttctgttttggtgaaggaggctgaaagtgaacggaaatgtttgtagagggaaataaagtataatgtgccatttcacagatcattgaattagaacagaagactcccctttttaaaatgtttgctgctgcaactgtgtggtacaatgaaggaaaattcacgcttgcagatgctttgttcaagggcatttgtagtttccatgtgtgttcaactgacttctaaaggcctttcaaacatatgatcttgcctccacttcctgtgaaattaacctcctttctttaaaaatacaatgatttaaagaaaattgccaccataaacaaagctaaaagactaggggaaaatatttgctgcatatgtagtcaacaggattaccatctataatatataaagaggtcctataaattgaaaatttggccaggtgtggttgttcatacctgtaatcccagcactttgggaggccaaggcaggagaatcactcgagctgaggagtttgagaccagccctggcaacacagggagaccccatctct

SEQ ID NO: 87916 - DNA, 1098 bp, Homo sapiens
ttaacattttgaaatatatcctttcagtgtttttttaatgtagataatggttttctgactaaattgatttcatatgctatatacagttctttttacctattttttatttaacaatagattaaggatatctctctaggattaactattcttctacctaatttttaacaattgcatagtgctatcagtcccctgggttgttttcaatttttcattattatgaacattgctgaacaaggcagcaatgaatatctttgttgttaaaccctttttcacatccataaaatggatacatctttgaaagcccatagtcacaaagtttaagcccctatcttgacgttgagctaattcaagatgaagtatgatttctgtggggattcaatagaacaaaaaaacctataactccttggcttttgttttccaaattactgtcatgcctgttgggatggtggggggcaccccctaatgacatatgtgtagagaaacttctttaaattttcaactcctagctaaaagtgatcgtctagtattatttcagatatatttgtgtttaagaaatgttgataagcagccattgaaagtgattgtactgaaagaatgtgttgttattattaactaagatgcatttgttttcatcataaagcagcatctctttattgctttttggttacctcgattttctaaaagaagagcatgctccttgcttggccaagctgctgcttagcattcttgatacttacattgcttatggaccgcatttgcgattgaggatctccaggtatacctgggaatgatcttctgcataaaatagaccaggtctggatttagaggcacacagcatcttggtcccagaccacagtgaattaaatcataaactcctggcaaatctgccctttggaaatgaagaggatctcacatgacacatggattgatataaaaagacaccaaaccacatgatgcagaaaatacctaaggaaaaattccagctgtgaatgcccactctaaatccccactaagccaattagtggtcagggtggcagaggaagcactttgttcggcataccatcattggtaaagagcatgaagttccgctctgccaag

SEQ ID NO: 87917 - DNA, 1032 bp, Homo sapiens
tcaatcattcatgctaatgaagggtagctagagataacaaagaaaagtgtaatcaccaaatcatttctttgcatcttcagccagagctgtgatctctttgggttccgccttgagtcctcatgtccattagcccagtctccagaataatacatagtaggtgttaaaaaaaaaaaaaaaaatcagctgggcgcggtggctcatgcctgtaagcccagcactttgggaggccgaggcaggtggatcacctgaggtcgggggttcgagacaagcctgaccaacatggagaaacctcgtctctacttaaaatacaaaattagctgggtgtggtggcgcatgcctgtaatcctagctactcaggaggctaaggcaggagaattgcttgaacctgggaggcagaggttgcagtgagccaagatcgcgccattgcactccagcctgggcaacaagagcaaaattctgtctcaaaaaaaaaaaaatcaatgctgtagttctaggaaatttagatgtggctgttgtcataaatggatcctttagaattgtgaagaccttctgattgcactttggaaatttttagttaaatttttggagcatgtctttggaatgtgccctgcaagtctcatgtgctgcaactggttgcatgtgattgcccttgaggttgcaagggccctaactcttctcccattttgcatgcagtgatctgatttgcaggaaactgttggagcaagaggcgtttcctctctatgcacagaccaattccagtaggacttccccctagaagtgctctttaaggaaactctccttgaatttctatcactttcaattaccttttcttttagaaatgttgggccccagttccccctcagccactctgaaagccattcactataaatatgaccaggcaaacaaaggaagaagccacaggtaaagaggagacaccagatggctaaaagatgctaagctcagtgattttctcacagcttataagccccttggcttggctttctttcagttttactgtgattattactttat

SEQ ID NO: 87918 - DNA, 2050 bp, Homo sapiens
cttaaatggataatcataaagggatattgttttcagggtgtagcttccaatagaaaaaattgggggtttggtatttcaatgatactttgggtgtataatcgggagaggcccctttatgatagggttcccatagttcctgtaaaaacaagggtagtgatgaatctatttgcctctcttataaataactgctcgtttttctttctgtttttctccttgaagacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaat

SEQ ID NO: 87919 - DNA, 2137 bp, Homo sapiens
ctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatggatgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgttttttgctttaaattgaaagcatgtctgtcaaattgcaagtctcccttcagtttctatatatcac

SEQ ID NO: 87920 - DNA, 1264 bp, Homo sapiens
gtgaggtgcgcttgtaattccagaggtttgggaggccgaggtgggtggagcgcagtggcacgatctcggcccactgcaacctccacctcccgagttaaagcgattctgctgcctcagcctcctgagtaattggggttacaggcgcacgccaccacgcccggctaatttttgtgtttttagtagagacagggtttcaccatgttggtcaagctggtctcgaactcctgacctcgtgatttgcccaccttgacctctcaaaatgctgggattacaggcgtgagccactgccctcggccagtaaattttttaaatgctgtcattttaatggtttcttttattgattataaacttaattgcttttaatgtttgaagttgacttcttgaatattgtatttatcttaatttcattaggtttctgatcagaaacccttggggagctggtcagtgaaacaaggtcaaattataacatgtccagctgtgtgcaactttcaaactggagagtatgttgttgtacacgataataaggtgagttttaaaacttttgtataatatatacaatataaatgttgattattaactatttgtatttattatatgtaaatggagaataggatagtttttaactagtatgttttgatttaaggttttaagaatatggaataatgaagatgtaaacctggataaagtatttaaagctacagtaagtctttgaattttccaacatatttgtttagcttattggtgaattagaatcattcataataaagtatgtgttatttattttaatacctctgggaaaataagcataaggtcctaatcaggttttcattctaattatcttacaatgtatcttggtaacatgtctccatgagttaaggagatgaggatttatataattgatgaatgagaaatttatacttatttccatgagtttggatgtttggagtgtgtcttttgtgagagcaaaatgaacttctgtgccctttcttagaataggtagaatagaccctgcaagtttcgtgtattggtgtattgtacttttttttttttttttttgagacggagtttcgctcttgtcccccaggctggagtggaatggctcgatctcgactcactgcaacctccgcctcctgggttcaagcgattctcctgcctcagcctcccgagtagctgggattacaggcatgcaccaccatgtccagctaattttgtatttttaatagagacagggtttcaccatgttggccaggctggtcttgaactc

SEQ ID NO: 87921 - DNA, 1001 bp, Homo sapiens
atactttcagtgcaagggacagaacccttggtgctcttcaaggaaggtgctgttcgtggtttagaggccttgcttgcagacccccagcagaaaattgaaactgttatctctgatgaagaagtgattaagtaagttccagtacttgtaagtaaatttatcaaaataaaaatgcactgaacatttttttgccttgttcaaaagtattttggttataaacataatgaaagtaacctaattaaaaatcacttacaaaacactgactaaaacaacatcctaaaaagcctctgggcatgaagattgaagaaaccatagagtcatatgaagtcttgacagaactggatacttagttatttgaggatgaaatgtgttatcccaaaagaccaaaatctttttgttcctctcatattgccctgactaccaagctcccatccttgtcccctggctaaaagtgcatcgtgttagtgaaatcatgatgcattaagacctctgctttcccagattctgaaataaaactggaaaaatgactcatcaagggatagaaggacacttcatgattccacatctttctgatactctttatttcatcacatttcctgttcattttacttgttttctccaggtccacctggtagaaactaattttctaaaagtcagagtgaagactggtacttacaacgtggccaataaccagttatatattagactgacctgatgaatccctctaaggtgtgagcaactgttgtgagggaaatccttggaggatttgagttctagttgctgctttgccacaaactgtgcagccagtaacttctctatgcctcagcttcctctatattgagatcttaatgttttcctcagaacacgagtcccaaaagtaactctgaagaaaatgaggtaggggagtcaatttaagtttgggaagcactgcatctcccctcttagaactttaaaattcacattatcatctggggagttcaataacctgcatttaatccagagct

SEQ ID NO: 87922 - DNA, 1335 bp, Homo sapiens
gttgcgtagaatagcagtggtgaagaaggcagggcaagcacctttgtctttttccttatcttagggggaaagcttttagtctttcactgttgagtgatggtaattgtgggtttttcatagatgccctttatcatgttaaggaagctccttcctttttcctagctctctgagttttttttgttgttgttttttaagtcatgaaagactgttggagtttgcacaatgctttgtgtcaaccgaggtgatcatatggttattccctctgttctgttgatgtatgtgctgcactgattggttttcttctgttaactaccctttcatccctggagtcaatccttcttggtcatggatcttaatatttcccgttggatttggtttgttggtattttgattaggatttttttttgcatctatactcatggggatattgctctgtagtttttttgtgtggtgtctttgtccggctttggtatcagagcaaccaaaagcccaaatgagtttaggaagtatttcctgctcttttatattttgaaagagtttgggaagatttgtgttaaattgtaaatttgtagaatttaccagtgaagccatctggtcttgggcttttctttgttgggtgtttttaattgttattcctggttcataaagccctcccttcctcagggctcacctttccaggcttcttcttaccatgagctctcatttcttccagttcctgtggcaatcactgtcttcataattcatttctatactaaagcaaagcatatatatttaactgtaactccccccttccccaaaatatcatatatttatacttgggacttttttctgaatttatgtcttattttatagaatgcctctctgtatggaacataaaatttcaaacactacagacttcaaaagagttaccacaagggaccagtggtcaagtaagttttttcacttgagtactttctctgatttagttattttgttgtgttttgttttgctttgttttgagatggggcctcactctgttgcccaggctggtcttttactcttgggctcaagtgatcctcctgcttcagaaatttagttatttttctgcctaataaatatgctgtaagggaagagatctctttgaacctaaatattttggcagcttttcaaaccaggtgtggtggtatgtgtctgtagtccctgctactgaggaggttgaggcaggaatatcttttgagcccaggagttcaaggcttcagtgctgtatgattgtgcctgtgaagagctgctgcagtccagcctggacaacatagtgtgatctcatctctgtaaataaataagtaaatagcttggcag

SEQ ID NO: 87923 - DNA, 2531 bp, Homo sapiens
tcaagaccagcctgggcaacatagtaagaccctgtactccacagaaaatggaaaacaaaaaaaaaaaagtttgaaacttgtgaacagtccaaattgcaggttctgtggcaagctgaagagctacactgtgttttgaatgccagtgttctgattttaggggcaatgggagaacccccaaacaaaatcagtaatacctctgccctcccttgtttaccgatggcctcatctgttagcttaacgttgttggacatacagccttttcactatattatgattttcttatctgaggttatcagaattacatggacttcaaagcctctcttaaattgtatgagtggttttttttaaattgttctttgattgtttagttgggcaaaaagtaagtcaaaacattccagaaattgtgcattttgcattttcttaggaactcatgtcgtgtcccattttgtaaactgggagacacctcaaggatgtggacttgggttccagaactcagagcagtcaagaagaattgtaagtttcgtagttgaaattgaaacattagtgcaaatgttgaaaaacagaaaaagactgaattattttaatgaatcatatccttacaactcttagagctttgactataatgacaggacagtttgcggcttgaacccagtaacctcacattctttatccagaaatgccccatgttgtctattagttatatttacttttaaaagtttttgatgagagcaaaagtgtgctaatctctttggagtgtttcatatccctctaaatgtgtattggatctcttatattgttttgtgatcctaatcaatttacttaattccagttaaggagacgaaaaattgaagtgagtttacagccagaggttccaccatccaaacaacttttgtcaaccataatggtaaataaataatattgaaatatgaaaaatcaaactcaagtgttccaaagaaatcgcatctactcttcgttctgtcttatttttatgatcatctttatacctatagctaacatcttgtagtatcttaagggtgtcagagttgatccgatattttggcttctttgatgctcgctgtcacctcatgagattgatatggtgttggtcttatctctttctcatttaactttgcagtgtcagcttcagctttgcaggaatgcatgataactgttagtcatttgagaaaatgttgtgctaggaaacgttaagttcagagtgacattcgttaatgtgccaaactgaattctttaattctgcgctttcagaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacaggtagctgtttgtgtgtaccacactgtacgtgcataattcttctgaccttgttttttatagttctaatcttctgaaactctcaaaaggcttataaatgttctgcagttgagaattttcttaatatgtaatagtgattcagatttttttgtcttagtttgtgccccgacttaatggagattgccttaaaaaagaaagatgtacagttgttacaactctgtctacagcagttccctgacattcctgaatcagtcacctgtgcttgcttaaaaattttcttgaggtaagttagactccaatggtcctttttcttcactacatttataatctgttacattatttgatttccaaaattttgatgcttaggaaatgaaatttttcccaaaagcttggtgataaggattaacctcttgctttcaactaccatcatagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctactgtatcctttgacatagagcatccctctgtttctctttataggatatagttatatgccaagcagtaaccaaggagtaactcaataatttaaggtttttctttccttttccaattgttttttgtttctgtttgaaaatagattatgttcaatgctacgttaagtaaggtttacttaaacctgtttaatttaactaggctgggcatgggtggctcatgcctgtagtcccagcactttttgaggccgaggtgggaggattgtctgagcccaggagtctgagaccagcctgggcaacatggcgagacccccatctctacatcagatttaaaaaaaaaaaaaagaagaagctatactaacacagaagctctatcaattctgaagatcagtattctgaataaataccaattaaagtattccaca

SEQ ID NO: 87924 - DNA, 2097 bp, Homo sapiens
tcccccttcgctttccttctccccccgcctcggctccgacatgaggggccggcggggcaggccgcccaagcagcccgcggctcccgctgcggagcgctgcgccccggccccgccgccaccgccgccgccgcccacgtccggacccatcggggggctccgctcgcggcaccgcggcagcagccggggcaggtgggccgccgcccaggctgaggtggcgcccaagacgcggctgagctcgcccagggggggcagcagtagccggaggaagccgccgccgccgccgccggccccccccagcaccagcgccccgggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtacccacccagcccagttgctgcagactccttccccacctcctctgccctccccccttgctcactcgtgtgctgtgcatcctgctccgatctccccccaaccccgcctcccccccaaacagaggggaaatgcgacggcacatcaagtggcaaaaaactagatttacaagaggaaagaggcgcattgttcaaaatggagattgcattgttgcagtttgcaggccacactcgctcgctctctctcccccccccaaccccctttttttcctcttcaaaatttgtgccagtgcagtgtctccaccgggcaggattgaaactttggcaaacacatatccattgcattcatttttctccccttgttttggtgtggttttctggaatgaaagaagcctcttgttttgcaaacctctttgcatttctaatgtggtttctttcggatttttattatatatctgttacttaaaagggaattaaggatttggacagattgtggtacacaaacacgcacaaaaaaatgcgttttcacacccctagctgtggttttaaaattgtgttaaggaaacggatcatttgggttagtaggggaaccttatctggtcctgtgtgtttgtttttattcttcgagtgctaatgggcccgtgcaacagttgctgttaaatggctgattaaaaagcaacgcagaaagccaaacaagacccaaccaaatttggttattcatccgattcagaattattttggttaaatcaaaaataaaagtacaaaactacaggaacgcgcgtcttaactcatttgatcgctttgccttgcttgggaaatgcagtttcgtgtcacctgttgcagaagatatgtagttgatcatctagacataattgccgaagatgaacttctggaacaacttctaagtcacacggcatcagtatcagatttattacacaacgactttttcttttcactctatttctgaggaaaaagccctcccgaaatccgtaatgaatttctccatggtaacccctcttctgttttctcacagaaagtttctctaggctggtgccgagatgcatttggtgaaacacccccggccccccgcaaaaggctgctttgtacatagtcacaatttactaaattgtgaaattaacataaccaaagcaacaaccggcaagacttttcctttataattttgcaaatctagattaattaaattagaatctggttttaaaagcctttaaaaaataaagtttatgagaaaatatttgtgaggaaaaaagaccttttttttcgttgaagtaaggtgtgtcatgtctttctcagagagactagggtagtagaagtggttaacttgaaaagtttgattttaataaatgcttaaatacttattggagaagtagggtagtattaagccaaatgtgaacccacataggttgtcctaacataactgaaaaaaggt

SEQ ID NO: 87925 - DNA, 1003 bp, Homo sapiens
atgaagggaatgaatcaagtgtcaggtatttatgtcttatatgtagaaaggactacatgtaaatccttgccaacttaattttagtactttttttttttttttttttgagagggagtcttgctctgtcgtctgggctggagtgcagtgtcctgatctcggctcactgcaacctccgtcttccagactcaagcgattctcctgcctcagcctcctgagcagctgggattacaggtgcccaccagcacacccggctaatttttgtatttttagtagagatggggtttcaccatgttggccaggctggtctcgaactcttgacctcgtgatccgcctacctcggcctcccaaaatgctgggactacaggtgtgagccaccgcgcccagcctagtacgttttttatagtaataatttttaccttaagaaatcacatgttggtcttctttgcacccagagccggtaattgaaacacggagactgaattgcatacacccctggaggaagttttttctggttaaaaagagctgagacattttggcaggacagttcagctaactttaagtcctattcgaaggcatagcaaataatatttaagattgatgggtgtgcatatgctgacttaaattacaatttgtagctaggtgtcctttaagaaaaatgtgtttacttttgatacttttgtgacattttgtttttctttttttgagaaggagttttgctcttgctgcccaggctggagtgcaatggcacaatcttggctcactgcaacctccacctcctgggttcaagcaattctcctgcctcagcctcccaagtagctgggattaaaggcatgcagcaccacgcccagctaattttgtatttttagtaatgacggggtttctccgtgttggtcaggctggtcttgaactcccgacctcagttgatccacctgcctcagcctcccaaagtgctgggattacaggcatgagctaccgtgcctggtctgacattttgtttttctta

SEQ ID NO: 87926 - DNA, 2179 bp, Homo sapiens
tataatctaatgggaaaactttgcatttagattttctatagatttaaaaattagagctgaatcattgcttcttcgtattattttaacttgacaattattaaagaaatgtacttatgtattttaggggggtatatgttcaaataggaaatttgtagaaatgatgtaatgtattgatttgtaatgatgtcacgtctttatctacaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatgtaagtaaatctggtcttaattttttgtatgcatttaaaattagactagtttccttcgtgattgatgtagcagagctatgctgttgatgtggtataaacctttgtaacttaatagttatacagttaaataatttcttaattgaaggaatatgtgcattaaaatagcttttaagaaggtaaaggaaacatatatgaaagaagcaaaattccattgttttttgatgcctaggctaggaaatagaatgtttctagttgggactgggcacagcagctcacgcctgtaatcccagcactttgggaggccaaggtgggtggatcacctgaggttgagagttcgagaccagcctggccaatatggtgaaaccccacctctactgaaaatacaaaacttagccaggtgtggtggcgcacacctgtaatcccagctactcaggaggctgagacaggagaattgtttgaacctgggaggcaggggctgcagtgagctgagatcacaccactgcattccagcctgggtgacagagacagattctgtctcaaaaataaataaataaacaaaaagtttctaggtggaatgccactgtgggcctgtttttggttatgttcctctatagcctagctcagctcatccacccttaactttggtgttagggttgttttacttcttttttggttttaccatatctgtatgtaaaatggaacagcaagaaaatacctagttgtctaaggaaaggtcagttctgccattattggttggaatcccccaggagaagatgatcccaacagactgagggtcatagtctggcctcagtgttcctgagggtttcgagaagctcttctgggaagcctgtgggcgaggtcaggagacagtctcagggtttacctcagtcagggcatcaggcagggttatagtgtggactgagtatctgacatcctgtagatatatggtcagagggatgggctactttgtgtcttcagcttctgaagtcttcaaagccctcttccagttcttagaattaggtcaaatgaaaaaatctggtaggatgaaatgaatgtcagagcagggcatggaaaggagagttgaaactttatcagtgtgctgtcgagaggtctgaatccacaccgattcttgattctttgtggctggaagct

SEQ ID NO: 87927 - DNA, 1050 bp, Homo sapiens
gctgcccagactgtgggtctatgtcagcttgcagtttttgtcatctgtcacagatatccgtgacagatatctatatcaaggctatattttaaaaagataggctcattttactttttttaaaaagtagagcccataattagcatgtattatctagaggtgaaggtacaccaaattgattgaattctgtaaacacaattttgtttgtaatcttgatttttatttcataggtctaatgctttaaaaatacttaatttttcctctttaatagcttgtattgaaactcgtaagtgacatttgtggtactgttctatttggttatatataggaataatttttttgtttgttttacacattatagaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgagggtaaaaaaattacttgattaaaaagaaatatttcattagtgttatttatgaaatctccagttttacttgcaaaatgaaagtgaaatattgcaagcagctacctaatttaatatttctaaagagatcaggataccgtcccctcttataacgtgtgtaacaattgtaatgagttttatgtattagtgaatttgctataatgttatattcatgtctctatttatacttcccattaagttgccatttccctatgaaaaagaactattctttaatattataccagagtatacacttttgtatgtgataaaatgttcatttttatattaattacttaagcattcttaatatattattaaatattcttaaatactctctgaattacctattgcagcaatatccgagaatctacttgctttaaaatggccgttcaatggaagcaggttttttgtgattatttagtagttgactgaatgtggccatttgccctgaag

SEQ ID NO: 87928 - DNA, 2622 bp, Homo sapiens
aatttgggcatagtattcaggcagaagaccatagagttaaataatcctgcttaattctgtttctaatactatttgagtacttttgaaaagtaagactataagcttcagattttgaatactatctcagcaaactacctctgcaatatctggcgcactgtaagttttgagagatagtcatatcacttggttattctccagctctggggtatccaaaaaattgtctgccttgtactggagactaaggtgatacgagtcagtgagttagagttgggtcctcacccccccaaaaaaagtcagtgagttaatagcctggaagacttaaaaaaataaggtgttgcctaccactttcttttatacattgcattactgatacatgaacagattttcttttaaaaatacagcttcttaatgaaatcctaaaacaattgtcttttctgacaattcgtcatttttcatgtgatttccaatttaaaaatcagatattctatttttctagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagataggtaagaatatacttcatccattcctttaaagggaagttttttcttttttttcttttttttgtgtgtgtgtgtgtggttttttgcttttgtttttgttttttagtttttaattttttaaatgaaagtttggtggggggtggaatttagatgttcttttcctttatttttcattttttttttaaacacagcacttgcactcaatgtttttgttttcaaaatctacaaaagcacacagagcagggaagaaagatccttttcatactcccctccccaaaggtaaccaccatgcatcaacagtttggtgtgtaacattttagatctttctgcagttacatttatgtatgtatgtttacaaaggttttggagagctttgggcgattttttagttttggggttttttgaaatataaacaggatcattctgcatgtattgttctgcatcctgctttttttactcagtgatacatggagagaatctttttgtgttatgaattgaattcatttttttttaaagctgctgcatggtactccagagtatggatgaaccataattcatctactatttctctattaatggacatttatgttgttaacagtttttcattattacaaatagtggtgcttttgaacatccttaacgtatatctttgtgtacttgtgcaggtatttctggcagtatagaaacagtaagtggacttgctggtcaaatggtagctacatttaaaaaacagtgatggctactgcttaattgtatatcaaaagagatttataccagtaactttcatacatttctgtttccttattctctcacttaaattcaacaacatcattcctcttaacatttttgccaatggtgaaaagtatttcgtatacaaatttacatattcttactcatgtggttaagtttcttacatgtatttgttgaacttcctgtgaattgcttattcatatctttttctcactttttcctaatgagttttgttatttttctttaatgaattttaggaatgctttatgtattgttgctattaatcttcaattttacgtatatttgcatagtaattgcctacttttagctcttcgttgtcatacagacatttttacatttttatttacttaaatttatcaatctttttctttagagtttctctggattttgtgttttattgaggagggttatccccatcccaagaatatatatatgttttatagtaattctttataatacttctataactttgttttcaacctatctgaagtaataattttcatttgatatgagttggaaatctgttttaattaggactttttcaattgcaagtgaccaaaccaacttaaactagcttaagtgaagagggaatttaattagctcatgtagttgggaagtccgagccatcatcaggtataactggaccctcaggtatcaaactctttgttttcctctctctctcaccttttaggtctacatatatttatgtgtgttaacctcattctctcccagtacagacaggctattcccatgtggcagggaagatggcaccagcaatttgtatttatatgtttccaaggtctgtgacccaaaggcaaggcccctacttctgctccaaatcagaagcccttgaggaaggaatttgagtggcttatcttggatcatattgtttctaaccctatggccagggcaggcaaggtactacgattgatgcctccagcaaaagttgggtaggaatggttttctaaggaaacagggacgctgcaaatattatagcatagtaaatatctacacttccatcctttggtagctcagcacgtgtgtgtactcacatttgttctcatacatacaattcaaaaatggttctgcctaatataatgcaaagatttcacccacaacttaaaactttttcaaaaacctctttcccacagttacatcctgtaattgta

SEQ ID NO: 87929 - DNA, 1973 bp, Homo sapiens
actggggaggctgaggcaggagaattgcttgaacccaggaggcagaggttgcagtgagccgagatcgtgccactgcactccagtctgggtgacagaacgagactccgtctcaaaaaaaaaaaaaaaaaaaaaaaattaaattccagtagatctcgaggtggcttatcttgatctcacaatccatgagccacattatgaatttaactgcctatgacactcataaacatagtagagggtgttctttaataaaactggatgccattgtttttctgggagaatggctgtgtttgagaggtgagaaacatataagaagattccccttctggaggccattctgttttacctgcctagttcctgctgtctgttactggggttgggttgctggggacttctataggattaaacaatcatataaccctatttggcaggtttggggttttttctgacagtagcactcacttgtagattcctaggttcccagctagtacttaatgcccagtaacttgctttaggatccatgaaggtgaacaccctccacttcctcagtttatctgtttagtaggccaatagtcctagtcctcaggtgaagagtttgtgtaggcttctgcctgctggtatcattaaacagtgagctgcagaggctgatgtagatctgtagcctgctgccaggctgcatcacaaggatccactgctttataataggaggaatatggcctttgggcagagggtgttcagtaaagacctctaccctcagtttagttctttttctccattcctttaagtcttacccctgtggtaattttctcctcctttcccttatttgcactaaatttagcaagtgataaaggattgactctgagcagtattggattgttggctctgaattaggaagctttttaaaagcactgtgtcattctctttctcttttcgggaaatctgacccagaccaaatgatgtctaaaaagtatctattacaggactttatagatggtcccaagaactaaccaccatagttcaacatcttggcataaaactccatgatctgaaggccaggcgcagtggctcacgcctgtaatcccagcactttgggaggctgagacgggtggatcactggaggtcaggggttcaagaccagcctgaccaacatggtgaaaccccgtctctactaaaaatacaaaaattagctgggcatggtggcgggcgcctgtaatcccagctacttgggaggctgaggcaggagaatcgcttgaacccaggaggcagaggttgcagtgagccgagatcgcaccactgcactccagcctgggcgacaagagcgaaactccatctcaaaaaaaagaaaaaaaacctccatgatctgagacccaagagaaaattgatagtctgaccaactgctttgctaccacacatccaaagtgacttgctttccagcctggggtggcaagatgctcagtaccctctctccattttgacttattatttaaggagggcaaagaggtgtgttctttctgtttaaaacaaaaatctgtggaatgtgagataattttaattaccataccttaaaaatcggggctggaaatttgtagaaatttctagacctacttttgaattgtattttctttatttccaaaactgtagtagtgtgatattttggagtcaaaatcttaaaatattctaccagattatttagaatttactggttttgatagaaatacatcaaacttgcttaaaaagggaattttattgacatacactattgagaagtccagtgttggtgacagcctcaggtgcattgttggatctagggagccaaatgaggttatcgaggctacttctgattttgccgtttcatatttttctgtttatttcttctttgtgatgggcttattgtttgctgttatcaacggttttctccatgttgtgggaataaaagtggccaacttctgatttacacccttcctgctcattagtac

SEQ ID NO: 87930 - DNA, 1273 bp, Homo sapiens
ttctccatctctggattttaaaaactggaaaaggatgctgagaggattgagccaaagagccagtcctgggacagtcactgtggccagctagtggtgtgctttgtctggccacgctgggtcctgctgctcgctccaaaggggcaacatacttgatttgcagccctggcagaatcatatgattaaagtgtgggagggcggtggtgagggaagtatctccccaaaggaaagaaggggtatggaacaggtaaaattaacagatgtttacaaaattgtcttaattattttccccaaaatgcatagccagttttcccaatcctagtttttctctatttacttaaaatgccatctttattatatatcatatagtaaattatctgtcttttcatttgccagtgccacagtgtcttcatttttttaaagctttaaattaaaaaggaaaaatcagagcttattcaactatctggtcaatggaaatttaacagtgatgcagtagttttagaatgtatacaaatttttccagcctgggcaatatggcgaaaccccatctctgcagaaaatacaaaaaattagtcaggtgtgctggtgcatgcctgtggttccagctacttggaaggctgagatgggagaatcacctgagcctgggggttgaggctgaggtgaactgagattgtgccactgcactccagcctgagcaacagaatgagaccctgtctcaaaaaaaagaaaaaaaaaattcagccaaagtgagattgatcagtatgtaaagcagaaatttgctcctgtggagtttagtgtgtccttaaaaatttactaggaaaatgttgagaggtctttattaggttataaaaaactaatttagttgattgttttatattgataagcctacacagataattatctaaattccctagtggaaaattcatgacatttatgtttataagctcaaaactatttggtatttaaacagaatttcagtggaaatctttcaaaaacttaaacctttttatacagaaatccatattgaatatataaggcaacactttgttagtttgctttttgagttattattatgtttgttacttgtaagtttgtagcagctcttcctgttttcaaacagatgagtttttaaacagataacccagcatgtttcaattttttgtggaataatagatgactcacagtaaagttacaacatattttcttttaagtaaaaaacttaaggaataatgatacttgctttgccattcaagggcctttttttatctgtttactt

SEQ ID NO: 87931 - DNA, 1063 bp, Homo sapiens
ttgttctacagaagaagcaaatcagtagataaaatacagaatccaaaaatagacctaagcatgggaatttagctgtagtagcattgcacatcacaaagggaaagcatgtttgggaagatatcacttagatctctgccttagcaaaaaacatttagattgatgaagaattgttaaaaaaaaaaaaacccagaaccctaaaaacaaaagaaaacgtcaataagaaagcatgaattaatttatgtttttgttgtgatactttctttttaaacagataaaaaatccagatgccatagaggaaaaaagtggatacatatatttaaaattctgagtggaaaaatgttattgtaatcaaagtcaaaagacagatgacaaaccgaggaaaaatatttttaccacaaatggaaaattttcttgattgacaaagaccttttataaatgaaaactactaatagtctaatacaaacaagacaaaggatttgaataggcattttgcagaaaaataaatatgaaaggccagtagacataaaaaatgattacttctctcataattaaaaacaatgggatagtattttttacctctgagtttgactaacagtttagaagttcaatactaactcagcatgagtgaaggtgtaggaacgcagggtggctttatgattgcactgttctgaagagtagtttgaccctatatccgtcagcattttcagtgcaagaacttttggacccagccatcccaccactggaggatataggggggtactccccaggtttaccaagaaagacataaaatattgtttgttacagctatggctgtgatagcaaaacaccacaaaaccctgagcaccagtggagttgaagttgagttcattctcttggttggacttcgttggccaagaagtagaaagaaaatctgccactggcacacccaccagcatgctactctgggataggtagcatcagagattagccataagactgcctaactggccttgcttcctccacaaagagaagcctttgtatttggtgataaaagggacctctttgcctcatggacaccaagaac

SEQ ID NO: 87932 - DNA, 5569 bp, Homo sapiens
cccctcaaagtgctgggattacaggcatgagccaccgcaccagcctatagtattaatgtttatcttgtagctgactatgttactgaatcacagttttttgttttttttttaatttttggacacagagcctcactctgtcacccaggctggagtgcagtggcatgagccaccgcaccaggtccccccccccctttttttttttatcctgcagtgttttaaaacaaatttcctaaatcatatttcaccaaaaatgttcacaaagttttctgaaatgtctgaagttcaggcattccttctgtgttttaggtcagccaggcatataggattatatggtaccttatactcaataagacctttgtcttttttttttttttaaatgaaaaaatgaaacataacttgctggaaattacttgtttattttcactaaacttgacatattaaagtgctaatactctggaaataacgtaaattatcgttacatggttctttttagccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaaggtaaggagagtcagctgtggagggcagcctgggggtgataagaatgcactggatcagggtcccaccacaggaaaggtactgcgttgtgttttcttgataacagctttatcaaaacataattgatatcccatacaattcacccaattaaagtgtaaattcagtggcttttagtatattcacaaagttcaaccattattacatcaatcttagaacattttcataaccttgaaaagaagcctcattcatacccattagcagttacttcccaacccctcccgaaagtgccaccagcttagtggtctactttctgtctctctggatttgcctattttggacagtccatagaaatggaatcagacaatatgtggtcctttgtggctggcttcatccacttagcatggttttaaggttcatccatgttgtagcatttatcagtactttctttttgtttctgaataatactctgtatggatatgccacattttgttatccattcatcagttgatggacattgggctgtttcctcttttggctatacgaataatgctgctatgaacattcatgcagaagttttttgtggccatgcgttttcacttctcttggcgatatacctaggaatggaattactggatcatatggtaactctgtttaaccttttgaggaactacattgtcttttgtaacaagtcatttttaaaaaaaaactagataagctagataatgcatgtggctagagatactttaaaaaaatatttttggctgggcgtggtggctcatgcctgtaatctcagcactttgggaggctgaggtgggcggatcacctgaagtcaggagttcaagaccagcctggccaacattgcgaaaccctgtctctactgaaaattcaaaaataagccaggcatggtggcacatgcctataatcccagctacttgggaggctgaagcatgagaattgcttgaacccaggaggcggaggttgcagtgaactgagatcatgccactgcactccagcctgggcaacagagtgagactccatctcaaaaaaaaaaatatatatatataaattcctcctttcagagtaaaaattacatttatataaatgtctttgtttcacagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatgtactttaaaatgtatttgggggagggagaaaattttaaaaagaattatctcacaagaatatctcatttttaaaaaatgagataatagagataagacaggaaacatattaatggccaaagatagtaatggaaacaggatacagaaagcttcaaaattggccaactaatgtactaaagtttttgtagggaaaaatgtttaaagtcttaaaatttaagggactattttaaaaatgaaattcagttttaactttcataagacaaaaggaacatgtcagatgtgattgtttttgtggtctgattttctgagttactgctctgggaacaagataaccaccaactttctggaatgtttgtattttatttttattaggtaattcataaaaaataagacataaacacgcctgtaaatttcataaagcttatcataatgtgaaaatcttcctaatgtagcttagttgcatgataaacatttgttttggagttctctgttatttatgtatgaataggtagtctctaagattccttagaaatttttttaaacccagaaatagtcctaatttaaaattttctgggcactttaggtttaggggatgcgtcctaaatagatagtgttggtagttgtaaaatcatgtagttttatgttgggaaggcaccttagaaattcttatcttttgtaaatgtacagtaatttgcctgtggctacagagacacaggaatagtgcccggttttcctaaatcccagtctagtactttatttgctgtatcacatttcacttatgtgtccttgctttctcctttttcatgtccttgtctttatcttttcacccctgtaattgagaaggatggaacataaacactgaaaacatgagagttctgggaacatctttagaaatcagaatcagtcatagttgcagttagattttgctaggaccctcaaattatttcagcgagttactgagccgttttcatttccccttaggcttcgtttttgtgtgtcttttaatatttttccaatttctttaaaaatcacacttttttggtttcctttatattaattacaatcagctagaaaaaaaagtaagtactctctataaaggaattcatttattaatacaaccagtcatagtttgtttgaccaagttttttataactcatcttttgatttgaaataaaatatcatcactccattacacattcaatagagacagctgaaaagtacaatttctctgcagggcctgcaatgaaggatttgcagaatcctgcagggaatcaaggaactcttcattacaattcatggatttataggattactctgcacttttctgctttcttcattgagagcggtcccaaaatgtatccttgactgtcctgcaggtaacttctttcccactggaaaagttactatgtacaaatactttaattaaagtgacctggcagttgtggaggccgacctttctgctctttgt

SEQ ID NO: 87933 - DNA, 1026 bp, Homo sapiens
gtacctccacacacaatgtttagaaacaaacatgaacacagagagatttgtctgttgataagtaactaatatggtattgtcctttttttttttttttttttgagatagagtctcacactgccgcccgaggtggagtgcagtggagcgatctcggctcactgcaacctctgccctctgggttcgagctattcttctttctcagcctcccaactagctgggattacaggcgcccgccaccatacccagcttagttttagtagagatggggtttcactatgttggccaggctggtctcaaactcctgacctcgtgatccccccaccttggcctcccaaagtgctgggattacaggtgtgagccactgcgcccagctgatattgtcctttttctaatattttactattcattgtagaatttgaaaactacactaatgctgttaaagttttattagtattaactttattcatcatccagttgttcatgttttgaataaccaccatttggatgcagaatgtttttgtccgtttggaaaggtcttactagatttgtaagatgtttttggtttaatttaattaattaattaattaattaattaatttagagacagagtttcactcttgtcgcccaggctagagtgcaatggcatgatcttggctcactgcagcctctgcctcctgggttcaattgattctcctgccttagcctcccaagtagctcggattacaggcatgcaccaccatgcccaactaagttttgtattttttgttttgttttgtttttgagacagagtctcgctctgtcgcctaggctggaatgcagtggccggatcttggctcactgaaagctacacctcccaggttcacgccgttcttctgcctcaggctcccgagtagctgggactacaggcacccaccaccgcgcctggctaattttttgtatttttagtagagatggggtttcaccgtggtctcaatctcctgaccttgtgatctgcccacctcggcctcccaaagtgctgggattaca

SEQ ID NO: 87934 - DNA, 1037 bp, Homo sapiens
catgagccaccatgcccggccctaagttttgtatttttaatagagatggggttttgccatattggtcaggctggtgtcgaactcctgacctcaggtgatctgcccacctcggcctcccacagtgctgggattacaggcgtgagccaccgcatctgacctcattttattcttttagaaaatttaaacattttcaggtttcttgtttttgcaaaagttaggatttttccttcaaaactcctttatcacatttaataacaattatctatttctctatatttggtccccaaaattttcctaacagatattttggaattaggttaactttataaagtcttcatgaatttttgccttatcaaccttacaatgaaacattctcattttataaacttatatggcatttaaaatgaatatagccccttttaaaaaaaaatgttaggtgcgtgttatgcctatgaatgaagaagtttttcttttaaaggacatataataccaaagtcttacaaaaccatattataaatactggagtcctaatgaggacaagaaacacagcccttcagtttagtagagtgaatatgaatgtgtatgtgtatgtatatacatatagatatatatggatttctttggttttcctttcaggtatagacttcagacagtaaagtccttagctggagtgagcctgatgttacggttactgtgggcaagtttgagatgggatgatatggcggccaaggctcctccaggaggagggactacacggacaggtaagggggaagggagttattttctaatttaagtttaaaagctaaaatcacaggccaggcgtgggcgctcatgcctgtaatcccagcactttgggaggctgaggcaggtggatcatgaggtcaggagatcctgaccatcctggctaacatggtgaaaccccgtctctactaaaaatacaaaaaattacctgggcgtggtggtgggctcctgtagtcccagctactcgggaggctgaggcaggagaatggcgtgaacctgggaggcggagcttacag

SEQ ID NO: 87935 - DNA, 1743 bp, Homo sapiens
agtagttagaattacaggcatgagccagaatgctcagctcatttttgtatttttagtagaggtggggtttcaccatattggccaggctggtctcgaactcctgacctcaggtgatccacccacctcagcctcccagagtgctaggattacaggtgtgagccaccgcagccagccataaatacgggtaaatttatatggacatatattctttttggaagtaaaatacttcagaaatgtagtggaatttcttaaggtgagagaaattgtggacagacttcttgtagaatggtattgtttttatttagaactattttgattcatgtttcctctccttcacttttttagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggtatggaactatcattaagtaaaagattactttggttcaggaaaaagaattttcaaccctttagctactgaaatgaaacatttttttagaagattgtttttcttttgcagccagttgagcaaacaagctgtaacggttggtttgttacaaataatgttcataatattacattagcaaactcctctcttacattatttcactttcaacatttacatagttcactttgagtggagaggaatgtttttattaaaaatacaaaatgagccacatttcatgcattggtgccctttcctagaagtcactacgttgctggttattttaaatctaaagcttattaaatgtcttataccccattagccaccagcacagctgccacatctgctacaaccattgccagcacaggtcagacgttccaaattacaggcaatccagtcactatggcaggaaaagtaattaccaaactgccacttcctgcaaacagcaagattgtcgctgtaaatgtgccagcaacacaaggaggtaagggaaatgtgaagttttaattcacatttgccagatcatactgttgccattatttttcatctccttttcactgatttcagtcctcggatctcacattctatgtagcccactataaaaccctgccacacgtagtttctcctcagcaaccgagcaccacgtaatgctttccaataaagtgatagtttttaattatggcttcatctttttttaaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaagaattcttacagacttatttggtttgatgtgttgagcacatcacattatttttagaatgacttcttccaagattaatccaactcagtttcctttgcctattactgaatctgtgacagagtactgatttggaaaaaaatctgttatatttctgataagtgaaaatgatacatgaagtattaatgtctaacagttaatgacacattagtatggtttatgaagaataataattgctttctaggattttataaagaaaatttctt

SEQ ID NO: 87936 - DNA, 4816 bp, Homo sapiens
caaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtagagctgtgggtttatcggaaatgtcggatgttactactacacgtggctgggctaacagaggccaacaggagaaccagtatttacctttggaaggatatgcctcaagccagtgacctcaacagttgacatagtcagcctcacaacgtctcgaagcttttgtaccctattcttacagactccctgttaccaccaccctctccctcctattaaaaaagagagagagagaaagggggcaaaaataatggttatcttggtaactatgcccacacttactccttgctaagccttgtaggtgctgattcagtcatggaggtgatctcagggagggtgggtaaatccagttcatgacctcagattgagagtgggtccagaaccactttgttgaccttctgctgcaagtcattgtaactaactaccaccacatcatgggagaaaagtgaagcgtggcaattagcctgggccagatgacccagctgatttccagaggctgcaacttactttggaaaccagccctctagagttaggagagtgtacaggggacagccaagaagcagggcccaggcttcccagtttcagagcgtcctgccctaagcgtgtccaaatggagcatttcaaaggcatagaccttctgtaccaaaatacaaaattctcaactttatttactttatttattttttcgagacagggtcttgctctgtcgcccaggctgaagcgaagtagcaccattactgcttactgtagccttgaactcctggacgcaagcaatcctcccacctcagcctcccacgtagcttggaccatagccatgctccactatgctcagataattttttattttttttgtttttgtgtagagacggggtctcactatgttgctcaaacgatcctcccacctcaacgtcccaaggtgcacaggtgtgagccaccacgcctggccagaattctcaacttcagaagatttccttcagattcttctttaaccacagttttatgttccagagtaatagaaatggttcatctttcctttttacaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttactgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtaaagttattaagtaaaagcagcatgttcagtagcttgaattattgtgctgtgcagtagaattagtgtttggttgtgttaggtttcctaaatgagacaaagtcattaatgtttaaatttagaagaaacactgaattgaccaaaaaaaatactgaatgactactgtggtgtggaacacttcgttagatacatataatatatagtcagtgcttattaggaatgacctgtattttgggaggactaagatgggaagaatggagttatgagctttaatctttaatataaaacttgagggtttaactaagttttaaagccacttcagacattatagcaattcctttaaagttattgaaagttgtcattccttagtttgcatgtagactatgcaaattatagacagattaaactcatttgcatttctagccacacctttgtaaaaaagtttttgaaaacatattatttcatagcttaagtaaaaagtggcatcatccagcaacatcttgcaatggcacattagtgaaataaagcaatttagatgagttagaattagtctactaaagtgaagtcacacatataacatctgataacattactggcagaaaccatcttttcatctacctatagcttgcttcgctcagcactaggcaggagtttgaatgtggattttaagtgttaccaagttgtgagaccttcattcagttcctaggtctcccattcacagtccgtgaaactcacttatccctccttagctatagcctcttaaaacccttctctttccagccacatgagattattgcaatgattaaatgaggtcataaatgtagaagcactttttacacagcgaagttattttaaagatgtagtattcttatgaaaatgacggtcatatatattatatttaaatgtattattacccagctttactgtgtatctataaactgagaattactacactgtctgtctatccgctaatctttgtataggggagacgagggacagttctttaaaattcattcctgggaagaaagcataatgttaaaaatacggcctttggagaaggatagccaggttaaaatttcagctgtattacttactgtttgtcaaacaaggtggttaatttctttatgtctcagtatcttgtttataaaattattgctatggttcagtgttgttgtaaggaataaacgaggtaatgtcaagtgcttagcctagcacggtacccagcaggtggtaagcacccaggccatctggtagctgctaattttatttatgttacgatataaaattcttacagtttctttaaaaaaacacatatgtgctcaaatttctactgttgttatctgtgtactaacctgtggtgattataaaatatgcgcttttggatttattctgtcctgaaggtggtgatgaagcataatgctgtaatagaacatttaaaacagaaaaagagcatgactccagctgaaagagaagagaatcaaaggtaggggagacgcagggtcttgttgtctgtccgtctcttctctttatcgtgcacacgcacagagttctgagtttatacttgtttatcttgattgaagttcattaaatgagaacacttggcactaatagttactcataactggtttgaaccactcttgacgttttccagtcacagaaagtttttgtctcatctgtagaggcatagaagaatgatgtcttaagcctttcaaaatgaaacgcccagcattacataggttgtgtatttttctctagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggtaagagggcacatccttttcttctgtgtccagtgtttaacatctgaggttctgcttttttcccttgcctttttaataaagcttaaaatttcagtatgttttctagaacttacatttgtgtacatagagtaaaaagcagtgcagcgtgtgtgtcttgcaaaacaagtcagagcttttataactaaatgtgtagttatattgtattctccagactagcaactctgagaggtgagcttgttgattgaattgttgaaaaactctgagaagagcttttcatgtctatgacatagtctagccaaaagtaattaggagcagagcttcatgagaaaggtacagagacagtgaagtaacgttgaaagaatgaaaaataacatgagtccattaaataagacaaattgcaccagaatgaggtggctcactcctatacttccagcagttggggaggccaagacaggcagatcacttgagcccagaagttcgagaccatcctggccaacatggcgagacctcatccctacacaaaatgaaaaagttagccagatgtggtggcacacagcccaggtactcgagaggctgaggcaggaggatcacttgagcctggcaggttgaagctgcagtcagccctgatggcaccactgcactgcagcctgggcaacagagcaaaaccttgtctcataaacaaaacaaac

SEQ ID NO: 87937 - DNA, 2694 bp, Homo sapiens
gtgtaacttctacttggtgtttgcgctttgctttgttttcaaatttaaattgtgagatacattttcaaacctatctaagaaatagccctgatattgaaatggcttctgtggaataggtttgacagatgtaagtctttgattctttggctttggtttttgtgcctgttacagttttacacacattcattcagaggaagacattaccatcaatgtgttgtttcttttttcaaattccagtatgtttttaaagacccatatttcactaagcagtgtacttgttgaaactgatgtgagtgactttatgtttccacatgtgatagagcatcagatactggagtttgccaggagtagaatggttggattcagaaatgtttagctgactcattgcaggaagttacactgtaaaaaagtgaatcaaggcagggaagacagatttaagtaccatgcagctcaaaatgacaattacattgtcattttcattgtgaatacttttaggttctatattggctgtgatctttgtactaactggtatcatggagaatgtgttggcatcacagaaaaggaggctaagaaaatggatgtgtacatctgtaatgattgtaaacgggcacaagagggcagcagtgaggaattgtactgtatctgcagaacaccttatgatgagtcacagtgagttctgataagagcatcatatttaataatttaggaagccaaattgctctgactggttacttatttattttaaaataaaaagcagatttttttctacatttattatacacttacattacaaattccttttcatttttctctttttccctttttacctacccttcaaaatttatcttgcttcatagtgaatgtttgagacacattggggaaaatgtggtttaatggtagatttgattcttcaatatgtaacatagaaattaatgagattaaaatagcctgacttgtttggactttatcagtgtttgaaatggtgctttattgtaggttagaaaaacactaatttgggtacaagctctgagactctgttattagcttataggattttgaacacccatatggtacagtactagttgaaagatttttggctttgttttcagctttaaaatcaattgaatgtttcatatttatctttaaattggttctccagtattacacagtgttcttataaatttttttactgcttgttcttaacatcaaaaatactaaattaatgaactggaatgtcaatcttgaaagtattaaaaccataatactaaaactattttatatcccagggtttagcaaattttcaggtgcatgctttattataagtaacatcatcccatgtgttttgaactcacatttccatttcggatcttgcagattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggtgagacccctctgtgtgcagcatttcaaaatgaaatcagccagcataattttggaagcatttctaggatttcaagtttccaatcttagaatgattatttactgactcccagctagtctagtgaagtgcctaacaaactgcagtccttcacgtaccagtgccatgagctttaccatatccccacaccacgtcagcttatctcacactcacaagagtgttaacatgactcacttctttatacattttatttttaaggagacttcctctcacccccatggattgagaagcagtatgattagattatagttgttcttggccgggcatggtggctcatgcctgtaatcccagcactttgggaggccaaggtgggcggatcacaaggtcaggagatcagaccatcctggctaacacggtgaaaccccgtctctactaaaaatacaaaaaattagctgggcgtggtggcgggcgcctgtagtcctagctactccggaggttgaggcaggagaatggcatgaacccgggaggcagagcttgcagtgagccgagatggcgccactgcactccaacctgggcgagagtgtgagactccatcgcaaaaaaaaaaaaaaaaaaaaaagattatagttattcttttccttatgaaaaacaaaaaggggactgggcgtggtggctaacacctgtaatcccagcacttggggaggctgaggcgggtggatcacaaggtcaggagttcgagaccagactggccaaaaggatgaaaccccatctctctactaaaaatacaaaaaattagccaggtgcggtggggcgcaccagtaatcccaactactagggaggctgaggtaggagaatagcttgaacccgggaggcggaggttgcagtgagccaagatcgagccacggcactctagcccaggtgacagtgtgagactctgtctcagaaaaaaaagaaaaacgggatcgagatggtttgcaggattagcaagtgatagagatatattgaagacatagaaagccagtgtggttgctcacacctataatcccagcactgtgggaggccaaggcaggaggatcacttgagtcaatgagttagagaccaacctgggcagcaaagtgagaccccatctc

SEQ ID NO: 87938 - DNA, 1072 bp, Homo sapiens
tcgagccacggcactctagcccaggtgacagtgtgagactccatctcagaacaaaaagaataacaggatagggatggtttgcaggattatcaagtgatacagatgtactgaagacacagaaagccagtgtggttgctcacatctataatcccaacactttgggaggccagggcaggaggatcacttgagttgacgagttagagaccaacctgggcaacaaagtgagacccccacctctacaaaacattaaaaaaaaatgagctgcacatgttggcacgcacttgtaatcccagctacttgggaggctgaggtgagaggatcacttgagcacaggaggttacagtgagctatgatcacgccactcgacaccagcctgaatgacagagcgagaccctgtctcaaaaaagtggggggaaataaaaggatatagtgcactggattgaaactttctcctgtcgttatcataatcagaagaattgaagtaactaaaaagagaatcatagtctcaatgtgtgcttgaatgttatctaacatcacgtctctgctacctcatcattaaccagctgtggtaatgattccacactttgaacccatcccacctgttgacagaagcgattgcaatgccagcatcactcagtgacggctcatcatgtagggcccagaatactgattttgtgacttctaagcttgtgctccattcccaacacaaagtcttctgaccagcctttgagtaccattattgtagaggaagctcatcttaggtaactattactagagcagaaatcacttaatataaaatatttcatgtatcaaatttaaaactcacttttgggttcattgatgtagtaactcaaccaggaaacttaaatggaattagtgttttcactgacaataatgatgctgctttttcattataggcccataagatggcctggcctttccttgaaccagtagaccctaatgatgcaccagattattatggtgttattaaggaacctatgggtaagtacatgagttgaatatgaagtttttcagaagtctcagtggatgttttattatccataaaattaat

SEQ ID NO: 87939 - DNA, 1050 bp, Homo sapiens
catgatgtatctttttatttagggacagggtcttgctatgacccaagctaatcttgaactcctgagctcaagcgatcctcccaccagccttggcctcccaaagtgctggggctgtgaaccactgtgctgggccagaaatatatatatatatatatattttttttgagacagagtctcactctgttgcccaggctggagttcagtggcacaatctcggctcgctgcaacatctgcctcctgggttcaagcaattctgctgcctcagcctcccaagtagctgggattacaggcagccaccaccatgcccagctgatttttgtatttttagtagagacggggtttcaccatgttgaccaagccggtctcaaactgcagacctcgtgatccgcctgcctcagcctcccaaagtgctgggattacagatgtgagccaccgtgcccggccagaaatttttgtttatttgagttcagaaaacaagtggttcaggaaagcaatgagaattactctgacccaagatgacatttatacagcaggctgtaaaatgtcagcagaccaaatcctagcaggagaatggagcactccccagaggctcagtagagcaagaaaatgactcatacattagataatttgtttaagacagaaaaacataaggctatgattaagccaaagaacgtcagggataaaaatgaaaggcaattagaaacgccactaaaaacagaaagttgtgtaagtgtaccctgttagctgggcacggtggctcatgcctgtaatcccaacacattgagaggctgaggcaagaggatgcttgagcccaggaattctagaccagcctgggcaacatgaggaaaccccatctttacaaaacacaaaaattagccaggcatggtgatgtacacctgtggtcccagctgcttcagaggctgaggtgggaggattgagcccatgaggtagacgctgcagtgagccatcttcatgccactgcactccagcctggaagacacaacaagaccctgtctcaaaaaaaaaaaaaaaaaaaaaggccctgttagc

SEQ ID NO: 87940 - DNA, 2229 bp, Homo sapiens
accagcctgggcaacatggggaaaccccatccctacagaaaatacaaaaaattagccgggcatggtggcatgtgcctgtagtcccagctacccaggaggctgaggtaggaggatcacctgagccctggaggttgaggctgcagtgagctgtgattgcgccactgcactccagactgtgctacagagtgagaccttgtttcaaaacaaaacaaaacaaaacaaaattacaatgtaaagagttgtataagggcaacttgctgttgcctttttagggaatttctattgttttccagatttaaggcagaatgaaacataactagccagttattgaaaattgatttatttatggattttcagaatttcctttgccatattttcccattttatgatctccagcattgtttgcacattgttttcattactgcactttgttataattcatcatttataccatccatattctttcttttcttacagattgtgatatctttagtctgaatttttaactggaatcagaactggatgttggggtcactctttgttttattgtacctcgtgattacctaattcaaaattgccccccaaaaagtcagattagttaatataattttttaatgttaaagatgtatcgtggtaaaaaatttactctagcagccatgttgaacaatgtatttaaaaattgtaaactcttggaatactgtatttatctgctatttcaatataaagtcctttgacttagtcctggtaactgtacagtaatttggtttactaatgaaagttgtgaataaaactgtgaaactagaagggagactttctggactttaatagaaaaatgtgattttaagattgctttttcttttgttttagcgtaatttttccctttatattcccctcatcaatgtaaataaacacacacacacacacacacacacacacacacacacacctttcaccacaatggtaatgcttctgtaaatgcctctatttgtccagttggctgaaaatgttgtaatctttattagacaaatatatatatatatatatatatatatatatatatatatatttaaatattggctttttccagtgagctattatgtttagtgtacagtgaaaagttttaatattataggttaaaattttcttaatcgttcttttctattcgcttgccaagggtgaatgaaagaacatggctgcttctcccagactgactgaccttggcatccgcataaagcatcattgttttcaaaaatgaagggtgcttaattgttcccttttttctatattctgtaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaattattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaaatgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgcgctaatgatta

SEQ ID NO: 87941 - DNA, 1025 bp, Homo sapiens
ttatactttacctgccaagttcacaatccttgaaaccatttcatgaaaagtattttcctattggtaaagcttttattctcctatccaaattctgcaggaggtttaaataaaattgtggctgggcatggtggctcacgcctataatcccagcactttgggagactgaagcaagtgggtcacttgaggtcaggagttggagagacctgcctggccaacatggtgaaaccctgtctctactaaaaatacaacaatttagctggacaagaggcacacgccggtagttccagctactcaggaggctgaggtgggaggacagcttgaacccgggaggcagaggttgcagtgagctgagattgtgccactacgctccagcctgggtgacagagcgagactccgtctcaaaaaaagtgagcttttggagatattttctgaaggaaaataattacctttttatatttcaaatggcctagagtgttatttagagacactaagatttgctgttgtttgtaatctaccttcctaggatctgcaaataaaagttacttccctatttctgttaattcctttaggcaaactctctgctgctttatgttaaagagccaacctggtggcctttcagatctctgcacacttagacaaagctacatggttattacagctttcgctcttcatgattgaagctattaccgtaggtctcagacttcttgtccttaatgtgagaatggtgatatttcatggataaagtaatgaagtacttgaggaggtgggggtaagaaccagctgagaagtatttttaataatttgaaacattctgaggtacttctggatacttggagcgagatactagaagattttctcagaagatcataccgcttgatccaatttgaaccaaattcaactaaagaaattagctatattttcaactaaaattagctatatttttaaaatgttaatgtcctgctttatctaatttatttattgcttgctcaaatatttcctgaaattgaggtgatgcattataggtg

SEQ ID NO: 87942 - DNA, 1029 bp, Homo sapiens
agaatcggagcgagccaggcttgagggcgaatgtcccgggaggacttgtggcggccctggtttcgcctcctcctttctcgttgcatcttccccggcgtgggggcaggggctgggggtggcagttgggagcaccgtctctgacacctaggccccgggggtggctctgccaccaagtcgtaggcgagcgtaatgaaagcaaagatagcaaattgtaaggagggctttgacttttgtcatcttctgaatgacgcacagctgatgtcatcctaattaagcgcattcactcctagtctctggaaatgcaaatcaaatatgcgagatgcggcactgcatttttaatgttgaccataatgtaatgatgaagcaaatttttatttaattttcgagtctgcacctattttggccaagtaaagacagtaaaatagggagagcctcctgaggatctgaatttattgccctggcacataatttttagctgtaagttgacttggttcccctactttgtcttgaattaactattagggactctggagtatcgaactaggctgtcagaaacggtggatacatgtggctagtccaaattgaaatacgctgtaagcttaaagtacacaaaagatttcaaagatggagtatggaaaaagaatgtagaagatgtcagttattttatatattgataacacgttgaaatactatttggatatgttgggttaagtaaaatacattattaaaattagtttcacttgtttcttttctcctttttaaaaatatggctactaggaagtttcaatttatatagcttgcattctatttctgatggagagccctctccaggaagtctcagccctttagagggaagggggacacttcccctttgggtaaagctatttcatagtgccgaaaacatgatgatcccccctctagtatacaggtgtggattcagtagatgcttgataattcagttcttatttggtactattattgacaaaggaaaatgataaaggaaatatttttctcttcccccatctttta

SEQ ID NO: 87943 - DNA, 1026 bp, Homo sapiens
tggcgcatgcctgtaatcccagctactcaggaggctgtggcaggagaatcgcttgaacccgggaggtggaggcggtggtgagccgagatcacgccattgcactccagcctgggcaagaagagcaaaactctgtctccaaaaaaaaaagtcgggcatggtagctcatgcctgtaattccagcactttgggaggctgaggcaggtggatcacctgaggttggcagttcgagaccagcctgaccaacatggagaaaccccgtctctactaaaaatacaaaaaaaaaaaattagccaggcatggtggcgcatgcctataatctcaggtacttgggaggctgaggcaggagaatcgcttgaacccaggaggcggaggtggtggtgagccaagatcatgccactgcactccagcctggggattgagtgaaactccgtctcaaaaaaaaaaagaaaagaaaatcctcagaacgttgcctatgacttcatgtctttctccctcaaagtatatctgaatgcaagtgattgagactaacgtagaaataatcttcagtctgctctgattcttgatttttgagacaaggtcttgtatggcgacaggcaaacaccaccatgcctggatattttttttttttttttttttttgttgggaggtctcactgtgttgctcaggctggtctcacctgagctcaagccatcctccctcctgagcctcccaaagtgctaggcttacaggtgtgagccaccatgcctgtccttctcgttcattttttaaaattgttcaaagctgccttttttagcgacaaaacacttggatactccataacttgagactccagtgagtccatgacaacaagtttggaaactgttctacatataaaataatgaatatttaacaggcaaaattaaatgtagggctaaatatttagtagctggctataagcctaacgatgtttacacttgccttcacaagtaagtgtggattttattgtttgtatttaatcttaatgataatgtgcaaactttcactttt

SEQ ID NO: 87944 - DNA, 1861 bp, Homo sapiens
tgcagggatggaaaggagggtaatctacattaatttctggaaaaatggtagttaattataccgcatacatagcaccatacaagtaatctgttcagcttctcttaggttccagaatgtctcagcatttagtgatttacttaaaaggttgtctgaagttctaaactcttgaattgcattttatattggtttttacacaaactccttttgttaatcactgtcaacttttatttctctttttgttcccctttaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtacttggacttgaagttcttttgactgaatgtatctaatcgtaattagttggaagaaaggccttgttataagtaatagtgactttgtcaagttttgagcttgctttcaagcccttattaggaatgaaagtgtcgtctttacaaaggcagcagagggccatctaagtaagtttgggagtttttgctggtgcattcagtcactgaaaattgatggtgttggacaaggtaataaaattaatcttgcctcggccgggcatggtggctcacgcctgtaatcccagcactttgggaggcagaggcgggtggatcatgaggtcaggagattgagaccatcctggctaacacagtgaaaccccacctctactaaaaatacaaaaaattagccgggcgtggcggcgggcgcctgaggctgaggcaggagaatggcttgaacccaggaggcggagcttgcagtgagccgagatcgcgccactgcactccagcctgggcgacagagagaaactccgtctcaaaaaaaaaaaaaaaaaaattaatcttgccttttttttcaggtgatggctcagtgttccgagacttggttattaagtacggtgcagttgacccactgttggctctccttgcagttcctgatatgtcatctttagcagtaagttactaacatgagtaaagttactcacttcttcattctaatttcccccatcttctcaaaagacagaacctctcattgcctattttttttcccccagtgtggctacttacgtaatcttacctggacactttctaatctttgccgcaacaagaatcctgcacccccgatagatgctgttgagcagattcttcctaccttagttcggctcctgcatcatgatgatccagaagtattagcagatacctgctgggctatttcctaccttactgatggtccaaatgaacgaattggcatggtggtgaaaacaggagttgtgccccaacttgtgaagcttctaggagcttctgaattgccaattgtggtaagttatttacttgtagattaggacataagtataagaagcatgatcagggctgggcgtggtagtggtggctcacacctgtgtaatcccagcactttgggagaccaaggcaggtggatcacctgaggtcaggagttcgagaccagcctggccaacattgtgaaagcccatctctactaaaaatacaaagaaattatctggacatggtggcacgtgtctgtaatctcaactactcgggaggctaaggcaggagaattgcttgaatctgggaggcagaggctgcagtgacccgaaatcgtgccattatactccagtctctcaaaaaaaaaaaa

SEQ ID NO: 87945 - DNA, 1076 bp, Homo sapiens
gtctgattcagatgggccgttttaggatcgtttttgatattcattgcggcggtacaagttttgtagccaaactgacttaaaagataacattttgtttctttttgtttcatagcaacaccaatgaatgataaaggttattgaaaatttagagttggttttgtttctaatttgaatcttcttactcatagactgggtaaacactgaataatcatcttaaagtctgtttttaaatgttcttccatattgtaggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggtgaattacacgactttgcaattcgaactgagtatatgtatataatatacactcatacatttatgtatttctttttaaataggggacatcctgaagttcttgaaaaagaagaaacctgaagatgccttctgtgttgtgggaataacaatgattgatctttacccaagagactcgtggaattttgtctttggacaggcctctttgacagatggtattccgtttttggcattgttgttagaagcttcttcagcttgagaatatttgaagatgttagaagagggaaaaaattccaaccaagaatcatattgatatttaaaatattttcagttgagacattatgccataatgggaagtgtgctgttggtagattgtgataatctaggttctggttggccactcactacctacaggaccttaaaggtaacaatacccacatcatggagtcatttggagataatttacataaaagtgcctgtacataaaaagtgtggataagcctggacaacatagaccacatgtctacaaaaaaataaaaatttaaaaaactaaattagctgggcatggtggcacatacctgtagtcctagctacgcaggaggctgaggtgagaggattgcttgagcccaggaggttgaggctgcagtgagccatgat

SEQ ID NO: 87946 - DNA, 1067 bp, Homo sapiens
tgttttcacatacatatgtctacccatgcctgtgtggacacttatatatgtatatacgtacatgtcaaagtaatataatgccttgtggaatatttagcaagttgagaaaaaataacatcctattatgctagaaacaaagtgtaagaatgagtgtatttctttttcatcttttttcagtgcgtacttttgacatcatttgtaattctgtgtgtatttggtacgtgccatttcactcagtatatcattagcattatttcatattcacaccatcattatcaaatgcagcgtcttcatggggtaatatgtcaccctatgatctagaagccaatgcttctctcttgcctgatggtattttgctgtggtttgttgaagtgcgcatctttcatgtttttccaggcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctttatcttctcatcttactggcctggtctgtggcagcaagcacattatttccattccccaaatatgtttaggtctcccaagaaagctgggactggcggtaacgagcaagtaaataacttgaaaaagaaccgttcaatgccccaaggaaccaaccaacataatttccagggggtgattttgtttttagaagagccgctcccctcttttaggcccagccaagtcacatttttggacgtccgtgggctctgatcaccacagccctccttttccgagagcctaccttactgtctcaagtgcattaccttgtttttttctcttgctggttgtcacc

SEQ ID NO: 87947 - DNA, 1048 bp, Homo sapiens
ttggagtcacactacatgtatagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagagaccgattctcttctaagattttttattgactctcacagcattcagtgtttgaggcaattaaagttataaaaactcaccaaagattcactccaaataaataattttttaacgtttatcttctgcaaaaccttttaactctactagagacacataaagtttcccaagaagtttctactgaactttttatttacttatatttattattattattttttgagatggagtttcgctcttgttgcccaggctggagtgcaatggcacaatctcagctcactgcaacctccgcctcccaggttcaagtgattctcctgtctcaccctcccat

SEQ ID NO: 87948 - DNA, 1033 bp, Homo sapiens
taaaataattcctgcactgactttgcatgaaatgtgttatggtttggttttgttttttcttgagacagggtctcactctgtcacccagtatggagtgcagtggtgcaatcttggctcactgcatcgtctgcctcccaggctcaaacaatcctcccatctctgcctgccaagtagctgggactacaggtgcacaccaccatgcctggctaatttttgtattttttgtagagacggggtttcaccatgttgcccgggctagtcttgaactcctgggctcaagcgatcctccgtcctcaacctcccaaagtgctgggattacaggcatgagccactgcgctcggccatatttatattcgacatcatctctccatgtgcaagacgtggaggaaggagtcttatggcagctaaccctgaagcctctgtgagttaaaatatcgttttgttctttcccggcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtaagtgttcctctttggctcagaagttgtctagacacttagtttgaagaacaaggaaggggaaggaggaaattaaagccaaactatatttctttctctttctttttttctttaacattaacagtgtctcagatcagtagttttgaactgagctatatggacttcaggggacctgggaatctgttctcaagtgcccaagggtttttgtttgatcttcaccaaagatgatgataatttctcttttgctgtatttgcagccaaaagatagcatttttacaaagtaagacgaatttctgtagccagtatttctcacatcagtgtctgaggatccagggctgtaggggaagtgcaacatgccagacttattcttgggggcctaagaaaacctttttccattcaaaaggagtagccagcatggtggctcatgcctgta

SEQ ID NO: 87949 - DNA, 1052 bp, Homo sapiens
catgccactgcactctagcctggatgacagagcaagactccatctcaataaataaataaataaataaatattcaacaacttaagaaatggggtaagtagttcttatctgttgtttgcttaagagtatgagaatcatcgatcctcatgctattgctgatctgaattgcttttaactttttctttcagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcaggttagtacatctttcggcctaaccatgacgtaagtatagggcccttttaatttggctaccttggtaatggtagtcgatgtgtttgtgatgctttcattcccttatacgcctgttggtccttcctagccctgactaacagggttttcagagcattgaggattggcaagaaacaaaaggcactgaagaaaaaaagccttatttgccagccatgacagccttcagtttaacacacatgtattaaacatctgctgtctgcacactcttaggattctgtagattcccttaaggagtgcagtcaacctccttttgtgaggatgtgaggatatagtcactgtctaagaagcaacatcaaaaagttgctgatggccgggcacagtggctcacacctgtaagcactttgagaggtcaaggtgggtggatcagttgaggtcaggagttcaagaccaggctggccaacatggcgaaaccccatctctactgaaaatagaaaaattagccaggcacagtgttttgcacttgtaatcctcagtacttgggaggctgaggcacgagaattgcttgaacccaggaggcggaggttgcagtgagctgagatcacaccactgcactccagcctgggcaacagag

SEQ ID NO: 87950 - DNA, 1056 bp, Homo sapiens
gccaccatgcccggctaattttgttttagtagagatggagtttcaccatgttggtcaggctggtcttgaactcctaacctcaggtgatctgcctgctttggcctcccaaagtgatagtattaaacgttagatagtatctaaacgatagtgctgggattacacgcgtgagccagcatgcccagccttcttcttcttctttttttttttaatagagacagggtctccctatgttgcctaggctggtctggaactcccggactcaagcgatcctcccacctcggcctcccaaagtgatagtattaaacgtgtgagccacctcacctagccagatggtggactattcatttctatttcctttctgagccactgctgggaagttaattccttagtttttttaaaaaactctgctttatgtctgagctattctactctagctagagccacatataactttcacctgcattcttgggtttttggacagaagctttcttttctttttataactgagatctccatcaaggaaagatgacaccctgaaccccgtcctacccccaaggtttatgcctttatcatcctaaagcatcctatgtcctattaaatttagctttgaagataagaccacaatataaagtaataacaggataacctggtttctgaaccttcctgggtgataatgcctgtatttaagtaaagtcatgcacaggtctttccttaaaaaaccgagtcataaggggagaaagtgcttggttgcagaataaaacccttcctggactcttctcccttttttcttttctcttctcttcttctcttctctctctctttctctctctctctctctccccctccctccctcctttcttttttttttttttttgggggttggggatggagtctcagtctgtctcccaggctggagcacagtggtgcgatctcagcccactgcaagctctgcctcccgggttcaagcgactctcctgcctcagcctcctgagtagttgggattaaaggcgcatgccaccacgcccggctgattttttttttgtatttttagtagag

SEQ ID NO: 87951 - DNA, 1934 bp, Homo sapiens
tggtacagttgggtcccggaagatacctaaaggcacgcctggcctttgagtgccccctgccccgggttgggggctccgggacgtcggaagagtcgggggctccaggctcagcccctccgcggattttccgcatgaagttgcctgcgcgtcgcaggagcgaaatgtcagaggtaccttcctaccccaggctggcgcgcgcacgcaggccgggcactgaggcagcgcgagggaaagtggggctccctgcctcccccgacccccaaacacagcactccctgcggcggccaccgtttgtccccagcgggaagccggggatttcccggcagagcgcgggtcctccacctggactgtcagaactgtcagcggctgacggccggtcccgcgcaacttcaaggttcccgggctgccaaccgcaggaaagcgctggtgtcgccaagcagttccgtagcaagggaagatggttttgcagaggaaatgggttatttccttctaggttgttgtcgtcttttctttttattccccccaccctagcaagacaggtcatagaagtttgttaggtggcgtatataaaatgtcaccaaacatggggggcgtcagtcttagaaaaagctccccggagccaactggggaagagcaattacaacttgtcaacctggaagccggttttgtttgcacggttagacactccgtgccagctccttctcgcaggagatggtttctaccccgggaatgagatttctcagtgatctgattgtttttgcaaatcatggtaagataggtgtcttgcttgtaaaaaagatgccaagtgcttatgctgaaatctctaaaccatgcatctccccatgtcccaagcaccgttatgtggcatttttggggtcaacaatacatccggccagatgatataatagaaacccctcttctcataattaagggaagagtgtccaaaataggaacttacagtgtgtaaataaacaatgcagccaagtggaaaagctccttccagtgtaatgagtaccactaaccctgagttttccttctgtggtttccgaaaaaggactttcctcagtggaactcctgaggaggacacttaaattaggggctcaggtttcaacaccatagtcttgtaaaatggtgactcggttgtagccagtgattcaacatcgtgaggcagctatccaggttaggtttggaaattttttttaaatagagaatgcagatgaactttagccaaatacagactggttttgacaacttgggccagaaacaacttgtcaaagctgttctccgggctacgcctttaagaagaagagaaatccgcagtgcttttgctcgaggtctgcctacaacagtagccaccccatttccatccagagcctgcgttttgaaacttgctcttagctgaccctggaataacactctgatggtctacaataatacaatttttttcatgccctcgggccaaatcttctctcgacaaattaaatcacagtgaaactcccaaggatagcggatttccaagcctttggcaagatacctacttatttatttgtttagaggcagggtctcactcccatcatgggagtgcagtagcgtcatctctgctcattgcagcctcgacctcccgggctcaagcgatcctcccacctcattttttaatttttttgtagagacacagcctcactatgttgcccgggttggtctcaaactcctgggctcaagtaatctgcctgcttcggcctccctaattgctgggattataggcatgagctaccgcacccggccaatactcatttatttaaggggacacttaaccacatgctactaggaaatcctccaaactgcccgtggattgtgtcattgtacttcctccagaagaacactagggtgaagggaagatggctgccgggaacccccattcagaattgtcgagtttt

SEQ ID NO: 87952 - DNA, 1021 bp, Homo sapiens
gggctgatcccgcgcggcgctcgcggctgcggcggcttcgcgcccgccccgggcagaacaggttccttccagtttgggtgtgagctgcgcgcgcggcgcctgagttcctcctgcagcgcccacttcccccagtttcgtcaactcgcgcacccccacagttccccttccggcagtggggagggagtgtcgcagtgggccccagggagcgagcggccgggccgctgcgggtgccttgcttcccccactttgctgcaccggcagcagcggcagcaacagcatccgcgttgcgcgaaaggaatgtgagcagccgggctgagtcagcatccccggcccggggcgcgcgcgcaccctccaggcagtggcggcgtcggcacaggtgcatggctcccatacccgcggggagccctctgtaagggacctggaggtttagacagtccgtgcccctcatcccgtagtccccgaccccaaggtcaccgtgaactaagcggatgatgcacgcgaaatctcaggagctcctcatggggacaaagcatgtgtcagatcctagacatttcagagcctgcgggggcgcaaacttagcttcttggtctctacctcacatcccgagggcaaatttggaaactgctcggaagcaaaggccatgttatttgcattcgtatgcagactttggcgccggctgctgccttcattggggttcggagaatgtggttctgatgtcagaaactcaagagagcctagtttgggagtgcatgcacggagggtcgccaccgggaggagtcggcgatctgaattttaataaaaatccttccttgctcgctgagttctctcaccattttgggataggctctcctgagttaaatgccatcctttgccgttgacaagttctggttgtgtaagtggggagaagattcgttggtacagggtgccttgtatggccagtagtgtacagccaaggggccgctgagcagctttgcaaccttgtaggcgtaatttaacctcgtagagcgttaatttctccaga

SEQ ID NO: 87953 - DNA, 1081 bp, Homo sapiens
cacctcctgacgttttgtgccctaggcattttgcttgtctcgctctagcactgtctctcacctggactcacctggacccatgcaagagactcctaactcagctgcttctttcatctgctgccctgcggggcatttgtgtattctcaacagggcagggattctgttacaatgtaaaccagagcctgctgctcttgctgaatccctctggcttcccatctctcgcagcaaaagcctttctttcctctctgactctaatccctgcccttcctttctccattgcttctgcagtggcttctttgccgctccttgcttgtgccagacctcagcctttcccagtttctctgcctttcctgcttggcttcctgatggctgcgtagcttcctccctgacctcacacagatccttatccaaattgtgttttctcgatgagattgtcccagaccaccccctttaactttgcagcctccatcccatgcctgagctccttctttgatgttcttcacgctatttacattttattgatttcatttctcccctcactgtcaaaaaagtaagtggtgtgagggcagggacttttgtctgtttcatttacggctgtatgcactatgcctggtttaaaatctgtcagtcagtacaaatttggtggacagatgacagaatgcgttggggagttgcttccgacaacacgtgagcagctgatgcccaaggccccttctgacagcccctgatggctcgtggccgccagccagcacacagaccatgttctgatctggggagtaaaacaacagcagtccacatcccagagacctgctcccccctgctcttttgtcttttttggcctcggctcatcagatgcttttgtctctggaaaaccaacagaaccctctgccagaaaggtctgcccgaccttcttgttatttcagctgttttcaaggttctctaggaggatgcttggccacagggaggcccatgggaaacgagggtcaggtgatgaagtgagtggctcaggaagcccaaggacttcagctctgtgttttcagacactgctcagcagatcttcaggttgctgcattccattcgc

SEQ ID NO: 87954 - DNA, 1014 bp, Homo sapiens
gggcagagcctcttctgccatctggagggttgagcgtctcccagctccctggaactttgggatggtttcgggcccctgtgccccatggcacgtggatgcttcaaggctagtggggacagtctcttctgcttttgtggtgactcaaacgacactgtgttcttaggggaaggaatggggactcggggccgtttaatgccccctccgaagtgggcatagggcctggacatccacccgttaattaatccattaaagggcaaatcaaccgacagcctccttattatacaaaaaaggggaacagttttgttaattcattagctggttattaagtgaaaagtcccgagtcctgttggcatttaacatcacagaaggaaatccccagaaatgctgatttctttgggatttccacatgccaaatgattttctgagcatcagcagaaaaggccctcaggtccatgcccttcctcctccatgactctggcccctgcctcaagcccctcccccaccttggacctgtttttcaaaaccaccagctgtccctagagtgtggcttcccgctcttccttgacaagggggcccaccctgggacttagggagtttttacttgggtctttagttggctttagtgtttcacccaagaccctcgacgtagtacttggttatcactgctggtcattcagtttacttgactttagacccttcatctggtagcaatgctgaatgctaatgcttgattggagttttttaagcagcaggcaaatctctgaatgggaaaaggagccggtagaaggcatgactcctgggtcacagagctagctgggcctctgttccttttgaggtctgggaccgtgcattgcacctacgcgggcaatacagggcttgataagcaggagtgtatcgggcatcaggatgagcagcggcccagcatgtttgaaatcagacatttcttagttttctttttttgagactgagtctcgctcttgtcacccagactggagtgcagtgttgcaatcttgg

SEQ ID NO: 87955 - DNA, 1055 bp, Homo sapiens
aggtcaggagtttgagaccagcctggccaacgtggtgaaatcccgtctctactaaaaatacaaaaattagccgggtatggtggtgcgtgcctgtagtcccagctacttgggaggttggggcaggagaatcgcttgaacccaggaggcggaggttgcagtgagccgagatcatgccactgcactccagcctgggcgacagagcaagactccatctcaaaaaagaaaaagaaaacttgccccaaaggaagggtgagcggaatcaaacccctgcttttcctatctgacttcaatacggattctcagggggcagccagaagttggcatgggaattttagccttctggttataatgacactgtcttaaaaacaattcttatttttatgtaattatgtaaaaagcctccagatctgttttctaggttcggactcctatggggctgacagatgttttaagaagtttaaaggagtttattcaaaagttgaacatttttaaaatttcacaaaactaaccagcaaagacagtaagccaatcctccatttaccccctttctgtcttggttaagggcagagacacatgtcagagggagactgcgtcccatgtagggagctaatgtgttcactagctattgcttctcgcagggtcgcagcatctacactcacttgcctcatccacactgtcacgttcaaagacaagaaataatcctgaaagtagatcccaaggccagaatgcaaaggaatagccagaagcccagaccagatcagtgggctaagggtttgtcaaaggcagaatctggtgacagctagggtgaggggggctttgtcattggaagcgaatccatcgcccatcttcgttgtcatcacggtttatgttttccttggcccttaggatccagaagttgccacggctgctagttgcgtcatccagtggacacctttatatgtacaatttggatcctcaggatggaggagagtgtgtcttaatcaaaacccacaggtgaagagactgcttttcaaaagacagcctttcgagagctggtcgtgtagagttgtcccttc

SEQ ID NO: 87956 - DNA, 1051 bp, Homo sapiens
atgtctaggcacaccatcttgactgcagacgcagacctcaaataaacttcctcctcgggaggtacccatttcccttatcaaggcagggcatttggctcagaaattgctcggtttctttttttttttttcttaagacagaacctcactctcacccaggctggagtgcagtggcactatcttcactcactgcagcctccacctccaggtttaagcaattctcctgcctcagcctcccgagtagctgggactacaggcacatgcaaccacacctgactaatttttgtatttttaatagagacagggtttcactatgttggccagcccgatctcgaactcctgacctcaggtgacccacctgcctcggcctgccaaagtgctgggatcacaggtgtgggccaccttgcctggcctgaaatttctcagtttctaaataggttcttggcagctcctcttctccaacttgaagttactggccaacagtatataatcatctgcagaaagaccaatatgtactgacttttcactataggaagatttatttcagttttgaggaaatctcttgtaaccctagaggataatggaattggaagaaaagtagatgctgtttcagagtcctggggtaaaatgtaaaaatgagcaatatatacacacacacacacacacacatatatatatatttttttttttttgagacggggtctcactctgtagcccaggctggagtgcagtggcacgatctccactcactgcaacctttgcctcctgggttcaagcgattctcctgcctcagcctcccaagtagctgggactataggcacgcaccaccatgcccagctatttgtatttttagtagagatggggtttcaccatgttggccaggcttgtctggaactcctgacctcaagtgatccgcccgcctcaaagtgctggaattacaggcatgagccactgtgcccggcaagtctcattgtttcactgtagcaaggacgcagccagtgttaaatcaggaggtcttcccctgtgaagttgctttattggaagccttaatcag

SEQ ID NO: 87957 - DNA, 2836 bp, Homo sapiens
acgtttataattatcacctcaacttctcctgagctccctttctactgcagtaaaatggagatgatcatttttagcccccagagttgccacggagagcgttacctgaggttgtggcctgggtgggcaaaggtgggtccgccctgtccatgcgggcagtcagactcactccgcagccctctctgtcccataggacagccttgcacaggtcagagctgcgcttcagtgacatgaccaggtcctcactcgggaaccttcagaggactccgccctgccaattatacattccccagaggccaggagtcgccttatctgttctcatcctctagtttattttctgaacaaagaaataagatggaaactgtgactgttgattttataaatccttgctgggtacagaaggaagacacaatcactcgtctaattgtcttcagcacacaaatcctgaatgcattttgacttcataaactacaagtaaattagctatacagagttcgcctgttgcctcacacttggtatctaacgcagctgtaaatttccttctttctgtctgtttgtgtcatgcccgttcctgttgtgtcagagattgcaggctgtttcctttaaagagcttggccagacaggggctcgaagttaatttcctgctagcacagcagtctgctctgagcagtcaagggtggaaatctccatgaaagtcctgccaactgcagacctcccagtatggaggaggtggtcacagagctgaccaccttttatgggatattgagggagcgttccataccacacagcaatgcagatcattgaacagttcatggtttcttccccagcaagacctctttcttgtttgaaaatgctaataaaagtggtataaatgcttcccttttgtaggagcatagggcatttgctgtacaaagaagatgtctttctatttttgaaaatcggaaagcgtaacctgagacattaatcaactcagagggaactgcattttataaatcactgttaacttacctaaagtttgacatgcaatactttaaataccaagatgagaatcatttagaatcatgggacttcctttgaattccactgatgatgccattggttcttgagttgagagcaggcacttcttttccagctgtagaagaattacagccaaacaattacagtggaattatagctgccagtgacttatgaaaatatgtgtcaagctataacacatccaaaagccccatcagaacctcattcctaggtagaaaaaagactggaagaaaatatgctcagatgttcagaacagtgaaaagcctctgggttttagaattgtgggtgattttttttctccttatattttctaggctttgcaaatgttctacaccatcacttttatattatacaataatatttttaaagcccatatccttccttaaaaaggctttgtgtaacacctgtaacagaaagaggagactggcagaatggcaatagccaagctaaggaaaactcttcttgcttgccttgggtggttcccaagatacgaagatacattcgtgtggctcgttggatttttctgacacttgggccatagggaagtcacagtaggcttttctggggaccttcattaagtctgtaagggtaggaaggcaggattccttgtctaaattcagatggattggtagaggtgcgagcctggaggcaaaactgtcaaataagtggtatgtgtcagagtatgcctgccctcactcttatcctttgtccctttcttgttagcatctagtgtcaaccagttctataataggtattgcagaaagttcaatattagcttagaaagtttaaacgtttcttcccttctgggaatatttatgttttaacataagactctgaagcacagctggaggtatgcgtccaaggcttctgctccaagactgcttagctctctctgccacaaagacacgcccagtattttcagagggaagaagtaagaaacgaaggcttggcatcttgaagtgttaaatctggaaagacctctatatcacggtagccttcatttcacagacaggaaacaggcctgaaagagcagcaaataactcggccagagtttcacagtacatagcagacctcagtcttgaactcatgtcctcagcctatctctaaccagataaatattcctgaaacatgccttaaaataaaatttgaaaatcttttttgagataaaattcacatcctatacaattcacccgtttaaaatgcatggttcaatagcttttggtatattcacggaattgtgtaaccatcaccacaattaattttagagcattttcatcgccccaaaccttgtacctctaagccatcactccctatgcccccagccataggcaacccctaatctactttctgtctctattagattatggatttctctattctggacattttatatcaggagactcatacaatatcggttcctttgtgactgacttctttcacatagcctaatgtttccaaggttcttctgtgttgtagcatgtatcaatactttatttttcttgctggataatattctattataaaaatatatcacattttctttatccatttatcagttgataacatttgggttatttccactttttgacttatgaataatgctgccatgaacattcatatacaagtttttgtgtggacatatgttaaatttctcttgggtgtatatgtaggagtggaatttctaggtcatatgagaactttatgtttagcttttgaagaactgctaaacgttccagagcactgccccattttacattcccaccagcggtgcataagatcccagtttctccatatcctcaccaac

SEQ ID NO: 87958 - DNA, 1280 bp, Homo sapiens
tgtcaagatgaagaaaatattttgacaattttctgtccaaatgttttacagtttatgtggtaagaattctcccctcccccaactaaggattttccttcttttaccactagtgtattatcatttaggggtggaatctggcaaacgagtctggaataaaggttgcttttaaaactcatctaattttcttgtgtgtttttaaaaattttgattatgctagtagttggctaatcagatcctcactccagtggtttgctctgtgacgttaggatactcccatgggatagaagttacgtatagggaatgtcagatattcttcattgtgctgacttgctttcgcttacagttgacttttgtgccctggtaattctgtatcctgtttaccgtttacctacttcccacgtcatcatgatttcttttgagggagaactgaatgaaattcccttaagggcctgacttcagcacccgtctctgcagaggttagtggctcatacttcctcccaggagctgaggttatcgactctcactgttgcctacagagcacagatcctgaactaaatgaaacatttacttggaataatgctaattctgtacatattttattccctagtccccacttccctgtttaaaaacaaaatctacttagaaaaaaatccctgtgaatcagttgtctaatgaatttagcaagttaaatgccagattgacattttgctttatagtttatacaagcatgtgtgtgtttttttctcgcagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggtaaaaataaatgtggggagatgatgaggtgattgtgacagttgttacatttaataactggaatgttactaatttgtattttttggaagaaaaggaatctgactaaataaaaagtctaaaacaatttcaaataagaaatacagttaaggcatttgtagtaatttaaaaattcttaattagtagaatttatcagaaaaatgaacctgtatgctaactgtacttggctaataaagggtttccaaacaattctttgtaactttttaaattagtgcgtagaactataacagataaaactgatcagaactagtatagcagttctatgaataagaaattctatagttcttaaa

SEQ ID NO: 87959 - DNA, 1067 bp, Homo sapiens
tcttggatcactatgttgggcttgaattgtttttcctgataacatttcttttggcaggagggtctcttgctatctgcagtagcatccaaaaaaacccaattttcaggattttgtcttgcagtgtgttactgttgtgtgcatcacagataattgttgtcaagacattaatgaatatctgatttgttactcacatgttatgtgagtactaatggcttgtactaatgacttttgcccattaataaaggatagcatctgttatcatctgaggtacattctgttgagagtgtttcaagtgttactctctttttttcccctttggaattggtgttttcctcttaacttacattgttaatggaagaagagattggaagtgactgagatagactatcattggaacatgagagtgccagctttacatgccgaaggatctcattttgcaaactcgtaatttctttcaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggtagttttgatatttgaatatcggggggatgcttttgggacccacttggtggtcatctagtctcctttgatgaatgaatcataaaatacaaaacagggtggaacttcatccatcctgtacaattcttgggtactggaaaacaggtttctgtaatagcatgctgtcagaggaaataactaatagtgattatgaactagtgaataattgcattttggggtttgttatttccttgcagttgttttgcagtagaaggaggtgggcggtattgctttttctcttgaatcgtgatgtcctttttttgctatcctattaaatgttgtggcttttaaccttttattctacgagcctcatttgtcctgtgttctcctcttcctcagagccaggctattttgagttatgctgttagccttaaaggggaacagaattgtcctggcactt

SEQ ID NO: 87960 - DNA, 1347 bp, Homo sapiens
tgataatgagagaaggtaggaacaggctctttcttaacactatttttcaagtaagggtgtgatcccaaattgttttcaacacttgttgcaagttttagagctcttagtaattgttcaccagatgacagtctggggtctttaattctaagcttaatgtttgaaattcacggaagagacatgtgaaatgtaacacgaggccttctctcttttgcagtgatatttttgatgccatgttttcggtctcctttatcgcaggagagactgtgattcagcaaggtaagggcctctggagcatgcaatattgttacgggagaggaggcgagactagaggatttttttggttttgttttattgaagtttgttttcctctttgatcctaccacttttttttttctgttatactattggatttttctatttcttttaaattaagattttctgagatggacagaacactttgtattgggaactaatatttttgatacagttttgtttataatttaaaggaaatgcctacattgtcttaccttgaatgtcatatagaattgcagaatcatatatatctctcatgttctttatattgttaatcacttttaaagtaagaaataaatgaaacacctacattcttcattgtatagccctgtctattaaaaaggttctaggacttctatagattcttactttgcctatatagactaacatggatctaactttttgactatcttcctctttttattttcttatttattcttgacattttatgagtgggtatatattttcattttgtggcagcctgataatttgttattaactatttgagttgtttctaatgtccttgttataaatgccatagcagttaataactacacatatgtagcttttaaaaatttttttcagaggtattcttcaccatgagatgactaaaaaaattttgattaattctatgacttttaaaatatgttgcttgattttctttcccctgaaagattgtgttagtttgtaacacactctcacagtaccactgtaaaataagtttattgttttgtaataattttgataatttctttctttaatttggaatatgcttctaacttttttaccctcttttaggtgatgaaggggataacttctatgtgattgatcaaggagagacggatgtaagatttaccaatatcaaaaatatgttgatcttaaaagccaatgtattgatcgcttccgagcaataagaatagtgattttgaagggtcattacatcccttgtatgtcagattttattaataccttttgccaagtatttttatgacacagagaaactctttaaaggtaattttctgttcagaactttgc

SEQ ID NO: 87961 - DNA, 1953 bp, Homo sapiens
tagttgctaattgattttatttaaatcaggggtcaggagactgtaaagggccaggtggtaagtaagttaagctttgtggaccatagggtttcattcgcaaagtctcaactcttgtcatagtgcaaaagcagccacaaataatatgtaaatgaatgtatgtggtatttcagtaaagtttgatttgcgaaagagacagtgagcttggatttagcccttcatctacagtttgctaacccaagtgtgcaccctttaagcaccttagcttgatacgaagaacctcgctagcaggagatgctggtaaaatagaaattgaagctcatgtggtgactaactttaaagtcattttttatcatatgcacacatttgcaaggtagttaaaattgcataggatgtttaaggtgccaccctgggtttgagagtgtgtgtttgtttagctttttggtgattttattataggggtcagctgctgtgctacaacgtcggtcagaaaatgaagagtttgttgaagtgggaagattggggccttctgattattttggtatgtatgaattccctcacaataaatacatggtttctttaagtcacctctcagtgagatattgtagtcttccataattttgtcttctcctgaattttattttctaactgcagtcttttttggctctgagagggaaggtgtgagattttgatctttactcatttaatgaaattactgattgtctcatatctattgtcttctttctcagaagtgcactgctttaaggaaatgtttttcatagaagttagcctgttacccatctttgctttctccaggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagat

SEQ ID NO: 87962 - DNA, 1407 bp, Homo sapiens
acagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattcttaaatgaatcagtttttcttccctttctcctttccgtctttcctctctctgtccttccccgaaagtctactc

SEQ ID NO: 87963 - DNA, 1028 bp, Homo sapiens
ctaacacacacctgaccagtacttctcaaaactgtcaaaatcatgaaaaagacagaaagagtaagaaactgtcacccacagttagagactaaggtgacgtgacagccaagaacactacggtatcctggatagaacctggaataaacaaaggacactaatagaaaattggtgaaatctaaataaagtatggagttcagtgacaaggaatgtaccaatgtcggtgtctcagttgtgaggaatttaccatggtaatataagatgataagattagggaaactgaaaccggataaagagtgtatggggatgctgtattttctttgtaatttttctctaaatataaaggtatatttttttaaaatgtagttatatgtgtgagagattattctttgaagctgtcattttatatctgagctttcttttaaaaaattacttcagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaaggtaaaattttaaagaatgtggttatatttctttatagagcaaaggttataaaaagttattatattaaggattaagtgaaaaatcatcttttcattcatagaccatatatatatatatctctgtgtgtgaatatatatgtatattttttcatatatatgaaatatatgtatctgtagatagataatttatatatctctctctgtattatcaccaatactggactaatgaagtctgatggctggtgttttatatctgccttagtattagatttttcaatattcagtagtatttaaatttttttaacattcttagtagtaatgagagttgttttgcatgaaaatgttattattttaaacaattttcatccaactaaataccaaaataagttattgaatttaattttgaattttaaacatgttgaactttagctttagaacataata

SEQ ID NO: 87964 - DNA, 1019 bp, Homo sapiens
attggggcctgtgggagttaattcctcttctgcttgggagaagaagttctagttccataggaagctgagcttggatatagcttttcccaattaaaaagacaagagcaacaaatatcattcttagatatttattattatttcataggaccactatggtggacatactaactgcttttcaaatacatcattcatttttatgaaattgtgaagcgtaatttatatgcctgattattctgtgttgtagacaggaaaatgaaagtaaaatgatttgcttaggatcagatagttattaataagtggcagagttggtaatattgtccacaaccacctgttaatacatctgccactcattctttcatgtagactatgcctgggttagatattctaatacattctttctgaggttttgatttttttttgatataagatatatcctaagatatatcttaagatataaaatgattctcagttccatttgttactctgtggttgtctttcaggaaattactgatatagtttttaaaattgagctgtattttcaagcagctttgcttggaatcattgttactgcaatgccaccttactttgccatggaaaatgcagagaatcataaggtaatgactcagttaaaaatatataatttgctaataagaagtgtcatataaaaataacctatttgcttgattgcaaggcttagtataattgttatttcagaaataagtaaatggaatataaatacatttattatagtttcttattgtaataagtgataattaatatttattatttgagacttgctacatgctttaaaaattatattctctaattctcacaacattgtgaggtaagttttttgttactgatttcttatagatcaggaaatcaaagatgggattgttcatatgacttgctcaggttgactcaacttgtttaaattgtggatttgggaagtgactgtgatctttatgttcttaactggcaaactaacatgcccgtcccttttatcctttaacagaggt

SEQ ID NO: 87965 - DNA, 1029 bp, Homo sapiens
tgaatatccatttgggagttatgcaagattaaaacgtttcttctaaaattaattatttgttgatttgaccttatgagttagaaattagattttacttttggaaataactagctgtctttatttatgatatatttcattacttcacagatgaccaatatataaagttacagaaatttagttttttaaaaaattatatgcttgtttaaaatattaaaatatctgtacattccaaaccagattgtctttatctgtcattgagtattatttctgtgagttgttgaagcagtttttctgtatgagaattagctttgttggtgagaaaagcttggtacatatcaataatatatccgcttatatacagtatgtaataagtgtcttttttttaattgtaggactatgtttttgcagctgttttcaacagtactatggtttattctttacctatattagtgaatatcattagtaactactatctttatcatttaaatgtgactgaaaccatccagatctggagtaccccattctttcaagtaagccaatgtatatacagataaatttccatatgcatgtcatatatataataaccattaaaaactaagcaaaaataacaaaatatgtagaaatttatcttgtgagatctcttagacttcttaaaactcaagtgagaaacggtttacattaaggtttaggattccccagtagaagtatgtttcagggtaaaggagattctgttttggtattaatatttgtataaggaataagtgtgttctatattgatcatagaataaaatataagataatttttaaatgaatattttttacctaaaatccaggtattgggtattgaaaaaaacttgagaagtcacccaggcaaccatttttcctctagatagaactgttggattgtacatatcagaatcaagattacagaaaagtatccaacatattttctcttaatccttttgattttcatatgctaaaaaataaatggacaaatatctgtaacaatattttctatcttcttctttt

SEQ ID NO: 87966 - DNA, 1030 bp, Homo sapiens
gtgattatcttttaactatctagagtttaaatctataccaatgtaggctggtcaaggtggctcacacctgcaatcccagcactttgggaggctgaggcaggcaagctccttgtttgagctcaggagtttgagaccagccttggcaacatggcgaaaccccatctctataaaaaataacaaaaattagttgtgtatggtggcgtgtgcctgtagtctcagctatttgggatggtgaggggagaagattgcttgagcctgggaggtggaggttacagtgagctgagatcatgccattacactccagcctgggtgacagaaccagaccctgtctcaaataaaaacaaaaaaagtccatatcaatgtgaagggagagttttaattgattttcatattaatgtacctttgtaccctgagctgtgttgttttttttttcttttcaggttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctggtgagagtgtgtgaaggtctgtgaacgagtgttggcatggagcatggggttgaggggtggataaaggtctggattttaaaactatatttaaggtaaaggcatggtctgtctgcatgaaatctaaattatagttcaatacgtatcttattgatgctgaagaatatattacagtaaattttggtttacaaataaatgacagttttggccaggtgcgatggctcccacctgtaatcccagcactttgggaggccaaggcgggtggatcacctgaggtcaggggatcgagaccatcctggctaacacggtgaaaccccgtctctactaaaaatataaaaattagccaggcatggtggcacgcgcctgtagtctcaggtactcgggaggctgaggcaggagaatcgcttgaacccgggaggcgga

SEQ ID NO: 87967 - DNA, 1039 bp, Homo sapiens
gcttgttctttcagaagcaaactttaattttgttttcatactggtatatatgaacattgcactaaccttaatatttgtattttataggtattttttgctttaatgctgacacctctttttaaaaaatcaaaacatgtgggaatagttgaattttttgttactgtggcttttggatttattggccttatgataatcctcatagaaagttttcccaaatcgttagtgtggcttttcagtcctttctgtcactgtacttttgtgattggtattgcacaggtaggtaatatattaatcttgcattcactaaatattttctttctgttttatgtagcttcttatactaccatgaatactacctttgatttaccaaaaaaattattttaaaattttagcatgaggaagaaatgatttctagagtatattttatatctagttttatttatgtttgtccaattttaagtttttagttaaatgttctgtttataaattttttactttttacttcagtgtatctcagtgatttatttcactgcagaaactcagtttgatagtaatgtgtttaaatgtcaagtaattcttattgcctatggcctggttatattgctatcatttgtacatttatctcagaagaatgcatgggagaaaattgtgtgtggagcagaacaaatttaccgtgagtgtagtggtggaataagtaggcctggtggattttgttggcccaggcttcatggaattgtcattcaaaataacattcagacttacaaatattatttttattagtccttacaggagtagttaggttctaaatggaagaagtcttataagaaatggctttgtagtggaacatgaatttggctaatgtacaaagaaaaaaatgtaattactaaatataagaaattactcatgttggttggatagaagttctgatttatgagatataattaaatattgagttaatcattttacttttttgagacctgagaatgattgttatacattttgagagttcattgagtccccgagtccgcgttctctagga

SEQ ID NO: 87968 - DNA, 1029 bp, Homo sapiens
tttctatttgttcccccttctactttttgcttccctgtggctgctgtttctatcctccagccagagagctagtgtttattttctccattgtgttacacacttgtgcagctgcaaccaccatatccagggcccaatggtaggaggtagagaagaaaagcaaaagggattggcctcatcctcttacaacgatagttccattgaatagagagaaaggttttcctgcctcagagtgttggctgcactaggcttttgttactgtagtctggccctgttaccatgggattgcttgcatgtggggatacaggagaattcagaaaagaaaaaaagatttgctatttctacattctccctgagcattaagacttcccttgcccattcctcaattcaaagctaaggcttcttctggagctgcctctgtgggcggttcgggagataccaaaggagaaaaagtaccactgttgatatggtggtatttcaaattctggtctaccctatttcacatgccttgtttacttttcagagctgacagattgctgctccatgcattctgtccagtttcctaagagagacagcttggagtatgcttaatccatcttacctgggactgaaacagctgcttattttgccgttaaaaattacatgcagtttactgcgtggctccgggtttgtttgtttgtttttcctctttaataggtttattcagaaaacatgtccactgcaattagggaggtaggagtttggagacagaccagaacacttctactgaagaattacttaattaaatgcagaaccaaaaagagtagtgttcaggtaagttaaataactctttcttatgcttttttgcagtttattttgcttgatatattctatcttgaagtgatgatttattttgctaaatatatttttattataattttatttttctttgcttgtaaagtaaaagcttgccatgttagccacagaaaaataactgaattacttaatgctttctaaatgttaaaaattttaataataatttctacatttagt

SEQ ID NO: 87969 - DNA, 1048 bp, Homo sapiens
tgaagaaaaccagtgatcagatgggcttaagagattttttttttgtttcaataacttgaattgaagctcaagattattgaaagttaatattttcatatgattagactaaagcttttgagtataagaaaaatcagattgttgaggtcattcataatactgagtcattggtataatttgatgacagagttaatactttcatcatttttttctctctgtccttttgcaattcattctgtagggtttctttgactcacgcttcaatttagctcactaattcgtctttaaatgaagttcaccccatcttttagtgcttttttatttctatcagttttttatttcatttctaagttctgtaattgcttttttcttaattatctttctcttgttccaagaatatgatattctctattactcttttaaggatattagttatacttttatacacaatcgtgatcaatgtgtataattagttgccatgtacaagccaccattttcagcttttcatgtattaattcttttagtcattttaacaacccaaagaggtaggtactactattgttgtattttacagataataaaacttaggcgcaaaaacattaaataacttgcccaaggtcttgaagttagtatgtagcagaggcaggattcatgtttagttggtttggcttcagaggtcatactcttaacctatactactttgggcattattagttcttatgtttgttaattttggtgcctttgtaatattggttaagatgcttttttgcaagaaatagaatctgatactggttagcttaagtgaaaatgaaaatatattgggaagataataggacatttcacatactccaaggaagaaaaatcgagttgtgagcacagtaggtgtggtacattagaagaaagcttagagtaagaatgtgtaaactttctttcttaaatgttgccattcatgtaattcagtttccttgacttccatccagtctgtgggtctcttagttaattctgccaagagaaattttaactgacacagctcaagagtagtggtggtggt

SEQ ID NO: 87970 - DNA, 1022 bp, Homo sapiens
tcaacacactaaactcccaaacagaccttctcgacaagccaaaagctctttagctaacctaatattctttagctgttgtttcagaggcttttcgagaacaaaactgccgccccgtcttggccttgccgcttttcacccatcactctactgagtgtgtgtctgacttgtttatctggacgcaatctttgtcgcacccagttatctcgctcagcgaccggggcgaccacgtttccttaaatcagagccccgtggactccgccggagaactacattacccagcggccttcgcgcccttcgcaggaaggacgtctgcgcactaagatactcagttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggtaagaggctgtttgcattagttgcaaaaatgcaaagggttgtgcatgcatttatgaatgcatggatgcaattttcgcctggcgagtgcatttttaagtttgaggttttccacagctcagttgcatttcctgtttagtatgtgtctttttttgcagacacagagagttcctgtaaggcagggcttgcagttcagctgtgcattgacgttatttgcattcttctgctaggattactgagctctttttgccttttgcacagtcaggagagacagagcaggttggtagcgtctaaatgtgcaaggctttatataattgtaaaattctttactatgcacagatattgtaagtaattttgtatgcaacaggaatagaaacttttaaaaactctata

SEQ ID NO: 87971 - DNA, 1050 bp, Homo sapiens
tctaacccaagaaatgggaggaaaagtgaaaagtggatacaatctcatagtattgaagaatttaacaatatgttcaattcaaggacctttacgaactttctagatcactataattcggtttaacagacctctaatttaaggcacagcagaggcaaaggaattacagactctctggaagctggaaggactgggttactgctctacagccttaccaacagtgagattccgagaaagaatttcttaaaaagaaattttgttttccacagttgtaactttaggtggtatgcttttcagcttgtttatattagctgtctggggttgagttgacatttttcaaatattaaagcagtagaatgccttttgaggaaatctgaaatgtaagttaacaggaagggcacccagaaagtgcaggaattcctgcacactacaggaagacaagctacaggaaaaatgtgtcatctacactacccgggagagaaaaactattgttatcagccataatgatctccggagggagggagagaaagagggaggtagggagatctggcatcccccagttcacctgaaaatacacaaaaagtttgaccctgttaaaatacacttttctcacttctcctcctattcacctttaaaaaatattagtttattttagttttagagagcaataagtaaatcatgtaagaaatgcctatgaggcacaattcagaagcatatagcagagtggtaggaaaggtcttaactctactggggttctttgcttctgtaattcattccacccttgggaaatgaaatgtgtaaatttcttgttctctataaattcctttgttaggttgtaccagacggacttgtcatgcttagcctgtaatctgagccagtatgttttataaccccgtacatctcaggacacaaaatcagaataggtagcttgggtttcctgagcttgctttgtattagcattgcattcagttctttagagcatgcggcctgttaactgtagggggcttcaggggtctctggttggtaaatttaatgttggagaaaagagttgag

SEQ ID NO: 87972 - DNA, 2065 bp, Homo sapiens
tgaaaaaatctttggcagtttgatgaaagctattaatattctactctaatattattagtgataaggcagttgcatttttcagtttttttgacatttgtgtttcatgtgcccaaatttctttttttctcatgaaatatatccttaaaattttaatttgggtggccaggcatggtggctcatgcctgtaaccccactttgggaggccgaggcaagtggatcacctgaggtcaggagttcaagaccagcctggccaacatagtgaaaccctgcctccactaaaaatacaaaaattagtcaggcgtggtggtgcacacctgtaatcccagcttcttgggagaatcgcttgaacctgggaggtggaggttgcaatgagcagagattgtgccactgcactgtagcctgggtgacagagccagacttcatctcaaaaaaaaaaaaaaattaattaatttggggatcaaattattttcaaagttagccagaaaatagcaatattgtagaggttaggtaatcctggattgatagttgggttctgtgtatctaaacaatttaattccttgatgagttctaattttaattttaacctaatgtcttaagctgctatcacatattttataaactcattttatttatatagtctatagctatccagacctatatgaaaataataagaaaaatgtagtgatctgattaaattccagtctgagaaatagcttacttttgggcattcctgcattttcagttatcttttcaggcaaaattagtttttctttaggtttataaataattcttacatagcacctggttgtgttatatgcattgttgcagagaaatttaatctaattttttttagcttcctgtgcaatgcctaatcacaaaaggtggttgacttaaatttcctacatttgttaaaataattaagtctagaatctttaagattcttgttaagaatcaattttaatgacctcacaagtcatataagtcaatcagatttaacatatccttaacatagccttaataaatgcgcctatttatgcatcctgatattaagtgatagaatttagagctatgaaagttttatagtccaatcacttcattttacacataagctaactgaggccttggaagtgagtgactttcctgaagacagtagagtggagtcacagggagaagtcagatctacagattctctgtccgtaagttcttttcactaaaccacacgtgaacactaataatccacatttataaaatttttttttcttcagaatctttagtatatttcacatttttagctttgcttgtttttgttgggagcagtctggcaagggggagctgatggtataatgagcaggggttatttttctgtgtccaagaaatggtgacatgtgaatcatggtggtggggtttcttaccagttctctgccaaaggatattttgcaaatgctctcattttgattcccagtgcctacatagtacagctgcaagttttaaccactgtaatggttgtttgccttttatggactgtcttgtttgaaagcccttgctgggtaactaaaccttttcttatatatctttacatctctgactcttatagcattgtccttataaataataggtgctcaaaaaatgtctgacaatgaaagtatttttcatcagtagggataagctctcatttgctcctaagttttatgaaagatttcgggtaattaaattacaatgcaattttcttcttgtgcttcttctttgtttgcactgatattcccattatgtatttgcttaattatttggaagttgcaagaacagcatgaaaagcaacttataatggctggcgaagtgtcatttctcctacctaagccttctgaacagatttaaaggttgcacaattctctgctaactttctttttaaaaaatatgagaagatgaattgtccgaagaatcccatccaatagaattgaagtgatttctgcatcctgtgctggttttaggagctggtttttaagtctatgaggcttctgaaggattgtcagagacaatcctttttttgttgttgttttttgtttttttt

SEQ ID NO: 87973 - DNA, 1051 bp, Homo sapiens
cgacaaacaaagttttattggaacacagctatggtcattcatttatatgttttccatggctgctctttgctcgacagctgtcgagttgagtagttgcgccagagcccctatgtcccacaaagccaaaaatatttgctatctggtcccttgcagaaaatgtttgttgaccctttcctttatgactttattccatcgaatactggggtctcttcatgacagagctcccagaaacattcctctctggctttaattggaagttgttaacctggataactactgctctgctgctcagccagagacctcttgggcccagcccacaggaaacgtctgagtggtgtctctcctagttataagaattgtaggtcattgctcatttcctctgaactaagttacccgtctccttttgcccgtcctggggtcttttccccttagttgtgttcttcctgtttgctttatatttctttcctttttttcttcccttcgatgagaagctgcttattaattcttccctgagactcttcatcctccccttattgatcccacatttctttagaaagtattaggttggtgcaaaagtaatattgttttttatcatcacttttcatggcaaaaaccacaattacttttgcaccgacgtaagaaatcaaaaataactctcctgctaccaccattgcctggcttgttggttatcatcatgacccagctcagaggttccatcatttcttttgtgtcaacgtgaaagcctccctgcatgggaccagagaggtttccagttatcatctcctgcaaagtttagagctgttttcttacattaaccccctaaccccgggtgggcaattttcttttgaggacgaatattctttgtgctcacagagtcgcttacatcgtggatattgggtatatttaggagagaaggttttgatagagggtctgaaaatgaagggaggtgaaagctacatgtagacagaggagctttggtagaatgagcccagatttgttcaccacatccagaatgatgtaaatttaagtcacgtacaaagaagtgctaatt

SEQ ID NO: 87974 - DNA, 1954 bp, Homo sapiens
aagaagggctgacctgtgtctagctatttataggttctttttgacatgtccctttatatgtcttttgatcacagagtacagagtctgactcattttgactcttaaggttgagttccaaatagaaactgcccattggttgaaggaggctgattacaattggcccactgatagttactggtctggatatacaggaatgttatgttaaaatgtaggtaacaaatattgcttccatttgctgttctgtaggttgtatcacacagaaactaagccgactcaaaccttgtgtgtttccttacacatctaagttaaattgtattaaaactaacaagaacgtggccagtgtggcagcatacctaagtgtggggattttgcagcccctttttggcttagtgactttttttcttcctggttgtttctatgtaaatgtaacaatttccttgaaatgatgaatgaacccacatctccagtgttttcctcttgtactggacagagtggaggaaactggaattgcctgtttttgtggcagaggaggtagatggggatggaaatgaatttccttttaaagcaatgaattctttttttttttgtttttttctgagatggcgtatagctctgtcacccaggctggagtacagtggtgctatctcagctcactgcaacctccgcctcccgggttcaagtgattctcctgcctcagcctcccaagtagctgggattacaggcgcccaccaccacacccagctactttttgtatttttagtagagatggggcttcactgtgttggccaggctggtgttgaactcctgacctcatgattcgcccgcctcggcctcccaaagttctgggcttacaagcatgagccaccgcacccggcctaaaccaatgaattctttctcggctttctctccagccaaagcagaacagctatacctatgcctcagttgtttttcatgatcccatgtcgaagctgcggaaatagatggtctggttgttgagtgacaagttatttattcccttcctttattctccctcctccaatttcaaatgggatgagaggagatagctgtaagcgtagggctagaatctgaagaatcagtgggaacagaatagttcagagtatggaaattagtttgaagtaaatgtagagataacctttttgtgatatttgtaaaccttgcgaggcagtcttcacagtttatttaccccttcctgtacccgaaacacctttgccatttgaaaaaaaaaaatcacaaactctgcatatacctaaaaagaggacttggataaggagtttgtttagatcaattcaacaaaggtttttgtttgtttgtttgcttttttcattcagggtcttctatgtggcccagtctggcctcaactcttgggctcaaacatcctcctgtgtagctgggattacagccagtgccactgttcccggctcaaataatacatttttgatctattgttatgtttaagacatcatgctgggtagaaataggcagaaatgcatttgactttactcttccagtgattagccatgtggccttggaaaatctacttaacctctagcttcggtttcttcaccttctaaataaaaagactgacactcattcacgaggtctttatgaagattaagcaaggtcatatatgtaacatgctttggccagtgcttggcattcatttattcaacaaatatttatgagtgcactttatatttgaggtactttgctatagtactctctctataaacatacatttgcttcactcttcctttccttccagcccttaaggaggttattgtctaggaggaggtaagaaaagcataaaaatgtgtagaatctaaactggaatcctagattagcttaaaagaggtactattgagtgggaaagtcctatgaataagagagagatcaggaaagtgttgacaggtgtggaggtatcaatgtgattttt

SEQ ID NO: 87975 - DNA, 1044 bp, Homo sapiens
aaaatacagttctaagagataaaaagataaacatataaaaataaaaaggaagataaaaatacaggataaaagataaaatatttaatacaattaatagattaaatacattttttcttttattattttggtttcaaaaacagagtgacgtatagctctggggctcacagtgggctgtttctctgtgaacctagcatttaatcaccttctttccctcaataactccatttaaacagagtcagtacagtgtgaaggaggtgaattgagtcacccctcctcagattcatgtaagccacagggcagttttggcctcactttgctgtgtggttaaagataacatatgacccagccaggtagaagacctgtcagccatatcatctcattcaagtggcctgcaaagtcttcttgcttgggactttgttcctgaatgagcctctatttttgtaaggaaagtagaggaaaacaatgcagatttaattctgaaattggtttaagaatgggattgagaaattttgatatattcagtctggaataattgttttccatcccgagtttcattctttctttttgatgtaaccctatctaaggacaggatagctagtcagtgttgagcaagacatggcaggtagaggactagctgtctctggattgcatttaacaagcattatagaacaaccaaataaattatctgtacctcactctgtgctagactgatacaaaaatgaacagaatcctcttactaccctcaagaagctcatattctagtgggatgtctatgtttgctagagctactgtaacaaagtaccacaaattgggtggcttaaaccacggaaattaattgtctcgcagttctggaggccagaggtccaagatcaagttggcggcagggctggctccttctgaaggccataaggaaaaatctgttttgtgcttcttccctggcttctggtgtttgctggcaatctctgcatttcttcccctgtatactcatagcccagactttgccttcatgttcacatggcattctgcctgtctgtgtctgtatcc

SEQ ID NO: 87976 - DNA, 1040 bp, Homo sapiens
aagtcattcctcaggtccctttcaacttaaatgttctgagaattgcagagaaaattgcttacatcttctgttttcctatgaggtctccatctctccctgccctctctcattctcaacagttgagtttgcctcttttcttaaaaagattgagtctatctaaaatagatgcctcatctccagtcatacatccatatgctgacttcccatctctctctctgtatgtgtcctttcatcaattctcgatttcctctattctgagaaataacaatattaccatttattagatgcctgagatttctagcattctacagagttgtgaagaaggttcagagatgataaatgtaaggtcaggcttattatttccatttctggggtgagggagttgaaggttgaggaggtcaaattgcttttctaggttgtgtcaattagtaagttgtggtgccagagtttgaacacgtctttctgatcaaagggactttacttctcttgtctgatgttatctttgctctctgtgcaccaaaagccatctcctccacaccacactccaccctgttcttctgtgtatgccctcttgatttcttcccttctttttctaatcatttcttttggtattaagtttgcctcctgagaacaacattcccttaggccagctcgtcttctagctaaaatagctactttagctgctaagaataggaatagcatttcttgagccattacattcacacaccagacactgtgctaaatactgtataagtgttgtctcatttaaatttcataatagttttacgaagttgctactattattaccattaaaaagggggaaaccaagccttggaaagggtaagaaattatccaagggcatatagttggaaagaatctgaatagagacttgaaccctctgtactttctttttttttgagatgaagtcttgctctgtcacccatgctggagtgcagtggcatgatctcggctcactgcaacttccacctcctgggttcaagtgattctactgcctcagcctccagagtagctgagattac

SEQ ID NO: 87977 - DNA, 1082 bp, Homo sapiens
cctttgtccctttgtctttcaacatgcattacctaaggtgtgtatttagggcaaaaagcacaagttaaatctggttctgccaattgtaagctgtgtaaccttgaatacttgacttaacttcagtaatctcagtttccccatctgtaaagtggggatgatgataatagcaactgcagaggtttgattcaaggatgcaataagtttatttatatgtaatacctaaacatatctggcatctaatagagattcaataattatagctcttggtcttctattaatataaaacagtattttccatcctattgctcagtcccaaaccccagaattttcctgcttgattttccaaggtgttttattgtctcttcccacccagaccatccagtttatattcagcttgtttttcacacccaaacatgcattctttcctctagtcagcctcttatctttatttaccttgaatttattgtacctctctcataccttatgtttattcttagaatgtccatttcccctccttccccttcaaatcccatccatgcatttgtcaggcctcagcacaagtgctggagtcttctgtggctgttcccttctgtcctgatctcttcctctgtgaacttcctttgaacttggagtaaccaagcaatagaccatggcagtgtaaggcgccatggaggctgtgtagttcttcccatttggccaggttacaagcttcaggaaggttatccgacctgtttgtggtagtgttagaccctgccctctctacgtcatataaaatattctctgaatcctatacactttgttatattattgaccattcagttgataaaaatctgagcggttattctacagtagttctctgaggtagttactgaagaaagaaagatgggtaaggaccagttttatgtacttgcatgaagtttgtgccctaggtgccacacttgtcttaccctaatccttgccctagtaagactttcacttgtcttgggagctcatcactggggtttagggtaaaggggttgactgacactctcaaaaccgagggaagcacagtggccacagtagagattccgataatgcagaga

SEQ ID NO: 87978 - DNA, 1073 bp, Homo sapiens
caccatgcctcgctaatttttgtatttttagtggagacggggttttaccatgttgaccaggctggtcttgaactcctgacctcaagtgatgtgcccatcttggcctcccaaagtgctgggattacaggcgtgagccaccatgcccggctaggaattggaatttgatgattgcatggaaggcagttgagtaaaaggcattggaggaggaaggagatgaagaaagaaagaaatagagcaatggcttagtttgggccattggggcattcagaagggtgagcattagtgggccagggaagagacagttaatgaaggtgtactaggagtgagcaggagctgagggacgcttattcctagcggggagcctgtgctggggagacttgctgaaggagagactgggctgagtccaggggagtgcagaactgccagactgttgaggtcagttggcaaacagggctgtttcaacccgaaattgagaggctgcatctggaatacagcagaaagaggactgagccgttcttggggtagagatgaagggaagtcagcccgttagcctgggactgaaacagggaggcatctttaaatgcctcttctatcaataaaccctgacagactcacctaaatattgttacagcgtttccctaatttgtcttgttgtttctaatgtatatccccaggaccccttaccccactagcaatggctcaattatctagccctgtagggaaatattgtaatatggttttgtttttgttttttttttttttcaaattcaagtttagttttctgagtgcagaggcctaatttgactctgtttttcactggactctttctaaaaaatcactgtcttttttttcttgtcacttaaatgtagtctaactttttatttaggaaacacagtcattttgcttgtctgcagtgcatggagagtccgttaaggttgctaaggtgcggacctttctgttcccagcccgaagctggaggtctgtggttcccccatggctgtcttgctgcttgctgccgagtctgcccatcactgccttggcctcactcccagttgcagccggccctggccagg

SEQ ID NO: 87979 - DNA, 1059 bp, Homo sapiens
ttagtacagacggtgtttcaccatgttggccaggctggtcttgaactcctgacctcaggtgatccacctgcctcggcctgccaaagtgctgggattgcaggcctaagccaccacacctggcctttctattcttattttaaagatacagcattttacaagcagtaggcactgcatgaattcatgtagtttgatttaaaaatgaatcacaataaagtactcggcttgactctgagtctgaggcagtagcatccgaaaaggttggtctccaagttgcctggccaggaggtaaccagatggtgcacctgcaccctccccttggaccagcaaaaattgctcctgtttccacaagtgcttttttccttgatacagagacccttgggtttgggatgaagccttagaggtcatgccctgtcccagccttcatccatgctttgcctctctgaaacaatctggaagtaggacgtgggaggtcaaacttatgattcacatttggggcaacggaatgtcttttccttgagacatttttaagacttgtacttcatgataaagttgagctaggaagtggggccaatttttttttttttttagtttattcattaaacacatctcatgagtatactttttgccagttactaaaaatataaataagaccctgccctcagagtagttacagtctagacagtagagttttgtaaacagaaatatgtaataaaatataagaagagcactatgatagaaagtatttatgacacatgcagacacacaaaaaggagggttctgcttcacctttgagtgaaatgggatgggtggaggtgaatcctgaaaatgtttatggaagagattttatgtgagctggatccagagcattgagtaggtttgcatgagtcagacagggaaaggaaacatactctagacagagaaaacagcgtgaataagggcacagaacctcagcgcatcctggaggtctgagatttgcaagaatttgtcatggctgaagcgaaggcaaacaattagagttaacaatagcgaatggtcaggggctatcagtggtgtgctcaa

SEQ ID NO: 87980 - DNA, 1029 bp, Homo sapiens
acttaactgtattttgagtggaataatttgcaactgaaaaaagtttacaaaaataggattaatttctgcagaaaatgttcacagtaaaatgccaagggataaaaatggtattaaaaattatatacacagtatggtcttaattttaggagaaaattctatatctatgcaagcatatatagttataggtttgtgtacaaaaatggctgtaaagtaatacaccaaaatactaatagcagttttgcctgggtagtggaatttgggtaatttcagctttcttccttatacctttctttattttctaaattttataataaatattttctttttgaactcaggaaatctatggtatttatttttcaaggtaaatttttctttaagcatcagtggtaaaattacttttgtccccctccagtgttgaagagtgcaagaaattgggagtcctaggtttgaaatgtttttagctaagaggactagagaatggcagttaatgtacatcaatgataattgatccaggagacgctttggagttgacttaaaatgtaaaaatgtgttcagggttcaatatatctattttcaaggtgttattgatcagatctgtttggtttcatcacctctggcagatgttccagtggtttcttaggagagcctccctctaccctggtatgtgtgatcgtaagccagactttctgaatgcagcttaatgcccaagaccaaaatagactagtgagtcacttggacatattctgaatcaaagatttaaaaaccaaagcatgcaaataaatgctcctaatgccttagctcagagtaaacatcagttaattttaattttaaggctagccaaatggctattgcttaaggcggccagagtgatgttaatgtgaagagctggctccgtatgggcaagggctacatgttttggtgtgttatggtatttatggtatgctatttcattttaattaattttgtgtattctctatgatactaacacaatgttgggcatgtacaaagtgctgagtcaatgacagagac

SEQ ID NO: 87981 - DNA, 1036 bp, Homo sapiens
gtttgttttttttttttttttttaccagggtctgtgtgcaagtcagcaacgctcctgggatcacattgcttcttctgtgtttctttctaggtaaactagctcttgaacttagaaagaaacacttttgcttcctggggttgagggcaggagacggtcgtggtgagaatgtgcttaaagacaaagacaaaccagctggagatggtccttttaagtgaaggggagaggaagccgcaacaaggagggaccacctattacacaaagcacagcgtttcttaatctctgcactcatgacattttgggctagagtgttctttgttgtgcgggattgcccagtgcattacaggatgcttagcaacatccctggcctctacctattagatgccagtaacaccctgccaccagatgtaacaaccaaaaatgcctcctgacattttccatatatcccctggggagcaaaatgacctccagctgagaaccacccacgtagactctcagcatctaggtacctacaaaaccatcggtgggagttacacggactcattcatttcactcagcacacattcccatatcaatcagactttgccgcctgttaattcctctttctaatgcgctcttatttttatcctcagttgagatgaaactttctctcataggttgtctggtcactgaggtcactaggtcctaggtctgccctcagttccaggttgaaacttctgtcctcacatctacctgtagcctgtctcaggttccctggcttccacccacagcattgcctggaacaaactggtaggctgattttaagttgttttggttcaaaaactttctctctctcttttttttttttttaattttatttcgttttaaaccacagtttctcaaagtgcctgaactacttcgctctctcatggttctgtaccttaccccgtcatgcttagcttcggagggtgaggcagagctcacgtcacacatgctaggtctcatttgctcaaaatgatcccttagctcaaatcccagcaacctaacaatcagttacatt

SEQ ID NO: 87982 - DNA, 1161 bp, Homo sapiens
ctgatagggatacttaatccctgtaccaagcagatctattcatttgctaatctcatatattgattgtcagtaagacattaataccatgttttttctttttcttttccagcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttgcaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaa

SEQ ID NO: 87983 - DNA, 1069 bp, Homo sapiens
catcagtaaatttcaattttaaggggcctatgcaaaatgcctcctttctgatgtgattttcttgggttgctggccctagttgaatttatgggccctgaagcctctagtggaaatcttgtcttccctatagaacgagaacagctatgtaatttgcttcaccttctgttaggacttgcaccctctttgccatacagaatgctataaaaaggacagtctgccagtgaccgaagctttctcatttttttttcttccagaacaatagcacacatcttggttaaagctatagtctccttattattcagaaatattctttttcctgctgcaccattaggcaaacatacattatgcttagaatgatacttggaaactccttaacagggcatattgaagtatttgatccagcaacttacctaaaagaatgtttgctcttcacctagggaaataaaacctgaatttcagagccttcaaaatgaaattatccttccaggggaagcacattgccaccaaatacatcactcactacctgttcctggtgactacatagaagatgtgttatttttctgaggtttagaaagtcactgtttacagctatgcaaatattgtactattacagatttttctaatgaagtagtttgaaatcaaggctttagtggaaggtaatcttttcagtttctgacccagatttctttttcaagcaaaactcctctgaaagcctctttgctatagaggtgatgaaggcacttgctagcctaagcagaaacataaagtaaaaaattttgtagtagggaatttttgttggtaagaaatcagtatcatcttgtaacacaaacacgtgttaatagaacttaaaaatactcagcctaattccttgggactttcagtatcttgacatcacttgtattatcatttgaacttggacattgagccctttatttttgggagtttacagttaaattttggaagaattgtgttgtatttctttcttagatgttgtcagtatgaacagaatttttttgtgaacagttaatcttgatgtgctccatagctttctccagtttacacttttgca

SEQ ID NO: 87984 - DNA, 1692 bp, Homo sapiens
ggaggtttgattaagaaaattgtgtttatctcctgtattacctctgtgtttgatttattctttagtctcaaatttattttctgagtggactgattttctatatgaactgaaatgatgttttaatagaataataggtatttttagaggaaaagtatttttttgtgtaatttgcttacacaactaggacatacttcctatgatactgaatcatcaaattgagtcatttaaagctgaaagaggtgttaggaatgtagtttcacattatttaaatacatgaacagttttctatatattttgtgaaaatcttgatgagacactagaatttctttatggaattgaactttacaagaattttaataaaagaggtggatttcttcagctttctttgtgcttcagtttcatagctgaaaatgctgcttccgtttattaatatggactttgtaaggaaacacaacaacacgttttcttaccttctgtaaattttgtgatagacacatgttatttgtatatatgattgattgtttgcctgttgcaccctaaagttattttcaaaccatgtttattgcaaagagagcctttgggcaagtggaaaatgccctgatgctagaatgaggtagttccataagctagttaggagcttgctacctcttcttggtacctgaaatattctgaaaggatatcggagaggtcctatgcacccctgtctttcaaaacccacctccagcacttcaaagtagtgtctctggagagtttaaaataaaagaatgaatgctattcagtggattccctcattgaggctcccatctttcctgccaggtgcagctttttctggttggaatcatctcttctttacggattgccgcattgtctctttgtgaatgaggcaggctgaactgtagagcatgaaactcattagaagtttataaagtaaagacctgtaaagcatgtgggtggaatgtttccatgctcttgaggtgaatattaaatttaaattctggcctttgggaactctttgcttgtgagctgaagaaggaaagaaggagttgggggtgtatatctaactgtgtttttctatatggaaatatatgagcatcaagtgataacttcaataaggcctcaggattgtatttaaaatacctgttttgtgggacagcatgcctttgttttctttgcctgttggctttggtggctccaaacattttcattttaggctagctttcctgtcacccaggttgtgtgcattttttttttcatttgaactattgtttatcattattaatgatgttatctccaaatcccaaagccaaggaaatagccagtatgcaggacttgcagtagatataagcattggtgttaacataggttaagttttgttagtgttcccagaaatatactgaattgagggataatgtagctttaaagaaattatgtttctttttaacatttggagaagccacctgtcctgggtccctattcttgagaaattcatcttttcatgcaaataacattgatgggggacaagactggatgattgacttctatcagtcagtagacaaggaagtataataattgccaaaggtgagggtaattttgccttacaagtatgtaggtcattctgtggtgggatttcccatcacatctagtaaaaaacaaccttttcatttccctcctttctaatccaagatcatattt

SEQ ID NO: 87985 - DNA, 1029 bp, Homo sapiens
gatctccacacaaacctcaagtctgaaaaataggacccccaaaattatcccttccaccccccaaaaaaatcactttcttagttaacagtgcattttacttgctcttgcaaaaatctccctgccaatgctttctttccacaatcagaatcttttacttttaatgtaccaaaggaaacgaaataatatttattgtgtctcttgcatgtgcttcttagaaaaatggcattagcctcatatggaaatactttgacagacccctgaaaataattccttaaccacaaacatgtcctctacttgtctgatctcaaattgcctcaaatatcacaatttcaggtcagatttaaggatatgacaggcactatcagtccattacatatgaatgatatatgaggtagagggcagaggtgctggcacagaagacggccagttgtggggaagccccatgcctggttccctacagtatctgcctccctgggaactttccaggcccacctgaagacacttaccagccaacggcttcctctgcacaaaggagaagaggaacaatggaagctctctctgtgttcatcatccagataccatctcggaacctcactggagcacgattattggaggcaaaataacacagataggatttcacatgcgagctttggatatggggctaacaaagatagagggacacaaacaacccctctccctgagcccctgccttcctcacaaccccttgttgctctttcgcttccaacttctaattggcagacacctgatctgcatttcgatttcattttctgagcacacatggccacttgagactccctgatacgtgtgggaaaggggtggccatgttgcctgcacctgttgcggagacctgcccgccgcccctcccttcctgccacccccattgtgtgccaccttattctgtttcagtagcaacagaaaagaagtcaaagtcaccggcattcaacaggaacacatacaaaaaggaagccagaaagcttccttgtacctcttctcccaccaccctgaaaa

SEQ ID NO: 87986 - DNA, 1033 bp, Homo sapiens
ccatatccctgttactcccatggaatgactgtgatggtacctgggtcaacacatacatttgggcatctacacagcgccacattgttttccatttataacttatctattttgttatccatctaagcacccgttaatcactcattcatcacaaggcctctgagactatactacattttaattatgtttctagggaggaaggatgatacagacctgaatgagacacctctgtagcatttggggcttccctgtacccatcctcattcactgtccatgtcagggaagcagggagggtggtgtggaacagggactagggccagacagctctggattggaatgtgggtctgccacctgctctgtgactctgcagcttagagaggttaaaggacattgaaacatacagttgataatagtacctacctcatgaggttgtagggaaacacagagaaagccctcaattaagttaatggttgctatttttatttacagaccttaaggtgtggggagattacaacttgctcaaggtctcatagctagaagatgtcagagtgataactcaaaccatgtcacatgactctaagcccaaagcagcctctagaaggttgtttgatcttctgatggaagcacaaatcaccattccaacatgaaagatggagaaacttaagtctagagagatttaaaggacttgtcaaaggcaatgaaacaagtggtatgtgaacttaggtctcctggctcccagtccaatgttcttcgaatatgattttggcagtggtctacccagctagtacacagagtgtgcagccactcttcatgggaagttctgggaggggtttcaaccagcacactcactcctgctggttgtgaccagcaggacaattgctgagccacattctgagcacctgcaggtggaggtgggatcttatagaaatctagggcataagggagacagggaaattagaccctggctactttaacatactcactttacagatgaggaaactgaggcccagagaggataaatgacttgctcaaggtt

SEQ ID NO: 87987 - DNA, 1088 bp, Homo sapiens
cactgggcttccctgtcctccctggatgctccaccctccaggaacttccatgtgcccagctatctggaagctccctgaagaaccctgacttcttggggtttcatggaagcttcatgacgtcagcattccttccccaaggtatagggcagattcctctctggggagggtctcatgagtcagaaaggtggggaagattagagtcctgtcttggagcaggtgtaaggagggcaggagagggattctgtttcctgaggcccaacattatagcaaaagactgtaacaagggctatgggagttatgagctaggaacttaggacgaaaacctgtgtgtgtgtgtgtgtgtgtgtgtgtgtgtgtgtgtgtgtgtgtgtttatcaaataacaccacagtgtcattatctcatctctggccactggtgcccttctctctgggtttcctggccactgcacacatccccaccaaggcctcagctagagccctcatgaaggagaattcctttgcaccaggttgagtggggcccccaggtcttttgagggacagaagggggcctgttggtttccaaatgcccccagaatccatcgtgcatttccctcaaggccttgctgtcctctggccccatacttgcctaaggaaacctttgatccatgttatgtctccattatggcctgtgagggtggggtttgcctgtctggctgattcctgtatccacagcatctaatccaatatggtacttgtgaatgcatggatttgtggttgcccaggtattccttgtggattgatagtgattgctagaatcagagacccagagggcagcctctttcataaggcctatgttatctgtatctgtgaataggcctgatatggtttggctttgtatccccacccaaatctcatcttgaattgtaatccccataatccccaggcgtggagggaggaatctggtgggaggtgattggatcatgggggcgggttcccccatgctgttctcatgatagtgagtgagttcttacaagatctgatgattttacaagtgtctggcatttcccctgcttgctcttctctctcctaccgccatgtgagaaaggtc

SEQ ID NO: 87988 - DNA, 1047 bp, Homo sapiens
taggatttgccctggtttatcacctgctgcttctgctgctgctttttaaaaaaattgaagatggggtctcaccatgttgcccaggctggtcttgaactcccaagctcaagtgattctcccacctcagcctcctcagtagctgggattacaggctcatgcgaccatgccctgcttgtcaccttgccatcaaagaagagagacttgcagaagagtgtcagattctatcccatagtgcagtataccaaggaggtggtctgcaaatggccattgaatatacaaatagtctcagacttagcattttctttctcatggtttattttgctttgtatagttccatgcatttgttgaaaggaggaagattgagatttaaaggaacatccctagtgggataatacccatctgcttagtgccttttcagtgctcagcactgtgctaagttatttgagtacagtctttgttctcatatttaataaaatcagactctttttgaccacctcattccatctcccattcagacccacaacatcctcccagcctgtccagataggtgctttctgcttggacactttaatgatggagaattttatctctcctgaggccacccattctaacattggcaactgcagttgttgggaagttcatccgtttagggagtgtccatctgcctttggatacttccatctgtaggtcctgggcaatgaacaggggatgagagtatggcattatggctgaattgtgggatgcagactacagaaaagttctgtgaagggatgggacctggaagaatcagagaagacctcgtggagttactgaaacttagagaaaaaaatggactgaaatagagagagagcagggaggctggctatggtggctcatacctgtaatcccagcactttgggaagcagaggtgggcgggttgcttgagcccaggagttcaagaccagcctgggcaacatagggagactctgtctctacaaaaattagccacacaggtagctaatttttgtatttttttgtagaggatcctggtgggaggatcacttgagc

SEQ ID NO: 87989 - DNA, 1014 bp, Homo sapiens
cgcatgaggaccggggaggacagagctgtttgcaataggtgtgggcttttatagcattgtgagcatttcacgttagcgtaagtgttgctgctgtgcaggtggtctctggggcttacaatcttccccaatgttcttccccacccctcccaccattctggtgaacaagcctcttgggattctttgaaaaaaaaaaaaaaaaaagttgcttggggtcacaccatttaaacttacctccctaattttctgtgatctcatttttccttaaaatatcattggaaaagtgtttttgagtggagcattttattttccatttaaacatggtgaaaccgagacataggggctaaggcttggcgtgaggttggtggacctgggcctaggacaccttctgtggttccgccttcacaggctgggagcagcgttcaaccacagtgacatcatgatccctgccaggggatgctcggcctctgtggcctctgctttgctaatgggtacggacaccgtattcaatgggtatccctaggggcaaagaagtgattttaaaggaggaaacccccgatgggctcataaacttttgattttctttttttttaagcacagtgggttgggctccatctttaagttcaagttagtgactactctgctctaggaagacccaggagagagctgaaacttggacagtcattagcagctccagatggaggtggattgggaaagactggagggatggacaagccaccaagagcagaaagtccagcccttctagtttagcagtctccagagagctctgccgttgcggaggttgtctgtacaggttggtggaggaccacagaccacagagcgaggggcatagcttgctctcagttaaccagggctactcgtacgaatgagttgtgcactgtgctaggctctaggaattcaaacacatgaggtctattacccaccctaaaggaatttaaggtctttttggagcaagaggatggatagcctttttcccattatcttattattattatt

SEQ ID NO: 87990 - DNA, 2160 bp, Homo sapiens
ccaagttatttagctgctttgtgccttggtttcccctctataaatttggacttatgatagcacttactagatggagttgtagcgaagtttaaatcatatgatacgaggctgggcgtggtggctcatgcctgtaattccaggactttgggaggctgaggcaggcggatcacctgaagtcaggagttcaagaccagcctggccaacatggtgaaactccgtctctacaaaaatacaaaaagtatccgggtgtggtgatgcatgcctgtaatcccagctactcaggaggctgaggcaggagaatcacttgaacctggtaggcagtggttgtggtgagctgagattgtgccattgcactccagcctgggcaacaggagcaagactccgtctcaaaaaaaaaaaaaaaaaaaaaaagtgatatggatttaaattaggatagtgcccagagcatagaaccctcttaataaatactggtgagctaatatttttgagtcttactcttgtggggtcactgcctcccttgtattctagatgaataatctcaaacccactgtgcatcagaatcacccgtggagctcttttggaaacacaatttcccaaggccacaggccaggtctattgagtcagtctccagcaggaaagcctgtgaatctgcattttgagaagcttcttggatggttccaaggtagccaacctgactttagatggcaagggagcagctgctctagagccactatagctgagaaacacctgctctgatttcccacactggtttcagtcacataactcagaagggtctgtgcaatcaagcctaaggctctgatgttggtggtagagccttcctcgctttgcacttcagtttccttatctgcaaaatgaggcagccatgcaaagtgtagtccttggaccagcgacatcagcatcatttgggaacttgatagaaggcacaatctgtggctccatgccagacctatggagtcagaatccacattgtaacaagatccccaggaggctcttgttaaacagaaatagcacctctctagaaaaggttgaaaagaatcaagtttgcaaggaggcaaaggcagtagtcttctttcttgatgagaggagaactcagtaaggctgaggaaggtgcagtgtcagtggatattggaatagtgaccagctgttatccattcatactggacaagaggaaatgagcttcaggagcctcagggagtatggtcagatttatgagaacatttcctgacattgaaggttacaagtttctgggaaggtttgcaggaataagtaagctttggatacgcttctctagagtccattaaaatcagattgatagctctgcatccgttttacaaatgtttatttaggtgccaactatgtgccaagcttgggcaccagtagcttgagggagcacttgcagatggcagtggctctgtatggcttctctttatgttcacactacccatcaccaaggatagacatatatttgcctgtgcacagagctttgcatgatcccattgttggcatggatcaccagggcactccagcacaacccatggcctcgtggaagtgtatcagttatctgttactgagtaacaaaccatcccaaaacatggtggcttaaaacagcaactgttgtatttgtccatgattctggggtttggtctaggcctggctgggtggttgttctgctcatctggtcagtggttactcataaggcttcattctgctagagaattggttggggaactgggctccgctgggccactaggacactaggcctttctctcttttttcatatcatttaagggcttctctttctccacgtggtctctcaagctatcctagaggatagcttgacttctttttttttttttttttgagacagagtctcgctctgtcgcccaagctggagttcagtggcacgatctcggctcactgcaagctctgcctcctgggttcatgccattcttctgcctcaggctcccgagtagctgggactacaggcgcctgccaccacacccggctaattttttgtgtttttagtagagacggggtttcaccatgttagccaggatggtctcgatctcctgatctcgtgatctgcccgccttggcctcccaaagtgctgggattacaggcgagagccaccgtgcccgg

SEQ ID NO: 87991 - DNA, 1059 bp, Homo sapiens
ctaggcctccatgtgcccatctgtgcaatgggatagtagtggtttgcactgtacaaggtggttgtagaagtgagagcctctgcctagaaagcccttagtatagtgcctggtacgtaatgactgctcaaggaagggggagcttttagttacagacatgtacgatctgaagaaatgaaaggcattgaactttggtgggtaaattgggtcttttccagcaaaggtataaatccttaaaagccaagatcatattgtttgatttctctgggctctctgctggatacagtgccaagtccataactgtataccccatggacactctatgttaaatggagattaatgtgtaagaggtgtttttttttgttttgttttgttttttaatttggaaaagaagcttaaagaccacaatgggtgtggcattggctcgacccacagatctgcttagtctcagacaggcactttgaaccagtcttttaaaattgcgtcacaacaactggtgcttcataaggatttgatgatattcttggacataggatatggagttctcttcctgtccagcctcgggctatgaggactaaccctgctaagtctgatctcttcttaggaaagtcaggaggattgcaaataatcaccatgacatgcctataggggactagcctgtataaaagagagcgtcagagtcttatttctaagaataggaacgaggagggaaatggtgagtggatgtgaactagacaggtcacccggcagtcggctctttcttcctagaatgtccagttcacgtctgtgtcgcctctaagggctgcatggatcagaatcacccaacactggatcctcacctacctggccaaaccagtcctgactttgcttcttgttcagggacccacagcacgatgctaacagctggacctgatgtcagaggcggagaactgtctggatttccctcccagcctcctcctccaacgcccttttgatccaagattgagtaagagacattggcagatgctgagaaggacaacccaattgttttaacttgcagaccgagggggagatgggttccag

SEQ ID NO: 87992 - DNA, 1005 bp, Homo sapiens
gccttttttttttttttgacagagtctcgctctagtcccagaggctggagtgcgatggtgcaatcttgggtgcaatcttggctcactgtaatctccacctcccaggttcaagcgattctcctgcctcagcctcccgagtagctgggattacaggcacgtgccaccatgcctggctaatttttgcatatttagtagagatggtgtttccccatgttggtcaggctggtctcgaactcctcaggtgatccacctgcctcggcctccctaagagctgggattacaggtgtgaatctccgcgtccggcccacagttgacttttgtattccacagttgacttgctttatcacttacctgctcttccagcctctttctgtcccatgttctttgatccattccaagtaagttgcagacattagtattcttctctccaaatactgcggtgttcagatcattcactcgagtttaatatttgatggcagatattttttcttttaaagtaaaatttgcatgcactgtactgcaacgaatctgaagtgtaccataggtacagaataataccagtgccctgcaaagtgtcttcatggtctttgccagtccaccctcacccttagaccctcccgtgatggcggaatgatatggtttggttgtgtccccacccaaatctcatcttcaagtgtagctcccaaccccgtgggaggtaattgaatcatggggacagtttcccccatactgttctcatggtagtgaataagcctcatgagatctgatggttttataaatgggagttcccctgcacaagctctcttcttgcctgctgccatgtaagacgtgcctttctcctcctttgccttctgccatgactgtgaggcctccccagccacatggaattgtgcctccattaaacctctttttctttataaattacccagtctcaggtatgtgtttgttagccatgtgagaacagactaatacatctccatagcaacacttctgatgtctttctgc

SEQ ID NO: 87993 - DNA, 1057 bp, Homo sapiens
cagttgtttctgggttgaagtctgcccttctgggtacagccaggcatggaagagaggctatgattagagcagggactttggaattggagagacctgggtttgaatccatcacttgccagctgtgattttggttagttactttgtttgtggcccattaaaaaaatatctgtacaatgtgtttaatgacgctgatctcataaggccattgcaagaattaaatgaagcaatttagtgcaactaacaatgaatgcttccgtcacttaggggaagagcctggagaactctgtctccagcagattctggtgttgaatgtatctcactccgaacacatcttttctgaaaacttttatgccagtcgttaccacttttgtgatagaggagagtgtgaattctatttatttgttaatgcactgaattatgggctgttaggagctgttactgaaacatggagtatttaagaatcatttttatgcccttcttattcccatctcactatttcatgccctgtgccccaaataatcttggtgcaatgtgtttgtatagcttatgtctgcattaggccggttaagagaaaatccttcataggagtttttgttttgttttgttttgttttgttttgttttgttttgttttctcagccaatatcctcacatagaggtccattgacctcacatgtccttgctctcctggatcactgagtacttgagaagtctcgcgagtgtccttggggagatggccactgccatcatccctgatggacggtgactgataaaatatgtttctgtaagctctcttgtgtaggaagggtagccctggggtcattaactcagagctaaagcccatcgctttccggcccagagtagaacattctgcacgtggacccagaatccaggccgcctgcattctgatcccagctgggccactgcttacctctgagagaggtcgctaaagcccatctgagcctccctcctccttgataggtgagtggctgcttaggcttcctgggtctcatgttgcaatttcagaacatttggcaagaaaaagcatcatcctcact

SEQ ID NO: 87994 - DNA, 1195 bp, Homo sapiens
ttttttttagtatcttcaaagtgaaaaacagaattgttgtatgggtacttgaagtgtggtttcggctgaatttgttttgctctcacgccatcataaagtaggaaaattgtatgttggggactatctgcattatttatacttatatcaatgacattaacagataattaatagtgatgtatgaattaaagaagcttgtgaaatttactgccccattttacagatgaggaagttgaggccccgagagactaaggaacttgcccagtgtatgagagctaagagatggcagaacacgttgggtttgcatctgggtgggtggataggggtttgggagctggcatgaatttcattgctggctaaagatcctgagccagcagtccccgggccagcgggtgggaccagcaaggctgtcttcctaggactgaggattggagaactggtctgcctcaacgtgggagggaagaggggacactttgcgcttggtgcccatgccccaccctttccgaggagctgtcagatgctaggccctgtgatcccaggtggaggcccagcaaggtacccgctgcaagttatctttccagatcggtctccaggaagcatctccgtgtggcttccgagctgggggagctgcaggccgggctgccagcatctgactggctgttatttggttttctctgactagatctttgtttctgtgaaacccttagctgctgaggctctcgtgctgcagcttaatcggcgctgcatggagtgctagcctggttaagtaaacaccgttggaatattacctgtctgttaacctgtcaaaattgctttacagcccccttttatcttccccccgacggaatttcccctggagttttctgcctcctctctggttcctttcctcgcctgccctccttctcctgcaaagcttccccacccccggagtcattaaatattgtcagagttccgcctcttatggctgccttgtttgctcagttcagataaattgttgttgactctgtgatgcagaccaagggcactgggctcccagccccaaggaaggaagcatgaggtctgccaggtgggaagaggcgaggggtctgggggaggatgcatgggcgggggccctgcctccctggctgcacctcgctccccctggtcgcctcagaaggagccagtgctctgtccggcctcaccgtctcgcaggccttct

SEQ ID NO: 87995 - DNA, 1772 bp, Homo sapiens
ccgccttctcccctaggtaaccacaatatggagattgttaatattgtaaagggaaggtttactctcccacagctaagggtcaaagacaagcccacgtgacaagaaaagaagggatatttgcttgtggaggtttttctaggtttggtttgagttaaaaatgctgggcaggcatggtggttcacacctgtaatcccggcactttgggaggctgaggcaggtggatcacttgaggccaggagttcgagatcaacctggccaacatggcgaaacgctgtctctactaaaaatacaaaaattagctgagcgtggtggcacatgcctgtaatccaagctgcttgggaggctgaggcaggagaattgcttgaacccaggaggcagaggttgcagtgagctgagattgcgctgctggactccagcctgggcaacagagtgagactgtctcaaaaaaaaaaaaaagaaaaagaaaaagaaaaacaaaaaccaacttggtagatcctaagatctttttctcactgaaatatttaagcactgcattttaagaaaacttcctattcattcgtagacttttatctggccagatttccactctgagggcttttctttctagttatctgacaaaccataaattttatttcctttaagggcaaaaccaacctccaagcacatttatggcccatgttttaagagctggccgccctttctatcctgtatctctggttaaacgtgttttctttttcttggagcaaatttttcaaagaggggctaaagctatgtgttcctctggagagaactcctgcctacccagcaggaaagaaaatgccagagaagcctccgacctgggttctgcccctggtagccaggtctcaggctagaagccttctttttggttgcattggagtccttctctacctcacctttattgtttcttccttcttggtttttatgtattctcctctgcctcctttaaagagtggcaactttttggactttggacaattcctgtgtagcaatctgggctgattttagagagtccttctgtttcctgctttccagtgagctgattggttgatcagctgattttatttaccttcccctggaggaagtagagtcccaggatgctggggaggcccgctggggacccctgaatgccctttatgttgaccccttgtctttttgtttgggttcctagggctatggactgagaggcagcataactttgaaatggtatctattgaaggagtctctttctgcttctcaccatattgggaagaaggtggattaaaacatttatttactcttaattgtggtaaaatatacataacataaaatttaccattttaaccttttttttttttttttttttttgtctgagagggagtctcgctctatcgcccaggctggagtgcagtggcgtgattttggctgcaacctctgcctcccgggttcaagtaattctcctgcctcagcctcccaagtacttgggactacaggcgtgcaccaccacgcctgggtaatttttgtatttttagtagagacagggtttcaccatgttggccaggatggtctccatctcctgacctcgtgatccacctgcctcagcctcccgaagtgctgggattataggcatgagccaccgcgcctggctttttttttttttttttttaaatagagggggtctcaccatgttgcccaggctagtcttgaattcctgggctcagacaattctcctgcctaggcctcctcaagtgctgggatgacaggtgtgaaccacc

SEQ ID NO: 87996 - DNA, 2592 bp, Homo sapiens
ttattgggaatggtattgagggatggaggaggccagggtgggtgatttttaaaggggaggctgagggtgagatttctaaccaagatgcctacgtcattgtcttccttgaaatgctcttcaaattttaacatgaaacaccctctgaggatggtttgtgtttgtttttgtttttgagacggagtcttgctctgttgcccaggctggagtgcagtggcgcgatcttggctcactgcaacctccgcctaccgaattcaagccattctcctgcctcagcctcccgagtagctgggactacaggcatgcaccaccacacctggctcatttttgtattttcagtagagatgtggtttcactacgttggccaggctggtcttgaactcctgacctcgtgatctgcctgcttcggcctcccaaagtgctagaattacaggcttgagccaccacgcccgggctggggacagttctgacacagaagtgagcttatactcccgagagctctagagctttggcctggacatttcttcccagcctggaaatttcttggaagtgtcctttattcatgctcaaaattcctgggaatgctgcaacctcttccaccatgaaatgatagcattgcagactcttgttttactgccctcttgttctaaactcaaatatccctcaagaaattacaaagggtactccctttgctggcttcccctctgttaagctgtgggtacagacataaacccttgccagccagatggcattttctttttctcccggttggcctctgtgtgctcaacagaaatgttcccaccctttggataaagcatgggctgcaacctgcaacattattgcaggctttgttcttagattatgtgccccagatagctccagccagggattttttcataaagttggtatgtgggcggaaggagaggacttggcgtttcttttgtaaggacagagataggaagaagggagaggccaggaggtgatgtactggaagatcatcaaaatgaagaaagaaacaaatatgtggagagacagttacttgaatatcaatggtgtttgttttctgtggattttctttgggctagcggggaggtgatattttgaagtacaaaggaccatctaatctggtgcatctcttggcatattctgatgcctctgggtctacagcaataaatccatcatatcattaggaatattttgtctgtccctcatcccctctcctgcgaggttatctgaacaagatgcacgaactaccaagtggttgaattttcacttagtgggttgcatggattgcaggcgattcctaaataacagagcagagaccaagagagatactgtcatacttttagagaaaggctgcttcgggaacaaatttttgaggctggatgttctcttgttttccctccattttccaaattcttaggttaattaagagcaaaaggagtaagctattagaatttttactatccacactaatttgtgtgactttgaaagtcgattgagttgatgagcggtttatttttagagtggttttggaattgaaaatgtgaagcttaatagttttttttcttttagggactgtgaatggacttatctttaactgggctgtatgtacatacaaataaatcttgattttccgagagagagagagagagagagagtgtgtgtgtgtgtgtgtgtgtgtaagtgtgtacctggacctgcacttcctggctggtgtatctatgtgtgcacaaatatatgcaggactataaataaaaaccgcaaatgaatgccttagactgaaacatgagggctgctctttctattttgtgcaacaaatgaggcgtgcagatctcctttggagaccaagtctttaggagaaatagcagctccgggaagagcctggcacctttgctctctgggtttctgcaccatgccatcttgtggttagcaggggagacagtgcgttaggcctggggatatcctggtcccagctccagggctacccctgggcctccctttccccagtgggtgtcttttccttgtgctaactttaaggataaaccctgattttgatgttgcaaggtaatgtggtataggcctcaaagacagactattgatctttttatgtagtttccttatggatgatacttgtcggtttataaggctagcggaaggcctgtgtgtgtgtaggggggtggggggttggagttgggagtgagcttggtgagcaggtatggggataccagggcaacctgagaggtaggccacgtcatcaccatttataataggcttccaggagagtgaaaaagtcatcagcgtcacctagactgaaacagagccaggggtaataacccaggatggtacactgcaagcctacatctatccattgttattttccatccttcaaacaagaataaatactaaaaaagaagttgaatgaatgccgattgaatgaatgaaatattatagaagatacctggaaaagtcagaagacacatacacccacacccatacacacatacaccgtactcctcaaggagttgaccatctagacatttagccatgtacctttaggcaagttactgaacctctctgtgcctcagtttcctc

SEQ ID NO: 87997 - DNA, 1027 bp, Homo sapiens
aggccctaggtggggaaagtgaggaccacagctaagccacctgcccaaggtcacataaatggtaagtaacagagctgggattcaaacccaggtagtagggattacaggctggagcatctgaggtttaaaaggtgggagaccaggacccaggtctgttacccacactggaaattgttagcatgcttgtcaaggcctgtagcccctgactcccctaggtgaatgtcaggatccctcccaggagtatgtgtgtgagagagtgtatgtgagtgtgtctgagtgtatgtgtgagtgtgcatatctggtgtgtgtgtgtctgtatgtctgtgtatgagtgtgtgggtgtgtatcttggtgtatgagtgtgtgtgcctgggtgtgtatatgagtgtgagtgtgcataagtgtgtgggtgtgtgtatgattgtgtatatctgggtttctgcctgtgtgtgtatgagtgtgtgtgtgcgcgtctgagtcttgtgcgtctctgtgtgtctgggtgtatgagtgtgtatatgttgtgtgtgtctgcgttatgtgtgtctgtgttgtgtgcgtgtttgggcgtgtgtctgagtgtgtgttgtgtgtctctggggaggggtgtgtgtgtgtgagaatgtgtgtggtgtgtgtgtgtctgggtgtgtgtggtatgtgtgggtgtgtgtgtgagtgggtgtgtgagtgtgtgtgtgttgtgtgcgtgcctgggggtgtggtcctatgtaaagagctctgccggtttctgccaaaggccggcgaaggcacaatctgcattgttcctaacagatagacctccagagttataacggtgcttgagggaagtggctcgcttctgtcctcacaaaaatcgtggccagggcaaaggcattaactccttataaccagctgtgcccagcagggaagtcaggcgaagagcagcacctgagctcaggcagctcctctgggcccgcgggcatctctcctggatattgctggggtctgtcgccacctcgtggttattccgtgtatcggctttcaa

SEQ ID NO: 87998 - DNA, 1027 bp, Homo sapiens
ccactgaggtcctctgagaagtttctctttcgattttatattgctattggaggtatatttgttattccaaacaactttgcatttaaaaaagcctgttgtgcatttacacatttgacgatctcttttatctctggtctgtatttgagttttgcagagtcatgatcttagagcctgtcatgtatttacacatttgacaatctcttttatccctggtctgtatttgagttttgcagagtcatgatcttagagcatgcagtttgattcccaccatttaacttaatctttttgtttttgtttttcctcatgcctgtgtccttgtctttgtgttgattttgaatgcctgtacactatgctgcaaagcaaatataatttgcttaagattgctattgaggagtaggagaatgttaacttttagtttaatcttatgtaagtaataccatgaaacttctttttcccttccatttttatctttcggccaaactgggggtttttgtaacaggacaaaagccataccggacagcggtgtagtgagtgaattctttagccaatgagtctcaagggtggccgggtaccctgactaacagggtagcagggcttggccatgaaactgtcctggtgcaaggaactggggctgtgctggtgaactcctggcctctgatctcttctcttcctccactctcaaactccacatcctggaaatccttgaagactcttccattctgctcttggacctgcctggcacatggctgctgcttatggatgatttgttcccttgagtggacttccaggctcgagttccagtgaagaatttttgggagatactcaaaggagaaacgaatctctaggcttgcccagtggccctggggcaccctctttccacgccatcctccatccccagcgatgcttggctgtagtccatcttcctcttctctgcccctgcatttccatcccaggaggaccactgggcacaaggaacatcagaaaccagggagcagtgtgcattgggattccttccagacgctgagag

SEQ ID NO: 87999 - DNA, 1095 bp, Homo sapiens
aaatgctaggattacaggcgtgagccaccgtgcccggccgggaggttttcttagggagatggaaacactgtctgccaggcggtctcttcaggcccctttgcggtcagtgctccttctgcaatgcacactttgctttttgttagggtgttctccatcctgaatgctcttcctcttcctcttgcccacccatgcgtggctcttcctcctcagggaggccatcacctaagggtgactgagcacctgctgtgcaccaggctctgtgacactcagaagttcaagattagcctgggcaacatggcgaaaccccatccctactaaaaattagcccaggctggtcttgaacttctgacctcaggtgatctgcccgccttggcctcccaaagtgctgggattacaggcgtgagccaccgcgcctggcctgatcagctttctgtctctataaatgtgccctttctggagattccatagaaatggaatcatacgtgtagtcttttgcgtctggcttctttcgcttagtataatgcttctgagaaagtgaccgtcaccaacttctcatggagccttctctgtgtgtccagactgttgcattcttggtagtgaatgggttaaccagaaacaaaggtgaggctcctgtgtgtgtgagggggactgcccttgggggggtcttcagcccttcctgcccaggcccctgaccaggcttttcaccctgcctgccagttttgaaggacctggcctcctccttccggctgttgtagcttaattaagttataatgacagacagagaagggttgtttcctggcaattaaagtaagtggaaggttggaacatggtccagccctcctcccggccaggaaggactggactctcccctctcattgttcctacccacgccaaccccctagatgggttctggggtgtgttggcaggggggtgttgggaagttccctcccctccccaaggcttcccatgctgtggctgatttttctcttccccagctgattttgtaggctattggttatgaaaaatgagatatgcattcatctaattttgaggcttcctcctgaccatcccaacctcagtcgaaggagacaggaa

SEQ ID NO: 88000 - DNA, 1099 bp, Homo sapiens
taatggaaccctaggcataaatggctacccccttttctatccctttcatcgttgactttttcaaggggtgaggagaaaccttcttgatgaaagatgtgttttgaaaaacttactgaacatccttctgttttatcatcagcactgttaatcgccaccttagtatgttcccttcaattctagacctgagccagaggaagaggctgggactgtttaaattggccacctatgatgctgcctctctccgggtggaatcttcacctgataacatgtggaggggggaggccccttcagacagacaggtttctctctcgcctgttctttcatagcagagggagccgcttagcacaagggacactttagatgatcctagggggatgggagggctagtgagttagtggcaggaggtggggagcgatgtcatttattaggtctatgaaaacaatacagggtttgtctcctgggtgcagtggtgcccgggggggcaaagccaagatggggctgagtagaaagaaaacaagcacaggtctgacgaaaatgtggtgaccccgaggagctggggaaaaaagcacctttgtttagggaggtcagggcaatgggaggcatttgaggaggactctgggagatttgctgcctctattctgggaacctgggccccgaaaagaggcttgagaagaccaaggaaccgaggctgatggaagtttccagggtggctgatccagctgctgtgcatttctggggcaggtttaaggtttagaggagccacttccttatcagccctgttccttgagggtggcccgagagaggatcacactggagtgtccagggggtggggagggaggatgatggaggggactgttctgatgtgggggctcctgatgggctatggttttgcttcctgctaaggctgcctggatgatctggccctggggcagggaagccccaagagccttgagtcaggccccatgaaatgtggggtgaaggcactcacggggtatggtgcccaggaccccctcccctggtcacactgtatccatgggcgaaggcattcacaggtgcagtgcccaggagcccttcccctggtcaccatggaccctgcaag

SEQ ID NO: 88001 - DNA, 1048 bp, Homo sapiens
tcctctctgtgtatctcagaactacatgatttcttgattacttggagcagggagggtgtctttttgttttgtttgccgttttccacaggtgaccttgagcaaggtaggtaaggagagatgccaggttgttctcagtggacacacggcttccagttctttctgcaatacaactcgacttcttggagaagaactcaattcaacataaatgaaatcaaaatagaaaacagtcttgctgagcaatctttagagaacatcatttgtgatagctatagctgggaatgtctattttgttgtgaccttgtacccaaataaattagaggagtaattgaccctttttctccctgaggtttgagataattttatttatttaagggctttagggcagtctgcttgcccctttccagagggggacagctggactcaaaatgccttcaaaggatccatcttttagggcgccgtggcagaggcccttcacttaggtaaaagtgagattctttcctgcatgctggtgggctcccatcctggatttgggagctgcaaagcacacgttggtgggagatccggctgggaggagaattccgctctgcggggctgctgacccacttgtcactcacttgctgttaaggcatagagacgccttgttgtaactggaattgttctggggaatgaggagtcctcgccactcccccttctccttcccgccctaacctccctcccctccccttaggggaaaaaaaaattccttcccccttttcagcatctgtgtctttaagaattccctccactgtagcctcaggacagagacccttctgtgagagtgtgctggaggcctgtccttggtgacaccccgccccccatattaaaagaccattggaacaagctccccattctcctctggagagggtccctctgtcccaggccaagcgactcttaagggagcgtttatcctgggacactcagtttacaaagactgctgcagtgtcagataaactcactcagcccttcgaggggggagggggaggagaagaacaaaaccccctttattttc

SEQ ID NO: 88002 - DNA, 1139 bp, Homo sapiens
tggggaagactgagaatacagggaggccagacagagagctcgtccagaagcagccacacaagtggatttatgtagagggctccattgtgttcacacattcatgtgccaacttggaagcagatcttctgggtgctccatgttcgagagacagctttgatctccaggctgttgagctcaaggtgggagactctgttttgcttactttgttcacacattacacaggtaggctttgtttgaggagcagtgactcacgctcatgggttgtgtgagctttgaaaggaagccatgcggccctggcaggtgctcccagctgtcctcgtttgccattgtcagaaaaaaatcttattgtcatggcgacagatttttttctacctaaagcttgagtatgaatagccttttttgataggtgatgaagtgggaggagagggggtaggtatcatgtattaaaggtgccgtatgtcctgtggaagtgtagttactgttgcccccatttaacagacaaggatgctgaggctcccagagcttatgtcagttgtccaaagttaccgtgctggtctgaggtggagctggaacttgatctgcttccaactggacacgtgactgcatccatccaggctttagctgcaagctggatcctgtttctcttggaaagtgctagaagtcacaaatcaaatggttttcacattatatatttatttagagacagagtcttactctgtcacccaggctggagtacagtggcttgattgtggctcactgcagcttcaacctctggggctcaagcaatcctcctttctcagcctcctgagtggctgggactataggcatgcactaccacatctggctaattttttgatttttttgtagagacaaggtctccctgtgttacccaggctggttcgtgaactcctgggctcaaacgatcctccagcctccacctcccaaagtgctggagtcataggcatgagcctggcctcataatacttctatcgctatgattcatccttcacttcttcctcctagtaacccactgacagctttaaaacagtgcttctccttccctctgctcatagaggtgagacatacatcctttcaggagtgtagctggaaatagactcctcccttccctacagatggga

SEQ ID NO: 88003 - DNA, 1062 bp, Homo sapiens
tcctccctgctgcttgccctgcggagtcacgctttcatatataaagtttgctggaagtggaacttttattaaagtagagaacacttttctgcacagtttgaggtgcttaaaaagtgccttttgaggccaggcgcggtggctcacgcctgtaatcccagcactttgggaggccgaggcgggcggatcacgaggtcaggagatggagaccagcctggctaacacggtgaaaccccgtctctactaaaaatacaaaaaaatagccgggcgtggtggcgggcacctgtagtcccagctactcgggaggctgagaatggcgtgaacccgggaggcggagtttgcagtgagcagagatcacaccactgcactccagcctgggcgacagagcgagactccgtctcaaaaaaaaaaaagtgccttttgagcatcatggtggatgtcagagttcggtggcagctcccgtggggacctggggtgtgtggctgggtgaagacgatcacctcccttctgtggttttattccccaggctgagtttgagcccccaaggctcctgtcggttctggtttgtgattggctcctccgtgccccatgcgcatgtccagccgccagggagattaggcgtttgtagtaagtgatttcactggccctggggggacagatggtagacagtgtttgatcccagtctttgcagggctctagcccctcgcagcttctgcaccttctctgcatggacaggaaagtggccttgtcacctcagagccaccaaaaatgtggctgttttccattttaatttcttcacggtgatatttctttatatttttaaaattaagcagtggctgggcgtggtggttcgctcctgtaatcctagaactttgggaggccaaggtgggaggatcggttgagcctaggaggtctaggctgcggtgaactataattatcccactgcactccagcctgggtgacagagcaagaccctgtctctaaaaaaaaaaaaaaaaaaaaaaataaataaaaataaaataaaattaaacatcaagaagcaaagttgttgttgctgaagttggg

SEQ ID NO: 88004 - DNA, 1034 bp, Homo sapiens
cgcacacgtgaattgaggctgtctgctttgagtatcactgtgtcttttctgacttggagtggttgcctgcattgagcgaaggcgatgtttgtttgggataaggaagttttgacgttacttaaatctcaacaaaacagatttctgttgtccagacagagtttctgtgttaatgttagggtctggttgcctagacttgatttttcttttcctttttgaaatgctcccaaccttcctactgtagcttgtaaactgaaggatattcatgtctttctctctccttgtgaactggtacagacgttttctgtaactagccagctccagtgaggatcataacaggaagtctcgcggggagaggggttgcggctgttgtgactaaacagttctggaaggcacctctgtctacacctgcctgtccctgtcctcagcgtctcctggtgggtcctccctactcagacgctgcagcttttctagaatctactccagtgcagtgcagactgttcactttaggactgccccacctgtcccctggtgttcaaattgtggtttgcataagaatgaattgcttgcggaacgcgttataaatgaatattctcagcacccacccccgtccagcccctcaccttcagtgcttgggggtctgcattttcaacaagccacccaggccattctgacacaggcactttaagaaaacaggaagttgactgacttcttggccagataaagccttaattgaacattttcccactgaagcttacccaaccacagtgtttttttctttctcctcctccaggaagcctttctggtttacctccactggtctgggcccccgcatgtacttgtttggtttgttggtacaggtttttacttaggagccttgaagtcagatgccctttatacttggttaagacaggagtggctgcatttgggtgaatgataaaggaactacagctctgggcattttctcccctcaggtaggcaagctctttgggagcttggaacgtgtccctgaccaggcagcatcctggcacatttgt

SEQ ID NO: 88005 - DNA, 1027 bp, Homo sapiens
gcgtcctcggcgcacccgctcggccccttgcacttgccttaacgcctgggcgccctccgggctccgttacttcgggagcggtgccgcctccgtgagctcctggcgtccgcccactggcgaccggggacgctgctggggcgcagcggttggagaacgcgactcagccgagcccctctcaccgttggggctagggggtgagcgggggcgtttggcaagcagctttccggcgaggactgggccacccgtcaggctgacgctggtacgcgtttggccagggtgtggacgggctttctgaataggtgggaggtggcaggaattcagtccagtgagaccacccgccacctcccctttccggcgcaacttgctaatggaagtcgtttcttggccaatgtggggagagggcttacgtcttgagtctggaactgaaagcataccgcttctgtatccatagcttcctcctccccttgttcttttgtgtctgccctgtttgggggcagcgcgatgcctgtcactgagtaggcactgaatagatgtttgttgaatgaatgactgagcgactccacccttggcgtgcagattaaccagggtcctccttttccttctccctccttggcgattgtcctcacctccaggacctatctaggtttcctgaggatgctttcccagaggtgggattccctccttcgcccctcacccctctcctgcagcctgtgggttcgcatttagaacctgtcggtgatccatttcccacccagcagtcccttctgcataggaatctgacgctgtcagggatcactcttggtcagtgctcagggtcccagcgtctccagtgagcactgctccaggagcaagagaaagtaaagcagcaccggaagaagaaaaggcagtgcatagtggcacgaccccctaccctgggagctggggccctcggtgcccctggtcccatgcagggtttggaactgcccaggttgacacagcaccttacctgcggcccttccccaccctctgcccccaccccagttctgtg

SEQ ID NO: 88006 - DNA, 1003 bp, Homo sapiens
acaaaggccagaatagacctagcggcattgacaataggactggaatgccagctttgtctgtgaaggaagggcgcaagggaggacagctgtggtgggcaaaccctaaccatttccatccttgtttagcttttgttctgactacgacaggactacgtagtcgaactacgactcccaggaagccgttcggccttccccaccccctccccgcccaccccgctccgccccgtcccggcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtaagtttccctgcggttcggggaagggatctgatttactttcttttctttctttccttttttcctccgcgtcgtttttcgaaggtctcgagattccgggttgaaatttttgttcttgtaatt

SEQ ID NO: 88007 - DNA, 2329 bp, Homo sapiens
atctttaagaaataatcacccctcttcattactcacacatggaccacagaacgatcataggtgaccttgggcaagtaacttctctttgcctcagtttccccaccagtaaaatgaggataattatgatactgacctcatgaggttgttgtttggggttccatggttcattagtttgcctggcacatagtaagccccagtaaatgttaccattattaatggtagtgtgctttctcttggaattggacattgcagaggatgccttcagcctagccgtggcctcagggatcattaaggtcttacttttcttcctgtccttctcttccagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagagacagacagagtgtgggtttgttcggaggcctctgctgtcaatggattccaggagcaaggccatttgtcgcgctttccaaatttcttaggcatttattttgataagtttatagccatcatgtttctaagagacttggagacaccagcaaactgctagaactcaaactcttcaattactcaaagaaggagccatttcagttaactcaagtgaatgaaagagttttggaatctgctgtgggtccttccctgttgaccatttggtaacttataatctgacaaaaactcttgagctgcaacaggccttgccagagggctcaggatgggaaaggaagaaggggataggaaaagaagaggtaattttacatttcccctttaaagtaaattttagccaactcatcattctgaaatgtccctataaagaatgagtcgaactagaccagaagccagcctactccttcttacatagcttctccaacaggggtagcaatgacctgtccacttcaaacacagataaggcctgccatcctcattggttaaaggcacacgtgagactttcagtgggctctgctgagaaggaaggcagcccaggagtcaggtatgcaggcattgcattgtcagtgtctgctctcagagtttacacattcaattgcttccaagggtgaatctcctgctctgtgaatgctatcagaccccaaaggccaaccttgggctgggtctatgtacgttcttccgaagcactgatgatcaaaattgaagacacattcagaggtttgattggttgagattaactggtgtggtggttggtgtatgtatgttttatttttatgtctttgtatgtagttctacataatgcaaattgtgctttctgatggacaagacctcataactgtgattaatatcaataaaaaggggatgttgtggatgacctgtgttacgttcagtacttctcaaagctgcttctttgcaaggatgatcataaaagagctaactaaagttggaactaacacctccctgatccaacactaggagaggcaaaggaaagagctcagatgggaagggctagtcagattcttggttgcaacaacagcatccaacagcagcttacttaaacagaaaaggaaatgagtggaagcctgttagggaattcacaggctctttcggagaatcgggcttgaaaatgggttggatccaagaaagccagaggtctggggc

SEQ ID NO: 88008 - DNA, 1069 bp, Homo sapiens
aatcttgagctgctaatccatccttccttattggcactgacttttccattgccccctcatctgcagggtcttgaacttggtttcctgccctggacttaacctgccttcctgacaccgactgacttcacctctccccatgccctcatgtcatgtcttatctgttcctattgtggatccgggattccttggcctgtcccttggcctgctgctgatcatatctccactctgacccacaatatagattttcaaggtaaaaatttttttaaaaaatgtttcactctgttgtctagtaaaatacatgaatgtgtatcctttgactaagggtctttgtgggtgaggaaacaaggaagcaccgcagctttctaggggagggttaccttcaagcttcgtggaaagttcctcatgtcgcctggcaaagcactggacacctttcaaagcacactgaaaattctaacatcaaaactcacaaacactgctttctggtaaggccatccaaaattttaggtggatccaagacatcctgcaagtgttctctccatattgcctttcagatcaccttctattaaaaaacaaaaactctattaactgaaactcagtagaagctttcaaaaaaaataaagggagggttgacctttgttgttatttttctttggtctttcaagatggagtgagaactggcctctagtgtttggtaaataccttacgctgcccagcaaggttgactgtgttatcccccggcaggctagctcaaataggcaggcaggccctgccacaggcagatgaaaacagggagaagaagtccacatatgtcacatgtctttggagcctgtcccctgtctgtcttccttcttgaagacccagtcctttctctataggtctctggctcagcccatctgctccctctcagcttaatgacaacaactttgagtcttctgaaacaaatgtgcttgcatggggaggcaacagtctttgtcccacctctgccagcagaccttgtaggacaaggcatcagtctaatccctcactaagccctgtgctttgcagccttcattttaactgcttctgttca

SEQ ID NO: 88009 - DNA, 1060 bp, Homo sapiens
atagatgcaaagatcctgggaggtaggtgctgaaaatggaaccggatataagcaggtgagctgggttcatctggatggagtgggcactgaccgttagcttcatgtgctggaaaatttctttaagctccaagtcaaaactcagtttttccatgaagccctttctggctccttcaagtgaagctggtcgctccatcttaaagggccctgtttcctttgtcagaacacttgggtttcagtatgtccccaattctaagcaaattcctggtacagaggaggtgctcgataagtacttatggatggaataaatgggtaacctacatggatgggtgaattttattttattcagatacagtcaagagatggtggaggatgagtttgtgaacagctcttaattattttgaattctttcaggcagtatttcctaaaatacaaaatacaggttctgtaagatgttaacaggtgttatctaataaaagggttccgttgtcaaatacattaggaaaacaaaattatacaggtgtctttgctgcagggaattcttcaagcctataaaatgtgatgtcggttctgggtcttgaagagtatttaagatttctaaaactcattaggttggaccataggaaattcctgttttgtagttttttaaacattgttaaatagcagcaattttgtatggtttaacctaatatttaactgtggaactcttttaaatgttactgatgttccatggagctcaattttgatctctagaacattggtttcatttgggaggcaatgagggagaaggggaggaaggtggagggttcgtggatgagaatctaaatcctgttgggagcttctcctgtcccaggagagtctgatgtgctttaaggttgtggtcaggtggtctttaggaaattaactccttgaagattcaggtctagttctctctgcctccaccccatggcagccaattggaaaccacagtttagagggagaactccaaaaaggaccaatgctcacatgctggacatcaaggcctatttcctcatcccaaatggtctacgtgggtctcaaaaga

SEQ ID NO: 88010 - DNA, 1033 bp, Homo sapiens
aaatgctaaatgatgttgcctattactttttaacatcattaagattcattataaccaaagtgtgtcctagaataacctcctacggtttactcgtgtgcagaatgtggatgagaaggcctgcctgcctgcctcagaagtgcaagctgtgcatgtgttcaccatcagcaggagcttattacacatgtattgaatgactaacatgggctgtcaactgtaagccctgacaaattcgaaggtgtttgttgctgtgcttccgaatgcatagtgctggttctaaatgtgcttgttgccttgcagtgcatttattgggcatgttgctcttttggcctatgtggtgatgttatcagcccaggtcctctgagaagcagattccaagaagggattagacctgcatgagatgagattgactgggagaaagacctgagaaggaccaaggggagggagcaggagctggcagactgccgtgcaggtctgacacccgtgaaaggagagggggaaggaaggaggcctgggaagaagagccgccaatcacagcagatttctaagaacattaggtcaggctgaagggaggcccatgagccaaaagtgtcctctaaaaggagtgccacatcccactggaatgggcctacaaccatcagcactatctggctcccgaacttttttatcttcccaaactgaaactctacctccatgagacaccaacttcattttcaccttcccagccccctggaaaccagcattctactttctgcctctatgaattgactactctaggagcctcacataagtggatcagacagtatttgttcttttgtgtctggctcatttcacttagcataatgtcctcaaggttgtgaacccagaaaatctgagacagatctcagttaatttagaaagtttattttgccaaggttgaggacgagcccgtgacacagcctcaggaagtcctgatgacatgtgcccaaggtggtcagggcacagtttggttttatacattttagggggacatgagacgccaatcaatagatgtagg

SEQ ID NO: 88011 - DNA, 1052 bp, Homo sapiens
cacattgtttctgataaattcaggatgctgcagagtcatcctgtgataccattctcttgctcctgttggttctgagtttttttcttatttcctgagttggggactgaagtgggttgcgagttgtgccgggacttgtgtagcaggctcgagagcatcatgatgtctgatgtcgggggatggaaggagctgcacaagggctgaaatagtagctcatcatcttgtcctctggtgttatgtgttatctgccagtagacaacctctcctcaccccagcccaagccaacatcattggtctatgtcagcttagcccctctcacagaacagcctcctgtgacttaactcaggtttgaaagaaaggatgttaaccgtcagatgaaaatcactggagtctttattgtcagctttctgctagagccattgtcctgttcatcccccaatgcctctagataaaacttttagaatacactgcctggaaaagctttgcctccctgtgggaatgacagacattgatcgtgtagacctttttttattctttggctgctaggaagcacagcacttcatttgctgctttgtgataaggataaagtgcattcttaaggtctgaatatctgaatatctgaattcttcttccatgttataacctattgttgtactgcactttaatccatttcaaaagaggacggttattaataatcgctacaagtgatttcattcctgtgttgccagttttcttcattttgtttcctggccacagactatatttctaaaccagatgcagtgcctgaaaagtatttttatttgattataatggagactggagaccaggcaagagggaataaagtaatctatttgtagcttgacaatggtcttgattaaggtcttgattgacaagggcttgatttatttttgcttcactgtaaagaaaattgtagcttttctaagatttttgtttcttgaaatacctggctactttgcaagcaggatggaccaccaaggagccatctcatctgctgatgagtctccctcctctgttgaggtggccccatttttccc

SEQ ID NO: 88012 - DNA, 1017 bp, Homo sapiens
caaactcctgacctcaggtgatccgcccaccttggcttcccagagtgctgggattacaggtgtgagccaccactcccagccgcctaattttctttctacattgtccaggtgggccaagggaggacattgactcatgtgggtcctgatgatacattggcagactcttgctgccttttgtgtttgaaattattttaaaggtccagagaagagggtaggtgaattccatgctttttattttcctctcaatagtatcaagagccaagtttgttttgctggttgttgctatgacatagaggcctggggaccactgtttgtgttgctagaaccacacaacagttggttttggtcatgtggcctgtcctcattgccagctcctgataatggctttcaaagaaatgcttgggattttaatccaaagtgattttttgtttcagggaacaggaacccaaatttagacatgaaaatgttcacagtggttggttattcctgggtgataggattgcagatgacttttattttcttcctgtttttgtgagatttataactaagctttcctgtagtaaatatttatgacttgcgatcagataaaaatgcttttttggaaaggtgaaattcttgccttttttaagcttgccacattaaacgttaatgtctgcagcaccacgttggcgtggttctcactccagctgcatcagactcagttcatcaaggagttaccatcacctaaccacttcaacacctcaaccctcaacttatgcacagaagtagagagatgttattcctttatgctagagatcatcttactggggatgttttaatatttagacaagttagaagcagaatgaaggactgccttggttttctttggctggtgtaaccaattatcacaaacttagtggcttaaaacaatccagatttattctcctgcagttctggaggccagaagtctgacatcagtttcactgtgataaagtcaaggggttggaagggccgtgttcttgccgggggctctagggg

SEQ ID NO: 88013 - DNA, 1021 bp, Homo sapiens
ccgaagtgttgggatttcaggcgtgagtgaccatgctcagcctagtcaatgaattgttcgctgaatgaatggatgcctgagtgaatgagagaacacacagaagcatgcatagtctacaggaagtttggaatgggcaattgtgacgtgggtcctttttggagaggagtgaagatggcagtcccagctacttgggaggctgagatgggaggatggcttgagcccgggaagttggggctgcagtgagttgtgatcacaccattgccctccaggctgggtgacagagtaagaccctgtctcaaaaaagaaaaagaagcttcttcctgctgtagcttgctggagagttaacgtgcacatgttcaaagcgctgtctttccccatctctctttttttttttttttgctcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccaggtgaggtcttgcccgtgagcgtgacagccactgcctgaaggtaaagtcatttgtcagcacagttgtctggctggaaaaggggaaggggcaattgtgacgtgggtcctttttggagaggagtgaaggtggcagtacaaatctttcttggctttattttttgatcgtcatagatagatcatcatatgtgaaaacttcccattccggttagtttaaacaacttctacttcctttttgtttacatatttgttaccaagttatttggagcataaattcataactgttacatgattgctgtggagggtatcttttataaatactgggtatctctggttctgcttaatgctatttgaaaacatagttgacccttgaacaacacagatctgaactacgtgagttcacttacactcagattttcttccgcctctgccccctgagagagcaagacc

SEQ ID NO: 88014 - DNA, 1138 bp, Homo sapiens
caccaggtcttggctgcttgctttgctttggcaatgacctaagattgaaaatggatgagtggcaatttgggagtctagcgaagatgctttgcaaatgaacacattgccgcagggcacccgttttcagcagtgaagccaggaataattttctatctcatgctacctaactcctggaagttatcatgagacccttgcaggtggataaacacagtctggagaggaatatttctccatttgtattgggacagcatacctaaatctgggatgttcagagataatctgggcctctgcttgttagggagaggaagaggacattcccaagaccttagcatggattggcatagaaaccagagagttccacatgcatacacctgtctcagatcagggtttctcagtgtggtctgctgacctcgcacattagactcaccttaagcactgattaaaaatgggattccttccctgccttgagcctagttaaatgaatgaggtagtttttaaaaatgcagatgtagaaaaatctacaggttatgctaaacaaaaaaaaaagaagaagaagaaaaaaaaagcaagctgcaaaactggatacgatctaattcctttggggtagaaatgttgagaaggacatatgccctggtattataatattttttttctagaagaatacattaaaatctgtgaccagttatttgtgggaagaaatacttgggggtaggggagagacagttctggtttttatttcagctttttctgttctatttgcattttaaacacgaacatgtgttactttcgtgctttcaaatgtcagcagggattatccgggcatggggattacatgccagtttcttttctctatgtgctttttgtattatgaaaatcaatttttaaaaattcactgggcgtggtggctcatgtctgtaatcccagcactttgggaggccgaggaggccgaggtgggtggatcacctgaggtcaggagtttgaaaccagcctggccaacatggtctctactaaaaatacaaaaattagctgggcatggtggcgggtgcctgtagtcccagctacttgggaggctgagacaggagaattgcttgaacccgggaggcagaggttgcagtgagccaagaccacaccatggcac

SEQ ID NO: 88015 - DNA, 1030 bp, Homo sapiens
ccctaggagggagcactccagtcagaaggagcatccgggtcacagggagcattcgtgagaaggccctggagcttgtaggtgcttggtgtatttgagggacagtcaagaggctggtgtccagcaagtgttccagcgggcagggaccactagcactttcagatctcaattagagtatgacaggaatccatcaggaggttttattcaggggagttccatgagctgacacacattctaaagtattgtttgggtggctatgtggagaagagattctgggagctggcggacaagggtggaatccagatcagcagtttggaggatgcgtttgtagtgggggaggatagcttgagctgcagaaagagtggcggagttgaatgttgagctgatgggatttgcggataggtaaggactctgagagaaggagaaaggaggaggaggattcttagcctttgggattgagtgatttacagggagtggctggagaaaaacaagtttgggttggaagaacaaaagttctgtgtctgagatgcctctgaatactcaagtggtaacgtcaagtaggcagatggattcatgactttggagttcatggaagacattggggttggagatataaatttgggaatgacgaaagtcatgagattggttgagattgcccaggggagcctgtgtaggcaggagagcgaagagcactgaggaccgagcaccagggtcctccatttggaaatcgggaagtggaacagaatccagcagagggaactgagcagaggtgttgccagtgaggatgcaggaatactgggggagaaaggtttcttggaagccaaatgagggatgttcaaaaagaggggaattgactagacatgtgaaagaaatgctgaaaggatgagcaagctgagatctgagatgggagcactggattgggccacatgggcaccagtggtgaccccgacaaaagcagtctcagtagaatggtggagatgcatcatggcagtaggtttctctccaattacattcaactctttggcgacaagtg

SEQ ID NO: 88016 - DNA, 1053 bp, Homo sapiens
atgcacagtatgttcgtcctaatatctgtggaatagttattcagtactgactcatacgactctgggaagaattttctagctcttgagacatctcaaatcacaaaaacagaaaaatgtgtgtttctttttgttgttttgtttttagaaataatgacttgagtgtgagagaaatggaatttccaaggcaggatgggagcagtggggaaaatatcacttcgaaattctcattgaaaacaattgagaagtggggaagagtacttttcttcacaagcacattcacacttagggtttaggtttgtatttagttaggactgagagaacaaatagaagcagagatctgctgaggagagatggcactttaataagcaattttttttttcgtttctaaatttgctggagtccaggcaagcatgtacacaaatagccacaatttgtaaattgttcctgacatattttctgctctttgaattccctgaatgcctgcaatataattagaaataagcaatcttttatatcagtaataggaaaaaggacatggtttcagaatgcaaataagatgttacctaaacagaaaattatagcatggctgcgactgttctcgttatgacggaagacgggaaactgttgaaagcaataagaactgtgcagtgttgcattctgacatttgtctctgcctttcaaagccacctactgcatacacaggcacaagaaagatgatgcagatgaaaggggaagaaggcagagccctcgggagaagtgctcctcatctttgcggctgtttccttagtgtggttgagcccattggcttgaaaacggagtttcgatgcactttctctgtcctgttgcatagcccctttctgatacagactggaggaggtagacttttccaggggtccagctttccactgcggttgatagccagttgatccattccttcattcattatctgatccatttattcattcactcactcatctgatgggtgtgtgattcgtgctatcctgaactctgggatgacatcagtgtacccaaaaagacaaagctcctgccctc

SEQ ID NO: 88017 - DNA, 1702 bp, Homo sapiens
actggggtcctctcagttcaggccttcatcatctctgccatgaattactacaggagctcccaaattggtttccatgcttcctggtcctttccaaatttctgttgttggagtgctctcactcacccttgaggacttttctgtttttctgtttgtttttttttttttttttttgagacagagtcttactctgtcgcccagcctggagtgcagtggcatgatcttggctcactgcaacctccacctcctggattcatgtgattctcctgcctcagcctcccgagtagctgggattataggtgcccgccaccacgcccagctaatttttgtatttttagtagagatggggtttctccatgttggtcaggctggtcttgaactcctgagacctcaggtgatccgcctgactcggcctccccaaatgctgggattacaggtgtgagccaccgcacctggctgtgaggacttttcttaagcgtcatttcccatgtccctttccctcactccctggtacaggcaaaattgagcattttctcatctgtgtttctcttcctacttctgtcattacaatgaacaaatgtgttataaatattattaaaaatagatgtgcatccccctctgtgaactctttgaggaagaacagccttggtctttcttcatctttcggtacgctgttggggtacagcactaacaaatgtttactgagtgaataaaggattaatgtaggccgggtgcagtgactcatgcctgtaatcccagcactttcggaggctgaggcgggcagatcacttgaggtcaagagttcaagaccagccttgccaacatggtgaaaccctgtctctactaaaaatagaaaaattagccgggtgtggtggcaggcatctgtaatcccagttactcaggaggttgaggcacgagaatcacttgaacctgggaggtggaggttgcagtgagccaagattgcaccactgaactccagcctgggtgacagagcgagactctgtctcaaaaaaaaaaaaaaaaaaaaaaaaaaaggattaatgtgaacaatccccaaatgttctctttttggttttagattacgttatacatttttgaaaatttgttgtaaaaatcctatctattacaaaaatcatataaccagaatgccgttttcatagtaatataaaataacttaaattccctgaagactattgagtttaagatactgaatcatacatatgcacaccaaaaaaaaagattaaaaataatctttaatagggccttgggattatgtgcactttattaagcgctaattctttcaaaattggccatttgtgtatgatctatattagcaattttcatttaactacagtatttggttaaataaaatacccctttccaactattcttcacagagaaggagtttattgaacattctcaactagagttttgctgaaagtaatggaattttctttccttgaactcaaagaatagaaaatagaaaattgaaaaagagaaaaatagagaactcactatggatggtggagaactggcagctcagatgtttgcttccctttagggtaagggtggcagaggctcttcttgatataaacagcatgtttagagggtcttcattccatttagtgggatttttttttttttttgagacagagtttttgctcttgttgcccaggctggaatgcaatggcactatctcagctca

SEQ ID NO: 88018 - DNA, 1041 bp, Homo sapiens
cacctgattttatatgtttgctcagagctcaagagggcagggctctgttgccagtccctgccttccacccacaacccacgcctctaattgtcttaggatttaacactgagccacacactgactatctccaggatgcagtgggccttcgcctcagcaggggcctgtgggtcaatgagcaaagcccttttcctggagtagagacgtccatcacttcccatgcgctccagctcccgcagtccaggcccctgcagtggaattccagctgccgaggccacctcattgccttttggcattcgttttcataaatctaccaggagaaatatttctctctgacttcacttggacacgatttttcagtttaacagcattgctgatattctgatgggtttcctcagcgttgcaacctcctgcaacataatccttctggagggcagcatcgtgtttttttttcgtgttttttttttgttgtttgtttgtttgtttccctctaataggcacaggcatgcaggtgaccttttgaagctcgaattttgtttcagaaaaggaagatgctaaaaacaaggaccctcactgtgctgtcgcctgtgagatgctgaactctgtaattgctgctgtttcatgattagtgtctgctttcccagcacagtgactcggaaacacctgcagcatggatgccgttgtttgttgttgttgcattaataactgcagatgctgttgaagtgctcacccatcaatcattcctagttacttaccactatttcctctgccctggagggcgcgcctgcccccctcacaaatccctttgcccccactctttccctcttgcagtaaggtctccacccagcagtcagtgactgtaaaagtgcaaatcagattgtgtcagagccaagtccaaggacctaaccatagacttccaggatcagggtcctggctgcccctctggactcatttactgtcaccccagcccgcccccttcattcctctttctcttcctcactggcctccttgcagatcctcatacatcctcataatcctgcatcc

SEQ ID NO: 88019 - DNA, 1061 bp, Homo sapiens
ataattctgagtttcccttatttgcaaggcaagatccactctataatagttctgtaatggtgctggaaaaaggccttgggactgagtgttcctcctgggcagaggggtacccactggaagaaaccagaggggtacccactggttgttaagctaattgtacacctggtttacctccaccagctgcatgttaagcctattgtttcccttgctggttttcaaagtatgtccggttattctatctatagatatttgctcttggcatgctggtatggaccagccatctctttgttgatttgtttattcatttattcttcgcttagcaactgcattcatttcctatggagtagtttgctgttaacaaattactacaaacttggaagacttaaaaccgtagagatttattttctcagggagaccatcggtctgaaatcatggcgtcagtagggccacccatgctccctctgaaggctcaaggagagaatccttacttgcctcttcctagtgtctggtagccccagctatttttagcattccttggcttgtagccgcatcactccagtctctgcttttgatgtcgcctggcctctgtgtgtcctctcctcttccttttttttttttcctttttattttttttggagacagagcttcgctcttattacccaggctggagtgcaatggcatgatctcggatcaccacaacctccacctcccaggtttaagcgattatcctgcctcagcctccggagtagctgggattacaggcgtgtgccaccacgcctggctaattttgtatttttagtagagacggggttttaccatgttggccaggctggtctcgaactctcgacctcaggtaatccacccgcctcggcctttcaaagtgctgggattacaggtgtgagccactgtgcccggcctctcctcttcttataaggataccatcactggctttgaggcccaccccaatccaagatggccttatctttatgacctctgcaaagaccctgtttcctgttccccagggaggccctagctgtgtctttatctcagggccccatgca

SEQ ID NO: 88020 - DNA, 1130 bp, Homo sapiens
tcccccgagatggagtctcgctctgtcgtccaggctggagtatagtggcacgatctcgtctcactgcaagctctgcctcccgggttcatgccattcttctgcctcagcctcccgagtagctgggactacaggtgcccgccaccgtgcctggctaactttttgtatttttggtagagacagggtttcaccatgttagccaggatggtcttgatctcctgatctcaggtgatccacccacctcggcctcccaaagtgctgggattacaggcgtgagtcaccacgcatcaccacacccagcctttttttttctttcaattattttaaattcatggtaggttgaatctgtgggttccgactcagagggccaactgtatgtggatttctttttctttggcaactgcatattttaactttctgatgctgatattcagaatttttgacatttaaaaattaccgttgtcaatgggaactggagatgtttgaagaatatagaacagaagattattctgttgcatgcagactgagatacagagtctatcagataccctggttctctgataaaagaagtatcttgatttctggagaactagcagataaccccaccatgccacagagggtcttcatgtcaagttcatggtccgcaacctcagaggagccttgggcgagtcctcagacctctaacatacacttgctgtgctctcatttgtttcccacggtgattagtccaaatctctacctctctccccctaccccctacttcatccttatcctttaggcctttccttctcaacagatgatgtcatctcttatttcactgagcaaactgggtatcccaggaggagactccatccacttcctgcccccttgccaaaaatgtatcttgatttttccttcctctttacttcctggctgcctgccttcaaggaagtcaggtccctccctttctccaggattaatttctccagctcattcttgattttgtccctgtctctccagggagcttgcctccatgattagcttcatcctttgttccacttatgacagtgtccgctgtgtcgacttctttcattcagcttataaagatgcccaaggcttcccatttaaaaaaattaaaaaaggatttttttttt

SEQ ID NO: 88021 - DNA, 3025 bp, Homo sapiens
agacaaggtttcatcatgttggcctggctggtctcggactcctgacctcaggagatccacccgcctcggcctcccaaagtgctgggattacaggcgtgagccaccacgcctagccagctcagtgctcttacattacaggtaaggacaatgagtcctgtagaggagagataataagcaccagatggcccacgaatctcgtaagttcagctcgttaggttgcaccctggtctttttgttctgcccctggcaggtaacagtgccgatgaggtgaggtctttggatcccattagtttcattctgttccttggccacctatagcacctaacccctcacctcatcagagaccttcctgctgtaggtagctggtggtcacagaggagatggagtctgttcagatgaatcagctcaagaatgtcttctggagaaaacaacgcagctccttcactcattaatcctgacctactgataataactcagttggacacttagcatgttagatatttacatcacagtggttcctgcccacttttattttgtacacagcccaataaagagcagccagtggatttccatgacgtccacatgtcacaagggccctagttaaattgtcaggcaaatgaaatttttttcttggaatgtctcctccctcctcttgtccatctttttccatttctagacatttcagtgtcttgcatgctgcttgctggctgtgtatatctcccctgttagctgctctgttgagaagtggtcatgctctttgtccctcacatgctccaggtgttcccaaatcccccctcacttcttccctctagtgattttccccaactcgcagtttcctcccaactccatttaggtaggagcattttgccgcgagataaatcccagagagcagggatccagccttccttgcctttgaatccacagcccagacacagtgcttggcgcctgacagatgcttagcaaatgctgggaaagcagaatgatttcagggcccaaccccggaagtggagaagagagaagtggagaagagagtgtgtgttaaccacgtgtgtgcatcttgagttggcaggtgatgggaaacagctgtgtttgttatgaactggcattggtatctcaatggaatgtggacctattcttcccccgctgggtgtccttttaccaagcggtggaccacttcctatctggtcactgaagatagagtggtcatcccccagtaaatcatgacgtttgtactggtccattcctttctgttaccctctccaacttccttttaatttgcaaatgttttcagaagtgtatgaattgcatcacagtcttaattaaagtctccctatgtgtgtggaacgtgtgggtattcctagcttgagcttgagtctgctagagggattcagccctgtctgggcatgtttggtcaatgagttgggtgggcttgccatgaattgaggtgcggagggagatggggaagccttttgggagagtccttgcctggtaaagaggaatagggtatatatggacccaggaatgtggcttcagtggccagaggaaggctgggatgtatctctcgaacttggccactggtgcagttttgactgttgggttcctgcccaagtactaaggccaggatggttggggggcaggggaagagagggtttgtgaaacagaaggaggatgtaggcctggtggtcctacagtgacatcctggaaaagtggcagcagtgcccagctgctgccatggtaacagctgggtgtggctgcctcccattcagaagaggaccataatagacatggaagggaccgcgtgcaatggactttgatgaactcctgggactggccctgaggactcccagctgtgctcattggaggaaccgtgtaagagcctgcccgagccagtgtggcaagagttagggctgtatggtttcatttatgcttaaggtgatcaaatagtggtttaaggtctcttttttccctcttgacagaaggtttcaagtttgtgtgtttgtgtgtacagatatatgtgtgtgcatgtgtaacgtgcctgtgtgtgcgcgcatttcactgctgtgagggcagctcacaatgtcgtgtcttggaggtgaatgcagtgctgagattaatggagtgctcaaatgcagtgaactccagcatttgctcattaattgagcagaagttctctttgttccaaaagatggagcagctccacacacaatcccttcttgtaaaacaaaaggccagatctcctttgtgtactcgagtattactgggtacggccagacgtgtggatgtgtgtttcagtagatggcaccagactttggcatatggttgtgtgggtgtaggtggctggtttctatttacatgaaaagaaagcgaaggttccctaaaaatgtctacttagcagacttttgaaaaaatggattcggggacatttcacttcatagcagtcacaaaggtgtgaatataggagctactggatgtgagctgctccaggctgacgaggcgtgggaccatctgggcccctggtttgtggttattgtcagactggctcggctttcgcccactgccaggattcccaaggtgctagcatatgagctaaacacccgatgacaggtagcaggggaaaggctggagaaaggccagcacggttgggattgggagtgggatgtctcacttgtatccacatgattttaatttatggaggtgaggatgtatgagttgcatttcccaagagaagggggcacactgccatgtcatgccaggcccacgttgtaccacacaggccacaggaaagcaccaggaagcagaagagtgaggggaaagccgggactagagcctttgttgggattttctcaggaaaagcgaggcagggcagggtaacaattaggtaaagcattaaaacgagctagtttgaacaattctggtgggctacaggggtgtccctagttgactggtacctgggcctgggtggatggtgggcgagagaaatagtgtcccggtgtgagcatttgataaggaggtggttggctagcac

SEQ ID NO: 88022 - DNA, 1050 bp, Homo sapiens
gaaattcattgtgaccacgtttgtgcttgtccacccggctctccgaaagtgaattccagccagagcctgtggtcctagcagggcactggggttaaccagagcatcagagatgcagctgtggtggccgtgctgcccgaccaccctggcagctctgtctccaccccacgcggggtcatcatcacaggcagagggttctggcttctcttcccttgggtttccttctttttttcttttttttttttttttgacggactctccctctgtcgcccagtctggagtgcggtggcacgatctcggctcactgcaagctccacctcccgggttctcgccattctcctgcctcagccccccgagtagctgggactacaggcgcccgccaccacgcccggttcccttgggttttcaattcctcaccttctctttacttctgggaagcagatcaatttctcagctccccacatgctaggtatcatcaaaagcccctctacgctattcatcgttgttgctgtggtccaagttctctccctttctcttccctgtctctttcttcacctttatgatcatggtaaagtggtttgcttggttatttctgtttttttgtttttccaaatggcttacccatttcctattctatagctttattattattattattatcagcaagagtgggcagagactgtctttcggcacactcttctatgccccaacttttcaagatcatgctgtggcacattaacaaatgtataaccatgctccagaatgaatcacgtggagaggcaaattttattaaaccaggtttggaggtccgaattgggttatgagcgtgatttatttttattttattttattttttgagacagagtctcactgggtcacccaggctggagtgcagtggtgcaatcttggctcactgcaacctcagcctcccctgttcaagcagttctcctgcctcagcctcctgagtagttgggattatgggtacataccaccacgcccagctaatttttgtatttttagtagagatggggtttcaccatgttggccaggctg

SEQ ID NO: 88023 - DNA, 2137 bp, Homo sapiens
tccacttgcctcagcctcccaaagtgctggaactacaagtgtgagccactgtgcccggccccgagagttctttttctgtattctgcatagaggacctttgtcagatatgtgatttgcatttctttttctcccagtccctggcttgcctttccctcttcttaacagtgcctttggagatcgaaagtttttaatcttgatgaactgccaatttatcagtttttctttttttttgttttatgaattgtgcttttggtgttacgtctaagaattttttgcataacttaagtttgcaaaggttttctcctattttttttttctaaaagttttacgttttacatttaagtctactatctatttgaagtttcaaaaaaatatggtgtcaggtagagttcaaggttgagtttttttttttcatatggatgttaaattgtcccagcagcatttattgaaaagactgtattttctccattgaattaacctttcgcttttgtaaaaagttcgtgagccatatttgtttggttctgtttttggacccttcattctgattcattggtttttgtgcgtatcctttctcctttcacattttagaatcagcttgccaatatctacaaaaaatcctaatggcaccaggcgtggtggctcacgcctgtaatcccagcactttgggaggctgagtcgggtggatcgtttgaggtcaggagtttgagaccagcctggccaacatggtgaaaccccatctttactaaaaatacaaaacttagctgggtttggtggtgcgcgcctgtaatcccagctacttaggaggctgaggctagataatcgcttgaacccgggaggcggaggttgcagtgagcagagattgcacccctgcactctggcttgggcgacaaagcaagactccatctcagaaaaacaaatcccaatgggattttgactggggttgcactgaatccataaaccaatttggaggaaattgacatcttaataaatatagagttttccattttatgaacatggtatattctccaaagtctttgatttcctttatcagtgttttgtggtcttcatcatacatactctaccgttggttagatttatacctctaagtgttttatggtactattttaaattatactgtattttaaatttctaattgctcattgctagtatatagaaatataattgactttgtatgtgctagccctgtatcctccaacctcactaaactcatttattggttctaagaattttttggtagattccttggaattttctgtcatgtctatgaatagtgacagttttatatcttcctttcaatctgtatgctattaatttcattttcttacctgattgtactggctaagacttgcagtataatgttgaagggaggagtaagagcagacagtcttgccttatttctgatgttaggggaaaatcattgagtgtttcacattgagtgtgatgttacctgtaggttttcggtagatgaacggtatgcatatttgaaaagccaccactgtcctgaaagatgtcacaatatagaaatggtatagatttggagttcagagaataagttctggagtcagacttactgggtttgaattctgactcgactccttagcggctgctagatgttggagttttgggaagataggctaagcgaatacatgtaaaatgcttagaatggtgcctagtatattgtatgctctcaatgaatgttagttgttattctgtttggacaacagtaaaaatagccaaagagctcatggagcctggatgtaggaattttttggcccagaccgtggggattttgatgcccatattggaaactttggagaatgttttggttcaggtgtggattcttattgagtcattgagcacatttgggtccgaacactctctgaatcagggatatggaggaatccataccaaaagaacaggttgtttcatagaaacagggaggggaacatcacacaccggggcctgtggggggtggggggtaggggagggataacattaggagaaatacctaatgtaggtgacgggttgatgggtgcagcaaaccaccatggcatgtgtatacctatgtaacaaaactgcatgttctgcacatgtaacccagaacttaaagtataat

SEQ ID NO: 88024 - DNA, 1013 bp, Homo sapiens
caaagtgctgggattacaggcatgagctgcggcgcctggccgaaattttaaaaaatctgtgtaaaactttcagacctctaagaatgtatccttgtgtcctcactggagaagccctattttaagtgaatgagattgagtttgtgggtttaagctaaagcaattgtttctagtctggatccatggagagctgcagggaattcctggggttcctcatattacacacaacattttgtatgtctgtgcatatgtactgcaataaatggcaaaatagccacaaatttccccgtcagcatccgtacctgacaatgtgacattgcaggtcctcccaacaaaaagtaccattgattcatccaacccttcaatgtggatacccatttacttgctttggccactgggatgatgctttggcctctgtgatgtagagacttgaaaagcatttgacattggatgctgaggttagcgtacgaatgagctccatctagtctgctggaagatgacaggccccaccaagaagaatcagtgttttccagtcaactcctggccaactgcctgctggctgccaggtgcatgtgccatcttagaccatccagcccctcgatgagccaccagctgacctcagatgcaccagtgagcccaggtggatgagcagccatgcccagttgaccatagaacaataataaccggctgtttttttaaaccactaagttttggggtgttttgctacctagcaatagttgtgcgatacatacacatttttaggaaagagaaattgtggcttttgatggatttttgaaggcatctaatatcctccaaaaggataacataggtcagaaaaactttattgataaacaccagctggaggttctcagtctgttgagaagccagaaaaagctcagagtggattatatgggtgcattttaataaagtctgggactaagtctaggattagattaagagtgttggataatcatcgaggattagaaaagaaatacttcattatacttcggttactt

SEQ ID NO: 88025 - DNA, 1027 bp, Homo sapiens
caggttggtcttgagctcctggactcaagcagttcttccacctgggcctctcaaagtgctggattacaggcatgaggcactgtgcccgtatctagtttttgatagttactcagctgattgatttctaacaggacagatctgatgggttaattgcaccgggatagggagtgagaactgaatgttcccagcaacatattcctccccagacatgctgggtcgaggttaactgatcatctcattataaactgaaaggacttcaggacggggtagtgtgagactctggctctgcaggaggctgaggccccaggagacatgaagttgatttaggtgcattctgtgtttatatgagagggagtgggctctgcagaggatgggttaagggaactagttgaaggctggggtggccaaagtaagcaactcagatatgtgagggtgtgtggtgcgttcacatctgatttatttacgattgccaaggcacagcagggggcactgctaagagaatttgcactgaggcttgggtgtgactgccctccatcaaatcgctgggcctctgcgtctcagattcctgatttaggagtcattggtgacaatgcctactttcctcctcatctcctctgatgccctgctgtctcctttcattatcccctcattggtcctgaaaccatgtggatgtgatcctttacagcaagtgtgtccaatcttttggcttccctgggccacacataaaatacaggaacaaatactaacgatagctgatgagctaaaaaaaaaaaatcacaaaacctcataatgttttaagaaagtttatgaatttttattgtgttacattcaaagccgtcctgggccacctgctgcccgtgggccgtgggttgaacaagcttgctttagagggagggctggcaaagtacagcctgagggccaagtcagctgcacctgttcatttatgaactgtggaatcccctgcagctgcttttgcaacacagcagcagaaatgagtagctgtgatggttgtgattgaacacagaaa

SEQ ID NO: 88026 - DNA, 1097 bp, Homo sapiens
gatgcctgcaagtgcgcatttaggtgatgggaatgcatgccatgaactctctctttcttgccatatgctctcttggttttctagggcagctggtgaatactgttctatgcatttgtatgcccatgtgtgttagctgtgtacacagtccttgctcattgaggctgcaggaaaaatatctgtggctttgcagtcagtggcacagagcatttcaagcgtgtctgctctctggcttttgaccagggttcagaaacccacctctgttgtcgatatatattcccggaggaccccgtgggtctggcacgaacacgcgcgcacacacacacgcactgcgtgggctggcttgctgaggggaactccttaagcacggaatggttcttgttcttggtctaagagtggtggggagtcttgagtgcagataggcttggttggaaccttctaggacttagatttccttctccgtgggtagaacaccttttcatttgttaggccataaagttgtaactggatacctgtcctctcttgctgtctcttgagctcagccacatgtttatgaaaaatgcccagaagccaccgtggaagcatattgaaccagtcgatagccgagggtggcaaagatgattatgagtatggaaggggaaagaggctgggagcggtggctcacgttggtaatcccagcactttgggaggcagagctgggcaggaattcatgaccagcctggccaacatggtgaaaccccgtctgtactaaaaatacaaaagttagccgggcatggtggtgcctgcttgtaatcccagctacttgagtagggctgaggcacaagaattgcttgaacccaggaggcagaggttgtagtgagccgagattgcaccactacactccagcctgggtgacagagcaagactatgtcttaaaaaaaaaaagaaagaaagaaagagtaagggaactgagtatgcatctaatcttcactggatcccttcttcttggcaaaggtgactgggaccgtgtctgtcttgcttataaccgtacccctagctgggtgctccatagagcaggtcctggtcatgcctgcgtggtccatctcctctgggattgatcg

SEQ ID NO: 88027 - DNA, 1023 bp, Homo sapiens
gcaactaccttgggtcagaaagacaaaggctgccctcttgggcaaagcagtgagccaaaaaggagtctagatccctgctgactccatgaacctattttcccagccatggtctctagatttcttctacagaagaggggtctttcttgttttttgttttttcttttttttgagaactggcaatgaagacgcttatacagtcttagtctccttttcaaccttggaagcagatctgcagcaataatagtaacaagcaggagcaatgggggtactataatgaccatcttttatgatgactggcgtattaatacaaatcacatttttttgagtccattcatgctatggatgttttcttatgcataaacatagagtagacacgtactgaatagatcacatctgttaagtctcttgccacaagcatcacaacttttcagagctgtctcttctgtgaaaatccatttaatgtagcaagttgattttctttgtggttcatccccatgcctgagacttgcagtaatgtaaaaccagtttaccatcactgccaaaacactcagagagagttccaacttcttggtctggggaaggagcaaaggactgattcacataaataaacaactgttctgaggccacaagtttaagaaactttttgatgaagtcaatgagtccttggatggttcatgttcgctctactgcccacttctttgttttcataataggagtatctcccacagcctttagcaaaatgtcaatttttttcttggtgtcgccagcaggttcctctgttcccggagaaactgcagtggaagacgggggctccagagtggttgtttctggggagacctccgtaagtccttcccctccagtagcacttgagggaggaagctgcaacatggactgcggctcctccaccatcttgcttggagagactccggggtctttcttgttttagccactatgtttcaggtctcaattattctcagtcaaatctaatcctcatagatatggatcaccaaaagcagagaagca

SEQ ID NO: 88028 - DNA, 1001 bp, Homo sapiens
agacatcggggcgcagaagacagtcgcttgggggacttggccagcggcttttgggcacggcctatgcagtggttttttctctccaaacctagacaaactgtcctttctgtcccgaggtgggggacggggacggatcctagatcgttcagcgtctagggagagaagcccctctttctccgctctgcgcccgccgcctgcctctggcaggctcggatctccgggtgcgctcccgcaggagccccagctggcatctcacggcctcgctcccctcgcgccaggtctcttttgtagggggctgggagagaagttgtcacccgtcgcagctacctgaaatctcgggctaaagggcacacgccacgcacacgggcatgaggctgcgaggacacgtccgttccagcacactctacccacagcccccttactcaggcaagggtacccgttgtcgttcattcctactacaatcaccccaaaaggcacaagagcggagaatcacgcaccgggacctaagctcaggcactcggatgggcacaccaccatcagcgcagatgcacacaggtgcccaagtgcgcttctcgctccctccatctctcttatcacacacacacacacacacacacacacacacacacacacacccctcacctttgcttttccgctgcaatccgctagctccggtctccgacacccagcggctgtccccgagccagctgggcgccggggcgcgcagcagcttggctagcgcctggcgccggacgtttggggttcctggctcctcgaccctcttgtgccggctcccgctagcccctcgcacgtagagagctcccctcgcccgcagacccccggcgccaagcctcagactggggctctgggcgctggtggtcttgcgagcgcgcgcgcatgggtggctgcgccgctgggactggcccagccagcccgggcccctcggcacatttccccacgcccccctcccgctacgtcacagcggcttcgctccgcccccc

SEQ ID NO: 88029 - DNA, 1081 bp, Homo sapiens
cacctcctgggttcaagccattctcctgtctcagcctcccaagtagctgggattacaggcgcccgccaccatgcctgggtaattttttgtatttttagtagagacagggtttcaccatgttggccaggctggtcttgaactcttgacctcaggcaatccacccacctcagcctcccaaagtgtgggattacaggcataagccaccacgcccggcctgtagaattagtcttctctgccttgaaattatttctaccaattcttggtcccttggaatcatttccctaaaactcagcatttattcaaggaccctggaacatcttatgttataataattgtaaagttaggtctaaagcattttcttccaaatctttgcttgtttttgtttaaaaaaaaaaatcacacttcgctaaacatggctgctaggaagccctgagctgaacttacagttgaccttacttttactaatggtgtgggattttcctgcatgcaatttctgccacaactttttctgtagtcttgttttataactatacctctttttatttttgtatggatttatctatccaaaatcttattgaacatatttttctgagccacaggaagtacttttgggagtgaggtggtgtgaatttatacagaacaaaagcagcacattaagaaggacacccacaggtggagcacttagtcactcccaccggccaacagcgcttgcttagggagccggatgaggaaagctcatttaaaaatatggtaacatctatgtgtgagatgctgagtgatgctctcagatgaaacccaaagatgatgacatccttgcagacacccaggtgtgtatttcttcatactctagaaaatgatcagtcaatgaaatggatattgtctcttttcttatcgcttgtaaatgtcagtttggggaacgaaaaaaatgccactttatggtgtgaagtgcctgtctacaatagtccttgcagagcggctcagtgagtccatggcattaaagatatgacagttactatgtatacagtcagtgaggaaggcagcacagcagtatctccgagaggtggggccccaccaacactca

SEQ ID NO: 88030 - DNA, 1013 bp, Homo sapiens
ccgccagccacttccggtaagtggatccagcgcaaagagctgctctggtggtggccaggcttcacattacgggtttatggcgtttgtcttctttcctgatgtaccaaagctctttacccaagatgtgaaaaacaccctggcgacttctgtcatcatttttctaggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgggtgtggcttctggccaacatttggtccttaaatatgggatggagaagggtgagctgcgggagactgaagcctccagagcgtcctctgtctttcactttgggaaaggtaattgtttcaaagaggatggtttcttcttttaggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggtgagctcttagccaagctttttaaattctggttcactcaactgataatttgctcagcgtctaccgtgtgccagccaccatgctaggctctggggatggagcagtgaactggacaaatagaggcccttccttcatcgaggccacagttgagtggtagaagcaggtatcagactcacaaatatgcgaatatccatttagtgtctatattggtcattgctagaaaggcttagtacaagttgccttgggaacattgaatggaagtaactcaccaaggtcagagaaggcttccctggagaagcctttaacctgaaagctgaaggttgagtgggagtcacttagatgaagaaggcaa

SEQ ID NO: 88031 - DNA, 1047 bp, Homo sapiens
ttaaagccagatacttgacaaggattttagatcttaatgggttcgatggtagggaatacggaaaggatacactgctaatattgtgtctaacaataaagcaaacaactcgatgctgtaagaagacaagctgtttgagctttcaaacacacatgcacacagcacaattcagaaatacccaggaggattcctgcaggcttaacagttggcatcgtactgaaatgaaacgtgtattaacaagaaaatgtcaaacttttggggaaacaaattttctgttacttcccacccaactaaaagggaagataaaaccatcatcaccagaacaaaacagattttctccaaacaagtacaatgatagtgccgggttggcagttaactctttcaccctactaaattcaagagctcatctccaccctgtcctgtatattttctacatttctattaagaggctacttggtagtgtcagcgggcatcttttacaccttctagtagctcaagctagtaaaaccttgtacttctctattgcgccgccattaaaagcagcattagtgcattttgtcattcagttcttaatcagttatttaaaagggagctgatcatgggtggctcggtgggaggtggggacccatccacggatgagcctcttgctcttggcaccaacctgagcttttgtttcgatgtttctggttgatttagcctttcgagtgcttgtcatgctcagtgggagaagtccaaacctccaaaacaagaggaaagaatttagtagcacaaacaggcagctctggggcccagcagaagcctcattttttttttttttttttttttgagacagagtctcgttctgtcgcccaggctggagtgcagtggcgcaatctcggctcactgcaagctccgcctcctgggttcacgccattctcctgcctcagcctcctgaatagctgggactataggcacctgccaccaggccagctaattttttgtattttttttagtagagacagggtttcaccatgttagccaggatggtctcgatctcctgacgtgatccgt

SEQ ID NO: 88032 - DNA, 1029 bp, Homo sapiens
gtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaaggtgcctctgctcatctgattctcagccacaccaatctttccagtttcactgat

SEQ ID NO: 88033 - DNA, 1058 bp, Homo sapiens
gaaattaactgccatactacctctcagtatgtagatgttctattgaaagtactctctcctgtgtaacaggagaacaatcagatccaattcagactgtcagtgaagcacactccctaataatagtctctactctttgttatatatttgtatttccagagagaatgtcttttagattcttgtatacccagataacttctgtgtcactattccaccagagtctgcacctcagactttagtaggaaacatggcacagttctgcaagtaaagtaatatgtaatgactttttgtcctacaaacttggtcagtcagcagcttacatgatctcattgacaattccaccttgtagtgtcaacaattaaggtgttgttgaacgctgataaaatgtaagctacctgaactgatgtctaaagcaacaagtattgtgaaattttgggacaaggattaacttgatgcttaaagtaacccccaacagtaactagggggccacattccatcagtgaaactggaaagattggtgtggctgagaatcagatgagcagaggcacctttagaagaaataatgtggtagtatttatttagggagagacagatgtgttgccatgttacttagtcatactagagagccagccaagtttgaataatgaaggtgcagacgtgttgtcttcttcactgacaagctgtctgaacaaggagccaggaactgtcgggtcaccagctgtggagcgtgccggggggacaacctgccattggatgtagagaaaagtgccttagagttggcctgagccctcctgcccactcgccctccgcgcgacgccactcggagtccacacggcacacacaagcggagctgagaagcacgatggctctagtcagaggactttgctgtcggtccagatttgaagaggacacggaacagcatgagcctttgtgacaaaactagaatttggaaatgaggactgtcttgggaaaagggtagacacaggcacttctctccacagcctgctaacctaatgtgggcagaactgaaagatcactgcagtggaaactgttctggaaga

SEQ ID NO: 88034 - DNA, 1043 bp, Homo sapiens
aagtggccattctacattgttatactaggttaggagacgcctttgtagaatacaatttttgtttttgactttgacttcttaagcctctaagtaaatacagttgcagctggctgcaaatcctgctatctgacttcatcagcccggcccattatcatcctttcatgaggtttttatttttttatttttttattctagaaagaggggttgtcccctgctacctgtaggtattggggtatgtgaccatagctccaatggcctcggcaccatcacaagtcttggtttgagtcttgttaatgatggcagctttgtgaacattgcttgttttcattgtttcagataagttatctatatgcatattattggatgtaatttttggtcaaaaaagggatagaactaggattttaagaatcactttaaaatatatatctgtaaacagcattttgtttaatttatacatttttataataaaaatacataataaccacattgcaaaaaagttgaagtgtagaaaaagtcaagcagctataatctttccatcctaatataactactgtgatttcgttctttctttccagtctttattttttttgagacagtctcattccgattgcgtaggctggagtgcggtggtgcaatcttggctcactgccacctcgacctccgaggttcaagtgattcccccacctcagcttcctgagtagctgggactataggcgcgagccaccacgcccagataatttttttgttttgttttgtttttgagatggagtcttactctgtcactaggctggagggcagtggcgtgatctcggctcactgcaaccttcacctcccgggttcaagcgattctcttgcctcagcctccctagtagctgggaccacaggcacacaccaccatgcccagctaatttttgtgtttttagtggagatggggtttcaccttgttggccaggatggtctcgacctcttgacctcgtgatccacctgcctcgggctcccaaagtgctgggattacaggcatgagccaccgcgcctggcctttt

SEQ ID NO: 88035 - DNA, 1027 bp, Homo sapiens
aaatcacaactatctgtacagtggagataatagtatctgcctcttctttcctagatactataaagctaaataatgtgaactgatttgccggattagttatatagagagaaacttcatgtgtgcataaattaatgtgtgcataaatggcttctttcccccattttatttttttattgtttattgttttttgagagggagtttcactcttgttgcccagactggagtgcaatggcgcaatctcggcttgccataacctctgcctcctggattcaagcgattatcctgcctcagcctcccgagtagctgggattacaggcatgtgccaccacaccctgctaattttgtatttttagtaaaggcaaggtttctccatgttggtcaggctggtcttgaattcctgacctcaggtgatctacctgccttggcctcccaaagtgctgggattccaggcgtgagctaccgtgcccagcctgttttagtaggtattattatctccacttctcagatggaaaacttggcacacagaaaaatagtcacttgtccaaagaacacagctagtaagaggcagaggaggaacggagccccagggtgtggttgttgggctgcacgctcctgaccatggtgtgtgctctcccagaagatagaacagaggttctgcgagactttgctaaatatatccaggagcagctagagcctagtcttctctttttttttctttttttttttttttgagacagagtttcgctctgtcacctaggctggagtgcagtggcatgatctcagctcactgcaacctccacctcccaggttcaagtgattctcctgcctcagcctcctgagtagctgggattacaggcacccgccagctcgcccagcaaatttttgtatttttagtagaaatgggtttcacgatgttggccaggctggtctcaaactcctgaccttaggtgatccatccgccttggccttccaaagtgctgggattataggcgtgagccaccgcgcccagccctagttttgttttgag

SEQ ID NO: 88036 - DNA, 1051 bp, Homo sapiens
aaggtgactctccggggtccaggtctcccgcccctccatcttttttcccccctgtcttttcctatttggaacgaagtgtgatcggtcccggaagagagacggtggccctaaagctttcctgtcctaaatttaggagggtggggggatgggataaacgtctcatcttggagagggagcccccaaaggcttttgtgagggcaccgggcggggagctgccggctccccaaggtcagaaagaaaggttgggcttaaccccgcagcagggaaagattcggttagaccgaagaacttgtgccctgaacggttgtgaacacagaagggcagatgaccaaggcgggttatggatcttctcttgactgtggcattaagaacaagctggattctaaactgtttggattgcggggccgtttgactccgaaggcgggaggaaagattttatcgcgatgcactcgctaccttcccgagggagcctggcctcgggacgcgggtcttaaattaggggttctgtgcttgacatgtactactagagtccggactaagttgggatttcttaatttttttctctctcttaatttcctctgcaagaatgtgtggaggagaaagttgggaaaggttacctcagaatgctcttcctgttacggtctttccacaaggatccttctctgaaataattatttcatgtgattgaagttctcaaaagtattctgagtttatttggtcccatagtgaaaacctagggttccccaagctgctgcattggattattgatttgggtcatgtagcaggtggagcataaagcctctccttgtatagaaaagaagagtggactaaatttgaaattgggggcccaattacagacatgccatcggaattaggagcaagatctttagatacagtgaatctgacccgactgccatattattctttcccaaacccagtttatacttacgatattctcttggggtgtctcacatatctgaaaaaaaatctaaatatttcctacaaataaaaattctactgtacataactaatctgaatgcatttatactgg

SEQ ID NO: 88037 - DNA, 1027 bp, Homo sapiens
ggcctaagttttttattctttaccattctgtccttgaataacgtgtttaagggtttttaaacaattttttatactcatataatgactagttgacttgctgtaaccgtaagtagcaaacatctagcttgttccaaatgaatttaaaagatacaacacataagtaaaatattggtatgtacaaactatgtgcttctcataatctcacatttacctttttcaggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagt

SEQ ID NO: 88038 - DNA, 1064 bp, Homo sapiens
acatctttagaaatctgaatttacaaaaagtcatgccattcactttttctgtttttgtgtcaaagaccaggccattatgccagtaagtacagtaagactcaactgataggagttattaaaaactaacctatggtcaggagaagatgctcaatggtcttactatgggattctgtttcccaagttccacagtaagcctgctgtcatcctaagcagggtatgagtgaggtgcagaagtagcctgtggcaggcaggtttatttcttttgatcctgtaagtgaacgagctactaaaaatacaacaggtttggaggcagattggcaggaacgagttatccataaaacgggagcaaaatgtacataaaaccaaaagctcgagtctatgggaaatccacgatcattatactttgctcagctcctaccaacaggtctgggttgcacgtggcagctcctctgtatatggcttcagctgccgctatcaactggcaattaactcaaatggctttctttagcatgacagctgcttccctgtatggcttatttaaatctaagaatatactctgtaccttatgtgtggagtattatggggcagtagatggaataaaataggcttatcctggggaggtaaggtagtaacacaaaaatttaacggtattaccatcttttaatgccatcatgaaaggccaataccaagcaacttaatccactgggaaagggggggtagtggctgtgctgagccttttggaataatggagaagagcaatgggatgtgtgaggaagaactggccccccaccttggtaaaaagacaggtgcctggcctgcctggagctggagtccccagtcagggcagtctaaaagaatggagcccaggagtcgggttttggggggttgaatgccagttcaaaccaatgggggctgctatgtgatgaacagcacagagctacgtaggcaaatcactctacctcaagcccgttttctttttggaaaatgagcaggatagcacctacgccacaggactgtttgaaactaaaaggagaaaacacatgtaaaaaaccttgcatggcact

SEQ ID NO: 88039 - DNA, 1075 bp, Homo sapiens
gtgcctgcctgcactcaccttcatgtaactcgggttgagtaaaagattcatcttgggactaagggaagtggagagagagacgattacagcccagctctcgccctcccatcttctgctcattaacatgctctgcgccagcctgctgcagatttcatatttcagaaccctgtagggaagttgccctcccttagccagggcgtgagggagaattacagaggactggggagaaatgggcattaagtgtttcttctcttattactagaacagtttgtgaaaagatcgacacctatccccagcatgaatacacattaagaggatgggttagagttctgagattgccagggtcaggcagtggtgccaggaaaatactggagcggatgcttgccagatgcttcattttccactaaggaccagcgaaggtatggaaagatctagaactagaaggccaggcctagcactctggtgggagttggtaactgagggatcatacttactgagcaaattggcacttgggtccctcggggcagaagccaactaaatagttgagacacattattctggggacatggcggtatttacacagaggacctgctgagcaaagagaaagtgatgagaaggatccgcttcagcaagaggggaaaacacacatgaaaaagctccctaggaagggtgtggatggtcataggggcttcacttaataggggtggataaatcttcccatcctttctgtaccaccctaaagcatccacttctagccatgagacagggatggggaaaaggaaccttggaatgtgctggagcaggtgtcagctggcaagttctgaaatagagttggaaatgtcactgacatgctgtgtcctggaggactgcatggatatgaaccacactttgttgccttttatttatttaagtatgggaggtacagctgagaaaaagctgacctggccgggtggggtggctcacacctgtaatcccagcatttgggaggccaaggtgggtggatcacttcagcccaggagttcgagaccagcctgggccacatggtgagaccctgtctctactaaaaatacaaaaa

SEQ ID NO: 88040 - DNA, 1073 bp, Homo sapiens
atccaccctttttagactgcagcaaggattaggcatactttccatcttcaaaaagctggtgactcccagaataaaggccagtgtcttctgtgtttgtgaggggcaaggtcaatctggtttggggacacagaagtgatcacaaagagaaactgcttctacagagagtgctgggattttcaggtgactgcagcaacaaggagtgttccttcctccatgtgaagccagctttcaagtcccaggactgtccttggtatgaccaaggtttctgcaaggacggtgaggccttggaagccagggagccctaggggctgtggggatcagggtgggagctctcagcaggggaggggccattttcctgatgaggctgtgccttggagaaaccccaaatagaaggcctttctgtagttctcctccagctctgctgtgacacacaaaacacagcctggtgtggggccataacaggcttgaggcagactgacttgggttcaaatcctaccttcagcatgtatcagctgcatgcctttctccaagttactgaaccacacaggaagctcttgacacagggtcaggcccataggagacgcttagttcatgtgtgctctcttccgcattccacttacccacctggggggtcctgagtgttgcttaagcatgtcctacctttcccattgctgccagccaaatttaagaggcagcttaccccagcagggttcccatgccctaagcaacagggtttctccctctcctttgtcttcagataggtttttcttacggagttcttagtgctgttggttttagggatctgggcgggggtgagggctgctgagaagatcagtaggattgtggggttagcttttttctttctatcacccaggttggagtgcagtggtgcgatcttggctcactgcaacctccacctcccaggttcaagcaattctcctgcctcggcctcccaagtagctggggttacaggtgtgtgccaccatgcccagctaatttttgtatttttagtagagacagggtctcaccatgtggcccaggctggtctcgaactcctgggctgaagtgatcca

SEQ ID NO: 88041 - DNA, 1858 bp, Homo sapiens
gcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagcacgcctggtgtctgtctctgctttttgggagggctatttcaggatgggggtggggtctggacccaggtcctagagctgtccaggggggcctgaggtggcttctgtctctctgtccgtgaggacccgcccttcctgcgatgctgtctgcctgggcaggccccttcagagtctggggactcaggtgtccctaactgccatctcttggaagcccttggcacttggtcgcttagctgttctgtgcctccctctcctgctctgtaaaatgggtatcctgccactcttagagggttgaggcacagaaacagtgacatgggctttttgtgggggagggggttggttttttgtttttttttgttttttttttttgttgttgttgttttgttttttttgagatggagtctcactctgtcgcccaggttggagtgcagg

SEQ ID NO: 88042 - DNA, 1027 bp, Homo sapiens
agcaattctcctgcctcagcctctgcagtagctgggattataggtgcatgccaccacgcccggctaatttttttttgtattttagtagaaacagggtttcactgtgttgcccaggccggtcgcgaactcctgaactcaggcaatccacccacctcggcctccccaagagccgggattacaggcgtaaaccactgcacccagccctggccaacccttcttaacaagtccagagcttttccagaagggccttgggttggcagtggcccagggcttccacccctttggagtgactgattgatttctgcggcccggactgtctgtgcgcaggtgtggccaaaaggtgtttgatgttggcctctccctttcactctcccccaccccacgcccctacgtttggattgggttcgaagtgaagaagtcagaagtcagagtggtcagggttgcacttggttagcagtaagtccagccttctgtgttctcattctggttctgcagactcagaggagtttgtccctgtggggggagggaggagtccgtcccttggaggaatggggagctgggttgatgccagagataaggcctgtgggcggagggagaagggttgagcaatctcgccctggaaacagagctgacctgagctctgcgtagctcttctgacctacgtactggaggatttttcccgaccgtgaggaaaagaaccaaattctggagctggggacactttgaggggtcatccggcagagtgtcctgaaggccaactccagccagtgcttctggggtgctctaggaaggccaagcccatgcgtgccctctctcggcagggaactggatggtagtgctggaaggagcccgcatgtggcactggacacagccctttttgcttgagtgcgttgggaaggaaattcagacattagggccgggcacagtggctcacgcctgtaatctcagcacttggggaggccaaggcgggcagatcacttgaggtcaggagtttgagatcagcctggccaatatggtgaaaccccgt

SEQ ID NO: 88043 - DNA, 1064 bp, Homo sapiens
aacggaccaggcatgtcttccacacggcggttcagcgtccccagtcagaaggggcccccggtgtcaagagctgtgctggaccctggaaacagagtggaggacagagctcactctttcccctggtgcccagtgacccctccccccgctccctcctcccgggctccacgctttgattaatgtgtcctcaggttcctcaagccacaaaccctggagcagcgccccctcctctcccacttaggcccagcccacaggcctggcctggccactgcgcctgcttcgttctttctctccctgctaattgcatggcctcctttacttccgtcctggaaggatgcagcctggcaggtgcccctgcctttcgcccagccagagccatcttcccacgcccctgaaccacccctaccctccaggcagcggttctcagagcagggcgcactaaaatgcacgttcccagggtggatgctccgaggggttgatttcctggggctgaggtgggacctggcagtctgcacttagacaaaagcccctggaggccgtgacaaagtggcaccttgagaaacacctgatggagcaggtcacctattcacagccagggccctgcctcccccacctcaccacccaccccctccgcagaacgcccttttgtgtgtaactgcccgcccctcaccccaggaagtcttccttaatctcctgtattgtttctgttgttgttgtttgggctttttttttttttttctggagacagagtctcgctctgtcatccaggctggagtgcagtggtgcaatctcagttcactgcaacctccacctcccgggttcaagcaattctcaagcttcagcctcccaagtagctgggattacaggtgatttctaccacgaccagctaatttttgtatttttagtagagacagggtttggccaggctggtctccaactcctgacctcaagtgatccacctgctgcagtctcccaaagtgctgggattacaggcatgagccactgtgcccaatcgcctcctttaaatgtcctcttcacctcccttcccctcccacccctcatccccc

SEQ ID NO: 88044 - DNA, 1057 bp, Homo sapiens
actatatacaggataatcccaggtgtaaaatgtttaaaaacagaatacattgaccacaaattgtgtaagtttgcatctctaggtaaggaaacgtgaaaggaaagcaaaggcacatgacctcaatattcaggagagaaatcacctggtgccggggaaggggggagatccagggtaggggaaaggtattgttagtgttctaggccttcagctgggaggtaggtgcaggagtgtttattttattcttctgtaaactatacatataattatatttgctcttttgtatgcgtgacatatttcatgattttaaaatgtttttaagtaaacacataaaagcaagaaatatattctgaagtggaatgcacactttacaaggccttttaagatatgacaaagacatcaggaataattttcagcaccttctactgtgccccaggcctgcacttctttgctcttgggggaatttcttgggaatgttggatcagccctgcagggcataacacggcgtattagcaagcaggtacctcggggagtcagtgtggcaagcccttaactgtttttgccttagtgtgagtgagttttcccaggggatcgtggggcctcagtctccgttatcaccgtcattgtctccaccctcccttctcgcctctagcctgcactcctgcactgtctggctgaacagaccgcctcttagcagcctcttgctgctgtggttcagtgcatacatggctgtgtgggtggggcatacacacacacatatgtatgtataaatacattcacccatggcctgctcaacaaggaactccctgggcagatccaagaagcacatttgacaaagtacaatggagagactgtgagggccttggggcctgagagccacagtgaggtgggaagatgttggagtggagaagtggaggaaaggggcaactgcagaacctggaccaaggccagctgtgccctacctgcttccatccacctcaccatataaacttacgtgtatgcatacatacaaccatccttccaccacatatacatgcgtgtatgcttgcaaacatgtaga

SEQ ID NO: 88045 - DNA, 1034 bp, Homo sapiens
ctgaagaccaagccttggagtcagactgacccaggttcaagtccctcccagccacgggaccttgggcaaattacctggctgcacctgctccatctgcctaagggccttaggatactaaacgcaccaggtcacataggtgagcaagtgatcactggtggctttgtctccctgtttctgcagatgatgtgtccccgtatttcaagacagagcctgtgcggacacaggtgcacttggaaggaaaccgcctggtgcttacatgcatggccgagggcagctggccactggagttcaagtggctccacaacaacagggagctgaccaagttctccctggaatacaggtaaactgcccctccccgcccttcctcctggctgccaggaccactgccctgctttgaagagggcatggtgaggagggggtttgtgtgacagtgtggggctcagggctcctagagcctggagttctggaagtgagtggcaaaggcagccctgccccaaggtgagatggctccaccctactgatccctgcagaggatggctgggttgtggaccaggggccagcgctgcctggacaggatggtctgtaccacagtgcataggagcagaggtggtgttgggcacagggactcactaacagcagctgtggctgtggctgtgactgtggccccctgctcactctctcgaacactgccatctccaggggactcttgttgtggggcctgggtccaatggaggggtgggctctgcagcaacctgggatcagtgaaggaggggacatcttctatctatgggaaattcaggtgggacacagagatggccctctcagggcctcttgagcttatcttcacttcctatctgtgcccgtgccatggagctcttgggcctgactggcctttccctgccgggacattgccaggtggggagaaggaagagcagggaaagagaatagggtctcagcaagggtggatctgctgccagcagggaagcagcccctcacccaggccaccctggcctccagcctttcctcgcagccac

SEQ ID NO: 88046 - DNA, 1046 bp, Homo sapiens
ccgccaggcccgtcaagtcccgggagccatgttcacagacgtgtcagctaatgaactaattgattctttcctcctccgcctgcatccgcctgcacaggagagagggcaggtctgaactctgcctccgcctgccctggcaccttcagggaggggagaaaggcggagggggcagctggggtgggtccaggcttcccatctctctctctgcctctcctcaccccccgcccccgacagcactccttcccccaacactttcctgaaaagcctttctggtgtcttttccccagcccctccccagtcccatcttttgagccctggggtctgagtctatgtagggattggcctcatctgagtcccgggttgcacaagcctccttgctctacagcctacctgttccacaccctggccacctcctaacttgtctgatccaacccagtcctgagaggcagaggaggaactgaccccagccgcctcagagaccctctcccaggccccaggcacactgtgaggttggtggaagaatgagaccagaaccagtcctggacagacaggcggggcatcccagggcagccttgcagcgctgggtcaccctcctgagagtagctgatggttgtatcatccagctcagtggggtcttcaattaattggccttaatctggttggaggagcagctggaaatggcggtgctgtcccccaacctcccagtgtgatgtttgtgatccgccttctgaggccccaggcagtggtgggtggggatggggactcctctgtttccggtccctttgcctgcttgcggcagggcatgtttagctcaaacgcaccccttctctcccttcccttgttcttgcacatttcccctcaaccccctcatctctaacccctaccaccggtgtctctcaagtagctcgtgtgtgtgtgcattcatttatttaggaagaaagtctcactgaggtggcgacacaatcactctccacagggtccccctcctgccatgggacccgaaccacatacagtaggggtgggtcagaagcagggcggcaggctcg

SEQ ID NO: 88047 - DNA, 1032 bp, Homo sapiens
tccagccgtgtggcctctgttctgtctcccaagcctgccctgcaaccccttctggaaaaccttggggtgtgcagatctggctgccctcaatgctgcaccccaggtgactccttggctcagtgtcacctcctcagtggggtctggcccacctcccaaactgaacaccgtagcctactcctgacacctgctctcccacccgagaccccttccctggctcagcgttttgctttttttcatgagctccccaggggcagcaatctttgtcttaagggtcccccggtagatcccaaatgcccggatgagggcctggtacatgacaggtgctgaacacacacacacagttgaatgaagaaatgagtgcgtgtgggcctctccctgctctcaggccaggtcccagctaagatatgtgccaatcgcactggttgatcagagtggacgtctcagctgtgcttttctacagctgcctgctagggcctcttctcagcaaggctgtggtggtgaggacaactcctctcttcctccttagagatctggaggatcctgtgaagtcctcttgaccacttgttgtccacaccacttatttggcacttgaatcagtagttgcctcttcttgaggacacatttctcccagggagcatgggacaaagaggccactcatgaaaggggtaggaatgaatgagggaggaagggactgtctcccttgcctgtccagcctcatggtctagcttgaatattggagaccctcaagaagcattggctcttgggccattccaatgcttttccatcttggaagcctggaaaaccacccttctggttcagtcattgactgagctgctccactcagcatgccatgggaagctttccctccgcctgatctgcaccccttctcacccactatgtcaccactcccagaatggagaatatgtttccgtgactaatagagcctgttcccttcccctctccattctcggaactgaaaatctggattctgcgtggatggggtggatagtggctttttctccatggatagag

SEQ ID NO: 88048 - DNA, 1026 bp, Homo sapiens
ggctctacttccccctgccttcctgtattctcatcctttgcaatatgactttgcatcttcccccatcaagagctggagtctatttccctcccatattagcttcctagggctgctgtagcaaattgccataaagcaggtggctgaaacaacagaataagtccaaagtcaagttgttggaagggccatgctctctctgaaggctctaggggagaatccactccagatctctctcctggtgtcaatccttggacttgcttggcttgtagctccatcactccaatctctgcctctgactttgtgtgtctttctcactgtgtctctctgtctctgtgtcttcctctcttcttacaaggatgccggtcattggatttggagcccactctaaatctaggatgtttgcacctggagatccctaattatttacatctgcaaagaccctatttccaaggaaagtcacattctgaggttccagatggacacgcattttttggggacactattcaaactactacaccaccccttgaatctgaactggccatttgtcttgctgtggtcaacagaagctggtagaagtgacaatgtgtccactctaaggccatgaagcctccactcttgaccgtggaacactaagaccacctgtgaacaagcctgaactagcccatggcccagctaggccaaccagcctccagcccacccagcagttgtgcagatgaatgcagctgagctcagtgaagctcagtagaacatctcagaccagctgagtccactgtaaattggcaaaccacagaattgagactgagtatatggttgttgtttgaggccacaccaagtttagggttatttgttacacagtagtcgatgactgattcacaaggtgttattggtttagggcaaatgggagatgagtgccatttctgggtgctgcccacgtataacaaaaaccaaagtcttggctgggcgcagtggctcacacctgtaatcccagcactttgggagtccgaggtgggaggatcacgaggtcaggaa

SEQ ID NO: 88049 - DNA, 1026 bp, Homo sapiens
tcaggtgccatgaaaaccaagcccgctaccaatttttgcaggattcttggaggaggtgttttggagccgatttttaacttaattttttgatgcttctgccagtcgttccctgccaaccttctgaactctccctgccttgctggcttgctaagtgaagccctgaacagaatatggggatgagtgtcaggaggttggtccttccataaactgactcgaatcttcgattacggtgtggcctcagttttctcatctgtcaaatgggagtcattatacctaactcacgtcttcaggcttaaacaagagcgtaggtaaagattctgacacaataccagctacttgtgagatggacacagccgccgtttcctttttcttccctcttgacatttgccaggctagaatacgtcctttctaaaattttgcttaggggtgtgtctcttccagaaagtcttccctctacctaggtgctattgaactttggcatggccctgcccttcgcagcacagggcggtgtctaagagtgagggctggggacgggctttgagattcacatcttggctcccgggctcacctgcagtgtgatagtgaatgagatgtttatctctttcaattctcagtttctcgttagaaacagtacgtgctctgtagggctgttagggttaaatgaggcagcccatataaaacgctttcctgggtcctggcacgtagtatgtgttcaataaatgacagctgttacccatcatcctcatgaaccatgaccctgatcaccggtggtttcctagaggactgcaagtctattctacaactgccattaataaagaaatctttcttcttatttgaaaaacaaaagcaaaacacccctgcccaaacccacctcagtgaaatgctgcctgcctcctctgcagagtcctgccccttccaagtagaaagaattttacttccaggcttaattcgcccaattactccatccgttacaacttactcctctcctctagtgtacccagagtctttgaagacagactgtactgg

SEQ ID NO: 88050 - DNA, 1057 bp, Homo sapiens
acccttgaagaacatggagaaagtatagtgcaatgatatgggcttgagcctcctctacaaagccagggtgcatgtagcttggctttctagcacccacagacctttggcaagcacggtgggaagactccgagatggtcccccgccctgattcccacctcgtggtgctcatgcccttgtgttagtcccctcccctagagtgtgggctggacctagtgacttgcttctagccaacagaagacagcaaaggtgaggaggtgctcttcgatgacaggctgcatcagatgacaatctctgtcttgttagattctagtgccttcttggcttgccactttcatgaagcaagctgccatgttggagaggctcatgtgacaagaaactgagagtggcctccagccacctgccagctaggatccaagacactcagtcccttaaggaactgaatcacaatgaccacatgagcttggatgtggatcttttccccagctgaaccttcagatgagaccccagcccctcaattgcagcctacgagagaccctgagacagaggacagttgagctctgcccaaattcccagcccatagaaagtgtgagataataactgtgttttaagccacagtttaagttttgggataacttgttacttagcaatagataactcatatagcaagttatttaacctttcacttttctatttctcatcttaaaacagttctaatcctactacctttcaagaatgcggagaagtttaactgagtagatgcatggaaggtgtgttgtgtagtgttgggcacctaggaagcaagaaatagcagcttcattattaatttacatcatcctaaatagtaatggctgttctgggccacggcatttagagcccctgtgctggcttgcccttaatacacacgcatttatgcagctcactcccttcatgtccagccctgccctggctgcattcagaataacaatgagatcctaaataatgccccagtaataatgtctgcttacatttatagagagctttatagtttacaaagctcacttatattgcattgactcaa

SEQ ID NO: 88051 - DNA, 1179 bp, Homo sapiens
acgggaagaaaacgtgaggcgccagaacaacaggttctacaaggtgcacacgagggtccctgccattgaatgaagaattttctgtgtggatgcccctgcgcaggtccaatgaaagccgtggagaataagcgttagctcttcaaactgaatctgagctaaaacctagcaaagccaggctggggtctgaggggttgcgggggaagacaggaaggggtggacggggaagaggcgggggtcctaggaggaagggatggggaggagcgagaggagggaggcggagggagggcggcagccaggatggtccattccattcttggagctgcactgttgacttcgaccacaagggggcagggctgctgaaattggaagtgcgaacgcctacatgagtcttgatcctcggcaggcaccgtacccagtttcctccgttgggagggtttaactgcccggaaacggaagtctcgttctttttcgtccttttccccggttgctgcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcaggtcctggtccgcgccagagcccagcgcgcctcgtcgccatggtgagtacagtccctgcctggcgccttcccggggtgggctcgtggggccccggggcgagggcgagagagcctcccaaggatctcctgaggccgggagaagctggtggactgggccatcgccgggagacgtgtctctttcctctctgttcacccgcttcctttgtgttgcagcctcggaaaattgaggaaatcaaggacttcctgctcacagcccgacgaaaggatgccaaatgtaagtggttgctccgaaggttcaagaagagcggtgcctagcctggcaccgctccgggagcgtcttccccggaatgtcaggcaggagacggttaggccgtctgggtgtgtgcctggccctctgggagcagtggtttcatcctgtttcccatgagaaagacctgtggggggcacgttgaggccctggaatttctaggaccatct

SEQ ID NO: 88052 - DNA, 1323 bp, Homo sapiens
gggtgcgtgttgtgcgcagtggctggaggcatcctgaagaacgagctcttactggcccagaatgtcatctcacatgcggaggcctgatttccgggagtggagtgctgaaaagcgctcagtcccagcagacagcccgtctccttactttatcactgcttctatccctttttaaaaagataataggccaggtgcggtggctcatgcctggaatcccagcactttgggaggccgaggccagcggatcacgaggtccagagattaagaccatcctggcaaacatggtgaaaccccatctctactaaaaatacaaaaaattagctgggtgtggtggtgcacgcctgtaatcccagctactccaggaggcttaggcaggagaatcgcttgaacctgggaggcggaggttgcagggagccaagattgcgccactacactccagcctggcaacagaccgagactctgtctcaaaaaacaaagtagaaataagaaagataataaggttgatagaagatattctgtaatgttgtgttcagtgtacccaataaaagtcccaagttggaggaacgggtaatagtgttttctgtttgcacagagggatggtactggaggtgggtgctgtctcctgcatgctgcttactgcttgagtgtatttgcacatggactgtgtcacatctgttttctgtgatacaatttaattcctgattctggtctccggtagctgtcaagatcaagaaaaataaggacaacgtgaagtttaaagttcgatgcagcagatacctttacaccctggtcatcactgacaaagagaaggcagagaaactgaagcagtccctgccccccggtgagtgagcctgaagtcacttcaggggcgggtggggtttggaaggttgctgtgtgtggccatgttgtatcttgttttgaatccctctcagatttcagagcccattttatggtctaagaatctgctcttgctgttgggagtgtgaggaatagttgtgattctcagattatatacagtaccagaaatcatttccttagccagaagagcggttagagctcatttaatcctgttcacgacccttcgaggttggtgctagtactgatagtccccattttttacaggggaacagatgaaatataatagaccaagtctttttatcgaatataatagaccaagtctttttatcaaacactaaatattttaaccgaaacttcgctggtggatctaatttctgaaccttgtgtgctctctttagcttaagtacaaaatttagacaagcagcagcaactcagatgtgtcttctggatggcttacttttgtctctt

SEQ ID NO: 88053 - DNA, 1042 bp, Homo sapiens
gcactcagcgcccgaggcctctgggtactctggtcttggacggtatccctctccttgcctttttcccttggccatggagctcaccacccacagccctccctgctagctggggattcctgccttgtctcctgagtggctcggactcttcatcagcagggcctggtccgtatcttcatccagggtctgaaccagaaaccggagaccagctctggcacccctccctcactgaccacgaggcccaccacttggcctcatgccctgtaagctccatcactcccacccaagtgcctcagcgccgggccctctgtttacagagtaggagcttgaaccctaggtggagcttggaaggatggacgagagatgcagctcaggcagtggggcactcagggcccaagggcagggcacttccagagccccgcactgcagggatgaagagtgacaacaggcctctgctctcttccagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctggtgagtgtccctggacgctgggcttggggtgtgtgactcagtctgcaaggggccagggactgtttgaccatgttctgacggagctccagctaccttgatggaaaagcttgtccccagatgaatgttgtccctttttttttttttaccaagcatcaggaatcagatgcctggggtggtgatggggtctccagaaaggtctcccaagtggccccccacaaaccctgccccaatgtgggtttgtcctgtgcccagcagctgtgcaggcagcatttctgcaccgacactgggcatctccagtctctgtccctggcccctgccagctgctgccctgggtctgtgaggtcagaagaaagtttgactccagcacaaatcaattccatcttcttgtgagatcaatagcttttag

SEQ ID NO: 88054 - DNA, 1016 bp, Homo sapiens
caggggcctctgctctacgatttagctgataacccaggactgaggagggcagcagagggcccgggcattcagcccaacaggctggctgacttctacagaagcttccccaagagtccacacagaccctccaaaggagttcggtggggcccagagcaagagctggggcccagggtggtgacagccctcaggccacagtctggcctcccttctcctctcttctcaccaggactttgcgatctggaatgaggagagttcttggtgctgggaggggtgccccaggaatagcaagaaggatacatggggtcactgttttcagggagcctgcagtccccttgaggagatgggcagggacacatggtgtacaggcacctggtgagcggattaggcaagaggacgcagggtagtggggacccacatgcgcatggtcagcgtggtggggagcctggaagagctggtcgtgaagctgggaatgggccagaatgatctgcaggaggcaggctggggaccgcgttttagaggagtctcaaggagacacgcgtggccagagagtcctgggaggaaaggcagggaagtaggacaggacctggctgcctcggagcctccttcacccttcacagccggccatcttctacccattgttctagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgtacggcctgcacacacacccaggctgggtagcactgcccggacagcatgttgggtggggtccacagtgccgggtgtggggaggaaggcatccaaggccacccgtggtccccactacagccacagggtgcctggagggaaggcccccggggagcatctagtcacccctccacacccacatgtgctg

SEQ ID NO: 88055 - DNA, 1092 bp, Homo sapiens
tgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacagga

SEQ ID NO: 88056 - DNA, 1025 bp, Homo sapiens
ttaccatcccaccccatagaaggcctgttctgggaggcagctggattcacctggcggaaactgctggagtccttggatggccttattcggaggtcccagcttccccctgtgacctgtggagacctcagccacctggaatggctgagacaagaatgctggcttttctgtgcatgggacaccattgatttgtcttcctcagtatatgcttctgtacccaggacagcagtgatgtcctgcagggaagtggggacccactggatcttttgctccatgggcaacatcataatactcattgctaacaacgctgggatccatggttcaagagatggagcctggagatgtccagctcagtggcagcagcagacaggacagggcaaccacgtcatcagccagcacacagcctatacagaggtgagaggccccttcttggtggtggcgattctttcctacatggtgtggtgtcagtgaccagggtaggctgctagcccacggtggaagggatcctatccactaaggcagtcacctctgagccagcctgggcaaggtgaaagatgttatgaagacccagccgcacaccttgactttttttttcttttctttttgagacagagtctcgctctgtcacccaggctggagtgcaatggtgctatctcggctcactgcaacctctgcctcctgggttccagtgattctcctgcctcagcctcccaagtagctgggattacaggtgcctgccaccatgcctggctaatttttgtatttttagtagagacggggtttcaccgtgttagccaggctggtcctgagctcctggcctcaggtgatatgcccacctgggtctcccaaaaatgctgggatcacaggtgtgagccaccgcacccggccacaccttgacctttttggtctctgaagtcttcagccctgatcagtccagccagagccaccaggcctgagcaccagggtctctctctctcttttttttccttctgcctccctacccctcaagacagggtctcactctgtca

SEQ ID NO: 88057 - DNA, 1030 bp, Homo sapiens
ctataggctcttgagtgtgtgggatgggaggaaggcaagtgctctgtggtatccctgggggaacctccctgaagagtgccctggtcacagcacccttgaagacagccattggccatgggtcagtgttgagtttggttggccctgtgacgcgctggagctctctttccagtgcggtatccttggccctggtgggtggagggggtctcaggcttgtgtgtggatgatgctggagcgaggaagggagttttgctctggagaagtgagaaggcctggctgtctccccggttgctggatgaagccacttgttgctgggggaaaccagtcagggctgcttgggcctctgggcctctgagcctctgagcccaccaggcctctgcgccccctggagagagaaggagggaggagggaggttcagcaactggactgcactgactcacaggagagctgggggcagggtggctgagcctggggaaaggccgatttcggaggcgattaaaaatatttgtacaactgattccagggaagtgaagcaaaaggcccttttgtccagaaaataatctgaggctggagctgggcttcagctgtggggtgggggagactcagggcggaaggaggttcccctcctacccccctccttgaaccctctgagaatctttaagcagaagatgcaactccaacatggaggggacaaccctgggtgtggagaaatgcacctgggaccatccagaggtgacttccaaatgcccactgtgttcaggcacagcaccagctgtggcagtggattctagaagtcttgttcaccagcttcaaagaccttacagccctggaggggagacacggacatgatttgaacgttcagggatcagaaggctcagtcttagtgcagggtctggggacccacaggaggcagaagtttcctccagggtcctgaggaaaagcctctgaccagagctgagtccatcttgtcagtcccttagccaccatcttaaaaggtggcattgggccgggaacggtggctcacacttgtaat

SEQ ID NO: 88058 - DNA, 1015 bp, Homo sapiens
tttcctaagactctgacgtccagcagcctctctccgtggcccaccctgggtaagccagtccagtgggtggcacttccagccatgtggttgagacagcagggtcctgacctttggacgctggctcaagactttgccagggggctgccaggccggccccggggagcctgctcctcccaggcttgggaatgtttctccccagctagtcagaagctattttctgataccggttgtaggggaaaaaatgtttttgttgaaagggagagaaaggttgctgggaaaaaaaaaataaacttgaaggggagagaaagtttgctgggaagaaaaaataaacttctcccaaaattctccttctatgctcagattgcattagcctcctggggactgaaacactatttttaagtaaaaaccagttcttgggccccacgcagtagagtcccctttgactcttgttctttctggtcactttaggctcagtccccacaaagtaaaacgagatggtagaagccctcttcccgggactgcacggcatcctgatcctcattcctctgtacccaggctggaccgggcccagcacctttcccatccttgtcattggagctgggaggggccggaggccaccaacctgaagcagtggaccgagtgggcccccgtgaagccctgagtgtgtgactggagcgcctagggccacctccctttcctgcccagcccatcttcctggtccccaggtggctgcagctacaaggagctgtccgcgggcccccaggctgcctccaactcccctcttgacacgcccccctccccccaaatcatagtccctgtgtccccaagctgtggttcagattgccttcttcccctctgtgaacaacaggcctcagtgccccgtcttgactctggaccttcctggccctgccatcttggtgtctggcactggcttgtcccaccctctgcctagatggatctcctccatgagtctttggagccaagccagggcagaagttggcccttgcccttctca

SEQ ID NO: 88059 - DNA, 1066 bp, Homo sapiens
ttgtgaatgtgtgtgggtgtgtgaatgtgtgtttgtgtgtatgcgagtgtgtttgtgaatgtgtgggtgtgtttgtgtgtttgtgaatgtgtgtggctgagtgtgtttgtgtgtgtttgtgaatgtgtgtgggtgagtgtttgtgtgagtgtgtatgtgagtgtgtttgtgaatgtgtgtgggtgagtgtgtttgtgtgagtgtgtatgtgagtgtgtgtttgtgaatgtgtgtgggtgagtgtgagtgtgtgtatgtgagtgtgtgtttgtgaatgtgtgtgggtgagtgtgtgtgggtgtgagtgtgtatgtgagtgtgagcgtgtgtgtgtttagagtctgcactctgtgtggatcaggaaaggggtccttgcaggctcgctgagtccctgctctgtgcccagccccgagttggctccaatggggctatatagaaaggaaggcatggccggaggacctctgtgtcaagttgaggacacatttccaagactaggaaccattcagggactctggagtcacgatgacaactccccttccctcagccccgaagcccaggcctggacctccaagggactcagggaagggactcaggaaaggggagttccccctggcagcctcctcgtgggcaccaccgagggtgagaggagccagctcagcgggtcccacccccagggttgcccaccttgaccacaaggaaaggagggaggagttattgggccttccactaggaggagacccggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtgg

SEQ ID NO: 88060 - DNA, 1045 bp, Homo sapiens
gtcaggtctgtctgccttttcttataaagcagttccattcccatgataacccattcatcctttaatccacgaatggattaattcattcatgggaactctgcccccatgacccagtcaccttttaaaggccttgtctctcaatactgccacattggggattaagtttcaacacgagttttggagggacaaatattcaaaccatagcaagacctcaggactcagacaccctctgtcacaggtcactctgagtgacagttaatttactcaagtgggacctcagggaccaggacagagcaggacctgagagacacacacgtatatacactccctcttacctgggttaatggtcacttgaactttgaccccaagatcaattccaggtctctcagtcccacaccaataactgtcagcatcatctcttttgagattctccatggtcacggtgaacacgtggtttttctgattgtccctgatggaaactcgattcttctttacctcctgctctgatccatttgttttaacaaggatgttacagtaattccaatcagctccttgacaccgccacttcaagtaggtctcccagcctgagccataagcacactgcacagtcaatgagccctgctccgagccattcactgttgttggaccagtgattttagcggcaatggagtaacctggaaaacgcaaattcatgtgtcgtcacctcccaccccaagggcagggccacagcctcgtgcattgggagtagcagccaaatccaactgccttataacagtcaaggaagcaatacattttcctcaagacaaatctttgtccttcaaaattccactgggtcaaagtcaccaggaaaatcactgaagagcacaactgcagatccccaaagaaacacaaatgttggcattgagcaataatagcttcctgcagttcacccctctctctttccctatggccagcaaatctttatattccaaggaatgctctttggcaaccatctttgtgttatactggtctgatggggaggaaatggcagaaggcccttttccag

SEQ ID NO: 88061 - DNA, 1075 bp, Homo sapiens
atggacatactttggaagacagagacctggtaatcccttttcacccaagaagaaccaagccctggatgaatggatgagcagctcacgtttttctgccccccacccccagtctttctgagactgactttgtcctaggaattgttcgtccctctggaagctagtctggtatgtggatgttccttagagccctggtgatagggaattaggaagtaagtgcttgaactgaagcccttttgtcctaattcactggtatctggggcaaaagcttgccctctctgtgaaaatgaaatgaaaatcttttcattttctgggagctcaaggtcagaccctggcacagtagggacccaatccgtgggctgttcctgaacccctaccccagaccattgccctggatggctcttgaagctggtggcaagagagaactgagagttctctaaggaaaagagcagccaggttgctcctttgttttaaattatttagctgcaccaaattttcagatttgtggcaacaacaactctatttaaaaactccaggcacatgatggatgagctcaatgttttcagtcagttcccagcttccagcccaccctacgggaatcttctaagagttacttgggcttgcctgggtcagcctccaactattgggaccagctaaagtgcaagagctacacaatgcctatcatgatatttggcgtatgtttttcatataaatgaatttcatcaagtcccatacaccacctccaagagaaaaaagatactcaacttaggaagtcagaactgggatgtttgcatagaagtcacgctttttgtatagatgggttgtgtgagtttatttccatggacttctgcctgtgaaataggtagtgtgtgtgtttctgagattctcttgtatgaagctgctgctcttctcacaaagctcatcattttaggtgagactgaatgtgacacccattgaagctgctttggagcccaagatgcatgccctaatacaaccacttttttttttttttcggatggagtctcactctgtcaccaggctgaagtgcagtggtgtgatcttggttcactgcaacctc

SEQ ID NO: 88062 - DNA, 1090 bp, Homo sapiens
tcagacattttctcacaaaaggccccagggaccacaaattaaaggaaaggatgcttaggagaggaaagcctggagagtttggaaaacgactttgaggcgctggactgagtcaccatcatttcctgctgaggttatcctaagagaactagcaggcaccaccactccccacaccagctgcctgctctgggatctgggcaggaccgacctatcagccaaaggagtcccagacggcaccagattgccagtgatgtaatatacacttcatttgtttatctgtaagccttcagagcaagcaagagaggaaaacaagccagtggaaatattatacagggagcagctagcttttcttggctttcttgtttgttcctgagctgacaatagaaatctttgagaattggaactagtgcgctttgaaaacaaaactctcttcacttacagggcatggatttttctgctaatttggattcttttgaggacaaatttgcataccattatcattatcattgtttcatcgaaaaaaaaataaaagaagcacctgtgggatagagaatgagagaggaacacagaatggcgagtatggtcttttgctgttttatttgtctttctcttgtacaattttctggcagggaaggagaacactgttgtatccagacctttccctaggattaataggtgacagtcccatggggagggagctagctgatgtgtggaactctgtctctcatggatgttaactttattttttattttttaattttaattttttttgtggggggacagagtctcactctgtcacccaggctggagtgcaatggtgtgatctcagctcactgcaacttctgcttcctgggttcaagcgattctcctgcctctgcctcctgagtagctgggatttcaggcgtgcaccaccacggctgactaatttttgtatttttagtagagacgagtttcaccatgttggccaagctggtctcgaattcctgacctcatgatccacctgcctcagcctcccaaagtgctgggattacaggtgtgagccaccgtgccaagcctggaggttaactttaatcagaagccataagtgagagag

SEQ ID NO: 88063 - DNA, 1027 bp, Homo sapiens
gaggtcggtgagagagatggacagatcttcttattcccggccaaagctgcagccccaaaggaggcccaagcccccagtcctgtccccaccagcagactttcagggcagtgtcaatgtgaggaaagggttaactccggggaggcctccagcctttgcttggtcagatcagagtccagtgacgggggccggtgcctccccctccctcctctcaggttgtcttggaaactcagccttgctggctctagagagtagtgggtcccccttcaatccctgggcccctgccctccccatcccccaccatcaccctgccaagcctggcgcctccccctgcccaggcccgagccaaacagggcagggctgctgcaccggggcagggaggggttaagcatgctctgctccttggtctggactttctccctgggaagatggctccctggagcgggcaggggtgctcactgggccatactgagggtggaacctcttgggactttgcagtgggtggggcctcctggagactcaaggttgtatgtgtaaaaggagattcacacaaaggtcctgcgactcccatcgccagctgcaagggcccactggggaggccctgtccccttctggcgcaatccaaggcctgaggctcctagaagaggggatggcccctggaagtccctagctggctctgggcatgggaggtggggtaccgccttacccttatctcccaagttcatggaaaccaggtaactcagataatccccttctccactgagggggagactaaggcccagagaagccccagccttcctcctagggatctgatacgaggaagacacagctggaatctggattccactcagctcctgggatactgtcccctgcttcccccaccccttcaccctgcaggtaattggccccctcagacattcctccctcttctgcctgtctctcgggctagaggggctgcagcctctggccaaaggacctgaagagggagaggcctggggacagtcccctccccgcagtccctccaggatgg

SEQ ID NO: 88064 - DNA, 1051 bp, Homo sapiens
ggcctgctctcctgccttgaacacaggagctgtgagatccacctccggggcacaggtgactcaggagagggatacagcctgcaagtgcctggccagtgccctgccaccccttgtgacagagagagtcttcccaagctccctccggacacccccttgaagaagtggagggccagggggatttctgtctgctggcctctcttcctagagggccgggtcagtctcagattcaggctcaggttgacaccggaagggtcaagggtccttccagccctgtttgcgacagccctgttttttctcgctctgccaggattccatcttggcctccctctcacatggcaacactggcctttgtccatttgcaacacttaaaatggtgtgcagtccccatttcaaaaccaaatgctttcctcctaaaatagtaccactcaaggagaaaatatccttttcatgagggtgcagagggagtgatgtgcccacctggcagtgccatgcgtgctgtgagtgccccgccctcccacggtttaccttgcatcggtgtagcacataccagtgacttttgactcccacccacacagtaaagtacacagcgtcatcccatttcacagcagggaaaactgactgagagacgggggcttcctgggatcccggagctgaagcagacagacaacagctcagctctttggcctctcagctctgtcctgccctggtgacacaggcttgctccacttgcccaagactcagttccataggccctgccttggcggtggcccccactgccatgtgcaggctggggcatggagcacctcttctcagccctggaagcctgacattttcaagttggtggggtgacccggctgagcatgttccctggtgagtgagcgcctttgcacgtctgcccatcattgtcaccgacttgattgatgccctgtctgccctggtgcccctcactcctagatagcaaggccagcttttcctgggcactcaagtagtgttagaattaagtgcctcttcccaaggacacttccttcccctgccatggtctctgttcttc

SEQ ID NO: 88065 - DNA, 1023 bp, Homo sapiens
ggaaatcaataatacagggacaggcctgtgttgttcttgcttgcttgctttttttccctaggagctgtctatatatcttagaccaggaatggcttcttgtcttccgtgtgctttccatccccctaccccagccctccctaaatgaaattcaggttgcctgtcactcactcccacactgcagcttgtctctctagctcctagccagggacagcgtgaacccccaccaccccacccattcctccgccactgctgctcctgtctgagcacggcccctgtccctcctttcttcccggagttgctccagcctgtcccttcaccttgctgaggacacctgggtgacgcctccctgagtcaccctgtgactgcctcctccaccctcatccccagtgcccatgctttctcctcctgctcagggagagggttgctgtttttgtttttaatgtcactctcagggacgtgggttcggttgactggcattatgcccaccatccatcatgccccacgacctatgacctgtccccaccttggccaatacctatgcgccagttgagaggatgatgcctagtcccccgtgccaccgcctctatggtctcagtacaggtgccagactgggggactcagtgtcacaaagcagcaggcagtggcttcttctccctaccactcccttacccagctcggaagctgctcatgggcctctgtcaaggtcctgaggggtgacagggtcttatgttcttgcttctaagctggtgaccgacatagcccccttcacagcatgacagttgggtgtctctggccctggtagaatgtgcaggttgggtatcccttccccaaaatatttgggaccagaagcgtttctgatttcagattttcttcagatttttagaatatctgcattatactcacagtagagcatcttaaattcaaaaatccaaaatattccagtgagcatttcctttgaggatcgtgtcagtgctcaaaaagtttcagattttggagcatttcaggtgttggaattttggattt

SEQ ID NO: 88066 - DNA, 1019 bp, Homo sapiens
ccgaggcctaagccctccttgtttgtgagtggtgcagtcagggataaaaacccggtgtgcctcacttcccaagccacctgggctgatcctggccactgacctgtgcgtgcacatgcatttccagtcattcccctcgagaagctgagccccgggcagactcccaaagctcaacagcccagtccatcccacactgtgcaccccgctgcttccagaactcccatttctgggcaaagaactaaaaatagtttttattatatctgttaagagtacatcccagttgttgatttcagatctctccctgccaccttttttattttttatttttttcttcatttcacaaaataaaagtgtcaaaaaactccatagtctgtggaatctagcaacctcccagtagtttgagagtaacatggaatgttcttcaatattttgtgctaactaaaatgaaaactgtatatgccaaactgtttgtcttctgctccgtgtctggctgctccttttatcctgtagatcagtctgtggcatttgtggtggccctgccaagttttgtgaggctgtgctattccctgaatgatgcttgctctgttacagggtgtgtatcataagcagagcctgatgtctttctatatagcgccccagggccctagcagtaattgtttaattaaataaagcactcactcaaaagtaatagccgtgatccttcgtgtggccagtgtcccagccagcggtgctggccctgcacactggctcaaaagcagcacctgtgtgcagagaagaaatagctgagtgtgcgctgtgcagtgcaccctggccctgaggagaggagccacagaaccccagagggtttacagccagcagagaggtgcgagggactcggctatgatggcccttacacagagctgaacgattagggtgcacattaatgatgatatcggatgaattagcataagcccggatgtcttgtggattcgctgacagtggaccaaggaacattttcataagcctcaggcacaaaaggaggc

SEQ ID NO: 88067 - DNA, 1003 bp, Homo sapiens
ttaactgcaatgagcagctcttaattcctctactccctgagcaaccaatttggcatggaaatcctaaccttccccacactccagtctctgctctgtcacatttacccccattttcctttgcaaagaaggttcccatttcccacagaccagttttctgagacagagtttgacttttgttttttgagtcaacactttcccctgttctccaaagagaaatgagaggacccatgctgaccagcacccgcttctctgcctgggtcccatcctcagcccagaacttctttgccctggttttcctagatgcagctcctttccttggtcatcccgggtacttccgaggggcctgccctggaagccaggggctctcgttctccaggcttctcctctcgaagtcaaaaacgtggcccatgcacatcccgatcactcctctccaagcccgtcagaagaggtgtcctctcctgcgaggcttcgtcagggctcctggggtccctccccactgtgtcctttcttcgcagtaaactaagagtcagagacatggctggtgcttcttttggatcctttttgccattatgtctctagcccatgctcatgggcagttcgagggtgggcacatcatggatcttcaatctgtgtttgctgaagagagcaggacgcatggggtccctggaatgacacctgggccttgcctaggaggctcagcattgtcggaacagtacatgtgagcagcagcagggaagcatggctctggagcttttgttccacccctggcactggcacttacccaaggtgaccccagggagcctctgccagtccaggtgtgcccaagtcaggcccggccttagctatgggcggaggccacgtgagcagcagcgtcttccgtgtgcagacagtctgctggtgcggcctgcaccctcctcactcttgtttccatcccccaggcgatcttcactctcctcctcggaccgttcaccttctttgacgtccagaagaccaagtacctgca

SEQ ID NO: 88068 - DNA, 1089 bp, Homo sapiens
ctcctcagaaagggaaggcaggcaccttctctgactggcctctggcagctcaggactcgtgcctgttttatctcagctccaagacaatgacttcctgtgccttcgctctgtcttcctcactccctccccaggtgtcagtgtgcgagggaggggagtggctgtggcccaggtgaatcagtgtggcgaggcctgcgtgtggagctgagatccactatcaggatgagcctgtgagcagccagcagccttggcaggcgacctcgcggggcctcagtgaggctctgcctatgggtgtcctcgggggcccccctcctcgtctctaccccgcattgagctgctcctaaagcatgaggagtcacagcagccacagacctatagggtcggaacggctccgaaaggtcctccacgtcccgtctgacacctgcttcccctctgggacccccaccacgtgcctccttccctcaggcttggccgcctcccgcgacggggatctcatcatgtaccccacagctagtgtgcctgataaccagcccgttctttggttataatttgtcccctgtaccttccacctggactctggtaccctggactctgggctccagaaggacaggacccctgtctcagtgtgctgtccccagatggccagcatagtgcccagcacccaggggaaactcagtccattgttgttgaatgaaggaatgaacagtccagttgggcccatgggtgacacaagacaaatgcggtggcttttgcgttggcttttactcagatattaagagagaagtcttctgcctccccttgtcattttgtagctgagccttccgaggcccagcagccgctcgtgtgacctgtgtcagcctcctcctctgtcctcccctctgcctcctcccagcttctcactgctgctctccaccactcagagcgggactcccagtgtgcaattgtgggtggatgtggatgcggatgttctgggcactgcctgtgataggctcttggggaactgcaggccctgctgggggccgacccccctgcacatctgactgtgaagtcctgggtgtctggtccttagcatgtctggggagcactttctgc

SEQ ID NO: 88069 - DNA, 1033 bp, Homo sapiens
gtcttcatggggcaggtgggactgtggctctaggggaaaccccctgtccagctggggttgttctccccacccaccttccacccagtctgcacctgtcctcactcccccgggcagctctcccaccaggtccttctgcctgggtgacgcgtggctgctcccaagttctaagactcattactggaatcacacctctcccacatcttccaacacgcttcacccccaaccctacttccagggcgggctactccctgcacaatgggagatgcagtgctggcactgccatcatttgtcccagacccatgcccctcccctctcctgccccatcctgcgtccttgtctaagaaacctccactagcagctgctgcctcttcagaggcgaatcccaggctggaagtatcctagccaggtctgcctgtgacggcagggcccaccctcccaccaggcctgggaggcggtaggtgccacctcagagagggcctggctggccccatgacaagaacaagaagtgctaactggtaccagagtccccagatagagctgcgagggccctcgctgtgggcgcgagctccggagtagcaggctggatggagcatcccttctacagggacacagccgcctgccagctgggcctaaagtctggagcttgtctctgaaagggaccgtctgctgccctcgctgccccactggagccctcagggcctcctacagtgcaggtggtcctactagagggaagccatccccacctggcacctcagcggcttggcagtgacatggcagtgggagggctctgaggttcccaccctgacaatggtcaggctgcccgtgctcccactccaacactaaaagcggctcccttaggggctgagcgtgggtgctcagtgttcacgctatatcccttgggcaatgtggggttggatggggcccccacttccattcccatggaaggaggccaggtccccagccacctcccactcagccatgcacgcacttgctgggctggcctcctgggaaacacaggtgactcgaatgaact

SEQ ID NO: 88070 - DNA, 1017 bp, Homo sapiens
gactggccggtgggggtgggggttgggggtgatgcaagagctgtcttccttcacctggctgggggcctgtcacctgcgggatgaggtcactaatcccagcaaatagcctgttagctcatctaagtcctcacactgctgtgattatttcaggcaagaaaacatggctcagagaggctaagtgacttccctaagatcacacagccagttagtggcagaactgggacacgaactcagatctgtctgactcaaatccatgcacttgaaccccagactagcattttcagtatgacttcctagggcagaacccactggctgagttttggaaggcatcagtagactggagggctgggtcccggtcatggctcctgttcttccccagcccttgctcttctgggatgcccttgggatgctcaactaacctctatctctttctctttgtccgtgtctgtctgtctccctctctctctgcctctcttcggggagggaggttttcccctcttctctttcatcttccgtatgtgtgtccctctgtccctcctgtctgtccatctgcctctctccaaacctctgtctctctccctgtgcttgttctggtctctccgcaggaccctccggtggacatgggtggggccctggggccggccctgttgctcacctcgctcttcggtgcctgggcagggctgggtccggggcagggcgagcagggcatgacggtggctgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcaccccca

SEQ ID NO: 88071 - DNA, 1031 bp, Homo sapiens
gtttacgagattttttacattctttttccctgttgtcttcaatgtgcagtgtggcatgaaattttacactgatagcaaactccgtttgggtgagagatgtttctggtacccaatagtcgtgtatgactggcggctcctatactgggcagcacagatctagagctcattactgggaggcaggggtagtaggaggtttggggctccccagagggcaaggaacctctaggacctggaggtgtgggcagaggtgagcagacagaggccgtgcaaggggagcgacaagcatgtcagtgtcctttgtggttgagatctgacatccctgattggtggtggcagctgaggcatggcatggcatggctaggatcgatcccttgccagactcaaacatgtctctgggctgtcagttctgtcacttctgtcacttctgtgtcactgtactagggaaccgtacacatgggaagatttcaagggcgccaccatgagagcaatattcccttccttgccaaaactcttgtcttcttggcctgaaattctaccacctggcactttagcttaaggctctgactgtggttaaactacatctctcttgggaatgagaaccctttcagctatgatcagtccctcataccttcctgtgaatgagctctagatgcttagctaagagaagatcttgacggggaggctggggagtttgagggaagtagggagagaaggttggaaagagaaatatatttagaaaaaaggaggttggaggtgctaacagcagcatgctcattctgcagatttgactctaagttcctggagggcagggaccatgtctcacccatagggacattccaccatccagcgcctgctgcagggaaggggctcagcacacacgggccaattgatgtttctacactaaagttggtttagtgggttccctggagggatcctttcagtgccaccctggggagaagaggaactttcctgaatgttcctggtagcctcttgcacttccccgctctctggattccttagagagaactaga

SEQ ID NO: 88072 - DNA, 1046 bp, Homo sapiens
tcggatgaggaacttgcagaagcagccgggtgctgccatcctaagctggttttccatatgggcttctctgtgagtgttaagaaaagctgtggtttgcctgtcagagtgagcgcccccactcagggtaaccacagtttctccatagagcaataggacagcaggagtgggctgggacgactcctaccttagcagctgctggggtagaatgcagcctggtttcagaactgaatttctctttcttcttaaaggtgaaatcttgtgctgagtgggtgtctctctcaaaggccaggattgtagaatatgagaaagaggtaaggatgatgggtagccgttgcctataatatgggttctctctttcatgaccacacatctttcacctggtggcaggaacctgccttggatattctgctttccgtctctgtttacattaactaaacacattccccctctttccagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacagttctgggtgtgcttcttctctgtggttgagataattaagcctctcttctgagctggcctcactggcagcggggtttttgtttaaatggaaaggtgagcctcgacaggtttgttgggctggttgtctgacgggctgtgtaggcgccacttactgaggccccaggactgctgaaatggcaacaaataacactaggggctatggcagtgtatttcactgtgatgtagtaaagaattgttatctgctgattctcttcaacttcctctttggtttcaaacccctggttccaagggagtgctcctgcttgtccattagtaagtcacaagaacagctggtccaaatggctaggtgtaacagcagggatttacttctctgtgcttcagcttttgag

SEQ ID NO: 88073 - DNA, 1147 bp, Homo sapiens
tgtctgagtgtggtagcgggcgcctataatcccagctacttgggaggctgaggcaggagaatcgcttgaactaagatagcagaggttgcagtgagctgagatggcaccactgcaccccagcctgggcaacagagtgagactccatctcaaaaaaaaaaagttttctggctctaactggaatatttggatgaataactgacactaatgatgaaaaattaactcttttatccactttatctccagcagtttgcaaaagtgaagagaagggcttattcatttagttttcttccatctagctgacagctcaaaggctcctttttgatgttcaaaggtggctttgtagttggtttgcagattaccacttggaatgtgatccagtgtcaccagtctctttgctatcttacctttacgtggtatctttcactattgtagatatttaatagtttagacattttggtaatctagccttatcctcagtttcccacattctaaaaaaatgattgcttactatagattttaaagtaccatgaattatgtaatttgaaatgattcaagtcatggtacctgaacattctcccttcttcgtcattagctaattcctggagagcattataagatttctgtttgatgaccgcaattaaattaattagtcttctagattctgaaggcttgtggatttatacccctttggaagcttttttgttctaggaatgtcaagacctttttgatgttaactatctttccatctgtcctttttatgtagtgaaactgaaaaatggatttgatgttattcaaagacaccctcttttatacttgttgtatgtggctctaagatgaagttggctgtgtgtggattttcgttttgtttcattttgtatttttctttatttttttgtgtgtggattttcaaacatgttacctccttgaacttacctgtagcccctcacacatgcaggattcaagccaagcccaagatgtgggcctcaaccctaccttcggtttcatgacctcttagctcttagtggctgccacctaactactttcctctgtttctttttttttcttttttctttttttttttttttttttggagacagagtctcgctgtgttgaccaggctggagtgcagtgatgcgatctcagctca

SEQ ID NO: 88074 - DNA, 1067 bp, Homo sapiens
taaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagcctcctcgagccaggtgctcctgggcaccttcagaagtgatgtcctgtgtgctccacagctc

SEQ ID NO: 88075 - DNA, 1045 bp, Homo sapiens
ccttctcacccacacagtggtggtacttcagcagggggctggtgcagatgaagacctgcgtgctgcggagaaggacgcggttaccgccgggagccaggagcccgcccaggactccgcccgcccccctctctccttactccggtaggtcgttcatctcccgcacagcgtccaaggctcccgggatgggctccaggtccaggaaaaagcccggggcttcgtacacactggccactttatcctgaaagacaagagttctgggtcccggcttcccgttcccgcgaggacccgcagggaggctcctgggggctccgggcccgagctcagaggggcggagggggcgtcggtcaggggcacgcgcccaaaggctcctccccagggtgcgctgcccgcgggttccagggtgagagctctgcgcccttcacagagaagggggagacccccggaacggagcgagcgggccctgcccgggtggggaccctgcgccccctaccgccaggtcgggccgcagggcgcggtactgctcgcgggccaggaagccgcggcgttgctccagcggcacgtgcggctcctcagggaagcggcggcggaagccccgcaggaggccggcctcgaagtcggccaggacgccgtccatgtccaccagcacgcgcacgctccgcgccatcgccgccgggccggagctgcgagctctcggggtctggggggcgcgggctcggccggaagcggagggagcgctgcttccggagtccgccgggctgatttgcatagagtgtccgggccgccccgcccaggtcgtaaaccagtgccgacggccctgcggttgcgcgaggccatcctagggttcgggtgcagggacggctttggggggcacttttctgaccctgcgcttcttcgggacccagcctttgtccccatcagccgcctcccactttacggcagacgtacccccgttcaccccacgttactagtaggggaccgaccttccgggggcccaacaaagggatgctctgaaatactgggaagcatctaacgaggagtcaagggt

SEQ ID NO: 88076 - DNA, 1391 bp, Homo sapiens
tttgggaggccgaggcaggtggatcacaaggtcatgaattcaagaccagcttggccaggatggtgaaaccccatctgtactaaaaatacaagaattagccgggcatggcggcaggcgcctgtaatcccagctactagagaggctgaggcaggagaattgcttgaacctgggaagtggaggttgcagtgagccaagactgcaccattgcactccagcctgggcaacagcgagactccgtcaaaaaacaaaacaaaacaaaaaaaaacttcatgtccttatatatttgtgtaatttagaaaagaacataaacaacaaatatgggaaaagatgaacaatggttaattctgtggagtgggagcatggtgggtgattattttgtttatgcttttaggtatgtttccaaccatcaaaccaaaaaaaaaagaaaaagagaaacagatccttgatcttaacaggaaatggctgtcattatgagtattatttctattccctgttttcatagaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgat

SEQ ID NO: 88077 - DNA, 1030 bp, Homo sapiens
gaagtggaaagaccccgcccgactaagcactaaagccctcagagcacagtgaggcatcacctgtctgagtggggagagaactggagaagggctttggaactgataggggtccttccataactattatctagtttccccttatcggggaaaggagagagaaatgaaaggagagatttaccagttttccattctaataaaagatctctgaagtgctaattggtgttaggtcctcagaggaaatgttggggtttgttgtagacgtggtactagcactagagcaatttatcatgcagaatttttgcatagcattgtcctgagttggatagaggtagcagactgaccctgtgcttgattgcaacacaatgaaatgtcacattcggtttcaagtagatgttagctgctatgaactatgactgttttgcgtgttccaaaattaaaataggaagtaaatttttgaatttttttcttttctagggagaaggtgatattcatggtaagtacttctgaagaccaaatttctggctctgtccatggttttaggacagatctgaatcttgatttaaatcatgtcttggggaaagagactggggagtgaaacctggccatgccccaagtgccgccatactctaatctgccagtaacgcgatcaatgctagaaacataatagaagggaaaaaacagagaatcctttaaaattacatatattggctgggcatggtggctcacgcctgtaatctcaacactttgggaggctgaggcaggcagattgcttgagcccaggagttcaagaccagcctggaaacatggtgaaaccctgtctctataaaaaagtacaaaaattagcctagcatggcggcacatgcctgtagtccagctactcgggaggctcaggtgggaggattgcttgagctcaggacgtggaggttgcagtgagcagagatcacaccgttatactccagtctgggtgacagagtgagaccttgcctgaaaaaaataaactaaaccaaaatatatctaaacacacacacat

SEQ ID NO: 88078 - DNA, 1050 bp, Homo sapiens
ttgagttgatattagtgttttgtaaagaatttcagtaattaggtcaaatgaatcctcacacttagtttttcatgtgtacatttgaaatgtgagacaaatgagttctgatcctgtgaaatgaatgtttaattcacctttcgtcatcaatttccctccaatattatgctctagggactgtagtagcattgtcattttattgtctctctaccttccctttttctatattctcacctaattctcataaacttaattttgtccagtaatgttctcctggccccataaactcgttataaatttagtctggtagggaatgatctgcaaagatatacagaaacttcaggattttaagagagaagaaagaaaaggagcaattttttaaaaattgctatttacagtacatggacacatttttgttcagtcttaaatatataatcctgatttagttgtcgtgtatgattctgaaagaatagtaggatcctaaaacattgagatactttctgccttatgatctacatcctttgtttggggatatctcactattacaaatggtctctacaacactgacgtcatccgagttggttactacctgctattgcaggaggaacagagacctttaaaaagtgggactggttagagttttgacttgctcttaagctggtgttcgggtactagtgtctttttcttgattttttttttttttttgagacgcagttttgctctttttgcccgagctggagtgcagtggcacaatctctgctcaccgcaacctctgctttccaggttcaagcgattctcctgcctcagcctcccgactagccgagattacaggcatgtgccaaaacgcctggctaattttatatttttagtagagacgggttttctctatgttggtccagctggtctcgaactcctgacctcaggtgatccgcccgcctcggcctcccaaagtgctgggattacaggcgtgagccactgcgccctgccttattttttttaattaatttatttttttgagacagtctcactgtgttgccaggctggagtgcagtg

SEQ ID NO: 88079 - DNA, 1027 bp, Homo sapiens
cacggccggttttcgttaatcggaaccttcggggagggcttcgctttctcctgtgtgcatcccggctggtgcatccccagggtggtgggcttggccccccaggtgcccggggatcctttagggccccatgcatggtcaggtcctattgtcccattgatgggccacgcgctcctgtctctcccccgtggcatgcggttggtctcgctctcgcgcgcagccattggatccggagaccggatcgatcaggtccggcgggctccttaccctcgccgtgcccccactccttattcggacctacctgacaggtgcatgtgtggtcgagcggggctggtcatcgcgacccttcaccccccattgaggacccaatcgttcttcccctcttcgaagtgcctcccctcttccaagtgtctccccttcctaacaaaggaaagaccccttctccccatccctgcgctcatttctaaggcggggggcgggggcgggcgcggggaacgagccaacccgagtgggttttctgcgcttaaaccttcggaccgtggcctttgcatcctaccttcgcttcctcctttgacgtttgcccagtgagttcatccctggccctggttcccttgcaggaggaggtttcttgttcttgggcggggccggagacatccattgtctctaacgtggtagcgctacctgggaagcgggggatttttcttgcccttcttcccactgctttttgggcttggggcactgggtacagtgtttggacaggaacccttttccaagtccttgcttaacttacttggtggaagggtttggattctgtggaaggtgtccacattgtctcagctaattgcacactgttctttaaggtgggttacagttatgtctgggatcctcttcaaggcttggaagaagcttaaatcacttttttgagcatgtattttacatcgattatgacctgcattcatgtgtggctaccctcggggtcctggccaagtggcacaaagggagccattttgtggggctaagaagacacgtg

SEQ ID NO: 88080 - DNA, 1112 bp, Homo sapiens
cagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcattttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaatgagctgttttctttattctgagaaatattaaatagaaaattgaggcttagaaaaaacataaataggcctgcttagaagtaacatttcaagaaggaaataaagctacttggtgtttctgacagactgatactgatgccaaacaaagaataacagttttataaatatcaccttgttccaaaagtttctctaggtcccatgttaatatgcaagtatactagcagaaaaattgggccatagtatcgtggatttccaggtattttctgtatattaagtgaggcacggagcatagggtatagggtagcacatgtggcaaggaaaaagttctgattttgcctttgttgctgataaaacactgaaccattctagcctgcacttatcataagtaaatactccctaacctaaaataaagttttcgttccttattcaaggattttttttttgagacggagttttcctcttgttgcccaggctggagtgtagtggtgcaatttcagctcactgcaacctcagcctcctgagtagctgggg

SEQ ID NO: 88081 - DNA, 2073 bp, Homo sapiens
gtgcgcgccgggcgcgagttgggcgggcagaaagcggacgcccgcggacccaccagccccgaacggggattcttggcccagccggccggcgcgcgtgaggaggggcgttagggcgcgcggggtctccaccttctgtcgaccccgcgtcgggtgttgcagtctccgaggcggcgaggagtcctctgggctcgggcttcacctctcgggtaggaaccgcgggcatctggggacccctgcctggggccgcggcggcggggcgagggttcggggcgaatcaatgggctgcggacgggcaggaacctggatgcccgcgggccgccgtcctgggcctgggggtagggggattcccgtggagtatttcccactttaatagcctcaggggcccgaagggggaggggcagcggcttttccctgggtgccaacgaacccctaatccgcgaacaccatgtggtttcatgaagttggaggcacaggtacgagcagagagactttgtgcggcttaacttttgaacgcggcttttgaggcacccggagacttcccgggaggacttggggacacccatcatcggggcacacgggacttgctgcttttagtttggtggcaccccccgcctcccgcgcctttactttctggagcgttttagggctacagaattgcttctgcactcgattttggacaactttaggttgggtcgaaatctacaagaaacaaatcaggataaaactgtgtatttgacccatgacaacaaagggggggaggggagaataagtgctcttaaccgaaaataaaaatgaagctgctaatagaggagaacgttaactgtggtcctgactgagtattaccgctgttccggggggaatcgggatattcttcgattgttttttttgtttgtgtgtttcctttaatggagattggatttaggttattaaactgagtttggtaactttttaatgacaacggtaatgagttttgaatggcaggctgtagatttattgttttgtttcttgcagttgtacttaaagtgcttagaaaagagaagggactctatttttaacttttttggggggtaaagtattttgggagtgatatatgtcattttaggaagtttaacttcaagagaacgttgcaatacactgaataggacccaactttaaacatattgttgctactgatagtattgcatgtaggcttttccgtatctgacagctatctaatactgttactgcaggatttttccgctttcacattgatttcagcagctgaaaacagcagtatgccgttttagcatacagtatgagaaacctgttgatttttgaagcaactagggctgctgctgctttataaaacgtgttcgttgatcacatttcccaaattatacttttatttttcttttaacaggaaggagtcaagactgagaacaacgatcatattaatttgaaggtggcggggcaggatggttctgtggtgcagtttaagattaagaggcatacaccacttagtaaactaatgaaagcctattgtgaacgacaggtgaggaattcatatgtgtacttccactgaataaaactatttttaaaaatcttattttcatgggaacaaaaactagactagcacattacagtgactttttgatgggatgaatatgcacttggcacgtcagttttgtcgtgcacttggtatattgatagctcgtgaaaacccttaggatgatttggttagtattatatgtggttccagtcctgtgccagaaatccatcaaattatatttacaataatttttttttaccaaggaaatgtaattttatgtttataagaaaataagagtgaacttggtaaaattacttataagtcttttattattttattttatttttttgagatggagtttcattcttgttgcccaagctgaagtacagtggcctgagctcagctcactgcaacctccacttcaagcgattttcctgcctcagtctcctgagtatctgggattacaggtgcccactaccaggcctggccaattttttttttgtatttttagtagagatggggtttcaccgtattggctaggctgg

SEQ ID NO: 88082 - DNA, 1061 bp, Homo sapiens
gtagcgaggactcccagagttgggagacgttgtacgcttactgggacctaaatcccgcacgagttcccacccaagtgccgccgccccagcctacgcacgcgcattcgcaccgtctccagccccggggtcctcctgcccctcccgccgtctccgggggccttttctccgctcggcaccagggtgtccccggcgccgcctgatcctgttagcgcggtactctgagtgcagtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgaggtgcccgccctagggtcgcagtggtcgcggggtttctgccaccagtcacaaaccccggcctcgaaggtcccactccgtccctttccttcctttgtgttcctggcctttttacttcccttgcttttcctcttgggcattagagtgggttcagcccaagcagaggaatttatatttttattccagccgtattaagctctgcatcgcggcacattgagcttctgcctgtgtggcctaaggtttattcaacgtattatctcaggagactattcctgttttatcgctgtgcattcaattccatttgaactttgaagacagtatgtcaactgtggatgatctgtgatgtgtataaaaaaaattcacgcgctttatgtacgagatacctaccgtttctgctagttgga

SEQ ID NO: 88083 - DNA, 1048 bp, Homo sapiens
aaaactggaatcttgacatttgatttgctttctttttttttttttttttttgagacggagtctcgctctgtccaggctggaatgcagtggtgtgatctcggctcactgccacctccgcctcccggtttgaagcaattctcctgcctcagtctcctgagtagctgggaatgaaggcatgtgccaccacgcccagctaatttttgtatttttagtagagacagggttttgctatgttggccagcctggtctcgaattcctgacctcgtgatctgcctgccttggcctcccaaagtgctgggattataggcaagagccaccatgcccggccacagaaaatttttttagagtagattcacttttggagatgatcataatagatgttaaattttttttttctgtttggtttcagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcagtaagttggttgctgtttggtgttgaagcccacactacactgtggaaagccaaatgaagtacattgttgtctttttgtgtgttttatgggttgcgtaaagaaataagagactcctggttctagttgaggcatgagtactggacagtgtacattagcagtgatgggaagacttagcgggaatatgcaaatgctattgatgggctggcttgacaagctttatttatattcatattttacttagcctctaaagaagaaaatttaggccacacaagcatgtgagagtcgttgaatgaggtcacattgttgggagatttgaaaattaatataaacctaacagttttgtctctaaaaaattatggttcagacgttatttgacaacagaccagaaaactctcgtactatttatagattaggattttcttgaattgtagttcataacttcatcattatcagagtggtacttgttaattgtagac

SEQ ID NO: 88084 - DNA, 1594 bp, Homo sapiens
tattgttttagcaccactgtgtcctgtgtcctgggcacccacctggggtggctttgcagttcctgttatggcagaagtctcttcttttcaggtagataggcagctcctttgggtgacagtgattgtcttgcccccttcaaggtgtagctcacaaggaagtgcttgttaaatacttgagtgaatgttcggttccttttttttttttttgagatggagtcttgctctgtcacccaggctggagtgccctgggttcaagcatttctcctgtctcagcctcccgagtagctgggattataggtgcatgccacaccaagcccagctactttttgcatttttagtagagatggggtttcaccatgttggccaggctggtcttgaacttttgacctcaagtgatccacccgcctcgacctcccaaagtggtgggattacaggtgtaagccaccgtgctggccctgaatgttccgttcttatggaacatatatgtcctgaccaaattgtgttgaggggttgtcacctgaaatggagaagtaatcttgtgagatcactgctcggtctcataaacactcctcacttcttgaactcaacattttttttttgaaagacagggtctctctgtgttgtcaaagctggtctcgaactcttgggctcaagtgatcctcctgccttggcctcccaaagtgctgggattataggtgtgagctgccacacctggcaaaactcaagtttttttttttttttttttttttttttgagacggagtctctctctgtcgcccaggctggaatgcagtggcgcgatctcggctcactgcaagctccgcctcccaggttcatgccattctcctgcctcagcctcccgagtagctgggctaattttttgtatttttagtagagagggggtttcaccgtgttagccaggatgctctcgatctcctgacctcgtgatctgcctgcctcagcctcccaaagtgctgggattacaagtgtgagccactgcgcccggctaaactcaacatttttactgagttgcaagtggctctactttacttggagctggaagatgacttacagtatctttttcctcagtagatgcttcatattagatacttttcaaagtcagtagtgactaggtagtaattcactgtctctgaagtacccttatgaacaagtcatcatggtgtctgtggactgaaggatggtgaggaagggaagcctgcgtattcctaagggcaaggtccaggtctgatttatttcggggtcttatattgggctttcccgttaatagactgttcccctaaacttcagtcctttgaataccagcttcacaattcttgctctgtctacgtgtttcatgtcatctactgaatattcttctaaatattgtctcttctttttactcaaatgaagcaccttgctaaagcatcagttcatcaagataggctgggcgcagtggctcacgcctgtaatcccagcactttgagaggccgaggtgggtggatctcttgaggttaggagttcgaaactagcctggccaacacggaaactccatctctactaaaaatacaatatttagctaggcgtggtggtgtgcg

SEQ ID NO: 88085 - DNA, 1309 bp, Homo sapiens
tgttgtccaggctggtcttgaactcctgagcttagatgatccacctgccttagcctccgaaagtgctgggattccaggtgtgcaccaccagccccctggccctatgtttttatcatcattgcatacctggctgcttgctatctagtcattgttggttcctaaacggccattacttatgtagctattaagtatttgtgaagaatctggagtgtggggtagtgaggtctgcattccatgttcacccctttctggggtcagttaaagatggagctgcctggcacagaagtaatatttggtgaaagtgcatttgctttttcctagcacagtctgtcattcaggaccatgtgtgtgactgcttaaaagggataaacctatgtagtcagcttgtctgccttaaagttctctgttccttggataaaggaacttgctgcagatgaagctgaggcttttgtgtgtgatgagagtctctcctcccagctggccctctcctcctccatctccttgactgggtccggctccatgtgtgcgaggtggacagtttgtcggcagatgttctgggcagtgagaatccaagcaaacatgacagcttctggaacttggtaagacaggccgggcccccacctcccaccatgtgtcctactgtccctggtgctgccgggtgggtctgaggacacccactgagcctccagcagtaggctggcttttggagtctgttactatggagactcttttggatcttttcttccctgctctatgggagagtctaaaaccgaggtaccatgtaagaaaaataatgctttgaagacttttccagggtaaaaggaaatttgatttctttgtggatctaaggaagagaagacacaaaaaggaatacaaaaccgtttttttttttttttttttgagacagggtctcggctgggtgcggtggctcatgcctgtaattccagccagcactttgggaggccaagtcaggaatctcttgagcccaggagtttgagattagcctgggcaacaaagtgagaccctccatctcaaaacaaattaataaataaaaatataaaagagaaaagatagtccgactctgttccccaggctgttgtgcagtggcctgatcttgctcactgcaacctccgcctcctgtgcggtcctaccacctcagcctctcaagtagctgggaccacaagtgccaaccaccatgcctgggtaatgatataaaaccaattgacaggggctggggtgcatacagggttggatgtaaatgagcttgcacattactttggatcatcagtttcgaagtcagcatgtcgta

SEQ ID NO: 88086 - DNA, 2597 bp, Homo sapiens
agtgagtcgagatctcaccagtgcactcccgtctgggtgacagagcaagactccacctcaactactttctgagcgatttttttttttttgagatatggttgtgctctctcacccaagttggagtgcggtggcgtgatctcggccgattgcagcctctgcttcccaggctcaagcaatactcccaccccagcttctcgagtagctgggattacaggtgtgtgccaccatgcctggctaatttttgtatttgtagagatggggttttgccatgttgcccaggctggtcttaaattcctggactcaggtgatctgcctgccttggcctcccaaagtactgggatcacgggcatgagctatcatcacgcccggccccatctctttgagggacaggacatgtggggtttcttgctcacccccactcttgtgggacgcggcctgtgccctgattttccttcttgccttggtgtctgaatctgcagcatcgccctgagcaactggtggtttgtggcccacctgacagacctgctggaccactgcaagctcctccagtcacacaacctctagtaagtggccgggaggcaccgatcctcctcttcttaccaccaggcccccgagggtggtgtgaactgaatgcctgaaagggaggttgggctaagggggccctgaacagggcaggccaggagtcttggtcttttgttatgttttattccagtttcggttccaacatgagagagttcctcctgctggagtacgcctcgggactgtttgctcatcccaggtaggaaggaccccatgggtgtgggctatgcgggtgctcttcagcatgcgggtgccattggagcttggactgttctctcccagttggctccttgaaggcttcggaagggtcagtgaaagggagctgtaggtgccagtcctcggagccatgaggcagcacctcatgtctgtcctcctcgaacctttgcagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaaggtgagctggccctgctcccagcctactgtctgtgggacgcaggagtcaggggatcctgaggtcacactttatgcctaccccagccatcctcctcctcacgagccacactggagacgtggggctgtggacgccaagaggtaaactaagagatgggataattacttgggagggacaggaaagctagggatccactggaacccagacaaaatctacacgccatctggaaaggcctgagccgccccttttctcacacacttgattccacgaggtcagggctggggttggcgctgtttccctgtccaggtgggttgctattgctagctcagcctggctcaatggggaagcagtgctggaggtggctccagaaaagcagagagagtggaatgaggatgaccaagtctgccccttcatttctcccctcactgttgagtaatgtaaacatgagttattaccctgcagagaggcagttgcatgttcacgaccatttctgaaagcatatggtattcacgatccacaggaagatgtgatttgaggcatctggagaggtaatagaagagctgacacgtagggagaaacacgtagggagaaaaaaaatagaagagctgacatgtagggagcaacgttttgctccccttgaagccacacacactcatagagccagtcttgccgtgatgggcacttacactcttagcagatcccagacactgttaatcagccgagtttccagctctgccgatccagctgcatttagagcccaaagagtggctctgcggtggagtgaggctgtgaggccactccggtccccacagggctcaggaatggagtgatttgtggagtgaaagccgtttaccttttcttttcccctgcaaagttcgcagcatttgtaagatcttagccatgaaagccgtccgcaacaatcgcctgggttctgccctctcttggagcatccgtgctaaggatgccgcctttgccacgctcgtgtcagacaggtgggtgccgctagtgttggcttcccagggactgggtggttgaggtgggcctgagactgctgctctgatctctgggccgggccctgcaggttcctcagggattactgtgagcgaggctgcttttctgatttggatctcattgacaacctggggccagccatgatgctcagtgaccgactgacattcctgggtgagtctctgggttttgtgccctgtgctttgggcacaagtgggtagttggggaggttggagggatcacgtcagacttctcccagcgcttccttcatgtattcccattgcatcagtggtcccagaaacatcctccgtcatgtccaggatcatgagtttggctgtcacatctccttagtgcctccatgtttgtttgtttgtttgtttgtttttctttctttctctctttctttctctttctctttctctttctttctttcttcttttcttttattttttctttttttttttttttgagac

SEQ ID NO: 88087 - DNA, 1520 bp, Homo sapiens
gccaccatacccggctaatttttgtatttttagtagaaatggggtttcaccatgttggccaggttggtctcaaactcctgacctcaggtgatccacctgactcggcctcccaaagtgctggggttacaggcataggcatgagccaccacgcctggcctagtcaatctcttttaatccatgactcttgttatgtattttgactctgatgtttccccagatttggctcttcggagttcttccaagtctgttttgaatgctcttggtctgcatctcattgggacctatgagtttggagacagaaaaaaatctcctgctttgtggagtggctggtctgaggtttttcttctcctgtttagggccagggtgacttttgtaggtgtcacttgggcaatttgggggaatatgcaggttactcagtgctcttgtttcgccataggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgaaggttgcagcagcagtggttttctttgcttgtcagtccctgctagagcttagttgtatagctgttgccgatgtgcgtgtttcctcctttgtcgttctgcctgtgcgcgtgtattccccttagcgccctctctgggattccagactcacacaggaaacaaacactgcttgatttgaaatgaggtattcgtatacaaagcacactattgcgaagggtatgaaaggaagaacgtccgaacatgggcccctgccccaaccaatgcaggccagggctgggggcagccaagcaaggcaggctctcttccctaggtgattttctcagcagaacagacttatgagttgatgcggtgtctggaggacttgacgtcaagaagacctgtgcatggagaatctgataccgagcagctccaggtcattttcacttttgggttgatggttccacatggaggtgggaaaaggctccctctatctcaggcttccccttccctccagaaacactggctcctatggacacatgtgcctctgttccccttaacctgtgtaattcacacaccaccttcttttaggagaaaatcagggattctagtgttctcatctctacattttgttctttgctgttcatcatttccagtatggccctttggtattgctttcttttacatcgataatttgctggaagctactatgaatgttaagtgccctctacctttggattagctagacccttcgggagtgtgaaagggctccttcctgctcttagctcatgctggcgctctctgctttgcaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatata

SEQ ID NO: 88088 - DNA, 2262 bp, Homo sapiens
gacacatccctttgctgccttaggttaagtgtctgagcatggttgggggttgcggggaaaagggaccattcctctagcacagagagggtagcagaatagagggcgtcctgccaaggggccgcctgggctggatctcacttgctgccctctgtcacaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtgggggtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgtacttggaatcttcctagtatagacgccattcaccctgatggaggaaaaggtaccacctatgaattctagatatacatgaggacagcctatgatagaactgcccaaggtttttgttaaaagtgcgggttcctgtacgcttatattttaagggaactaaataaccaaaatgttaagtgttccagaagaggtgaggcaagatttcagaagcacaagtataccaccaagcgttcttgttcagacttccaagacactgcagtcaccacaactttggggttttttttttttttttttttaaacagagatggagtctccctatgttgcccaggttg

SEQ ID NO: 88089 - DNA, 2597 bp, Homo sapiens
ctgtctcacacacacttggacacctgcagattttgagtaggaccatagctgctgagcagccacgccattgctgtggagggagccttacactttctctgcctccgaactgcacttactaggtcctcattttcttttgccatgtagtacctgggggacagggtgtctgagaaagtgaagaccaaggttattgagctgctgtacagctggaccatggccctgccagaagaagcaaagatcaaagacgcctaccacatgctgaagagacagggtacgtgtctgcctgcccgcagcctccaggcagccctcgaaggctggcccaggcaaggagagaagggaaggtttgggatccccagagtccctcctgaagagaacagcatttgtccccaggcaaggctgagtcggagttggatgggataaggtgtagcagcctgccctccaccctgctaccctttgcaggtcttgatcacagggacgtggcccttggtgtatgaggaggggtgacaaggcaaccacagcctgagtgcacgtgctgccatgtcccctttcaggcatagtgcagtctgacccaccaattcctgtggataggacgctgatcccctctccaccacctcgtcccaaaaaccctgtttttgatgatgaggagaagtccaaggtaaaggacaccctgggcctgggattttctcatacgagagtgggtggcagcaggggaatgtggtttgcactgtgctgcggggagcctctggggtttccctggggtacgggtgctgcctcttcccttcacctctgatttcctcctctctcagcttttagccaagctgctgaaaagcaaaaacccagatgacctgcaggaggccaacaagctcatcaagtccatggtgaaggaagtgagtgggccccggtccttcaggcacggggtggaggagcccatggccacacagcagaagccgctttgccccggacacgggcctgttttgttctcccctgctgccagctgccctacctgtgccccggtggctgagagtgggaggaggagcacaatagcttccgcgggagcacggaagagaggagtgggttgggagcagtgttgtgaaagcagaagtatagactgggccccaggcaccccacactgaaaggagcttccgagcgtctgtacttgtgttgtggggtaaggtgtgacctggtggaagtggaaagacagtcaagtgacgctctctttctcttgaacttcttcactggggcaggacgaggcacggatccagaaggtgaccaagcgtctgcacacgttagaggaagttaacaacaacgtgagactgctcagtgagatgctgcttcattacagccaggaggactcttcggacggggacagagagctgatgaaggtgggaccgccgacggcaaaggctgcctcccggggctgcgctgcccttcaggagctcagccagcatttgctgagcacgtgccttgtcagagacacgggctgtgcacttggcagtgtattcatgaccttactcatctgcacagcagccacgtcagtagagggtggcgtccccatttgcctcctgggatcagctgacttgtccagggtgtaagggccagatggaaacctgagtctgactccagagaccacactctcggtgctcacccctgctctctccctttccttactaccttggggacatcaagacagagaggcttccttgtaaccctgatgcccatgtggtgcaggccatggttgggtggatattttgagttctgaggaacatgccagcctggaaggcaggaggggactgacttcccctgacccatcctggtgactgctacctagacaaacatcctgggtgatgtggtgtggtggtggtggctggtggcaagaagacgtgcgctgtgatcccagctttgctggtaattgaccgtggcaattggcatatcccggtcattttctgggcatgaaccctgaatgaatcagatgatctctaagggcctttgtggtttgatttttatgtccgagtctctttcaggagctgtttgatcagtgtgagaacaagaggcggactttatttaaactcgccagtgagactgaggacaatgataacagtttgggtgagtgaaagagcgacggtcagggataagccaggcatttggatatgtgggtgggaactgtcacaacaggagtgagaagtctctctttcctgctccaggggacatcctgcaagccagtgacaacctctcccgggtcatcaactcttacaaaacaattattgaagggcaggtcatcaatggcgaggtggctaccttaaccctgcctgactcggaaggtgagatgctctggtccccaactctaggctcctccagaccagcctcaggcccctatcatgaagctgcgggtgtaggctggccagcgtggtggtgttgcacaaggcccaagggagttctttgccattccaagcaatcctccggcttcccggaggcctggagatgtgggtaggaatttccccacctgctttctcgggcttgctttgcagcatcccctggcagagatgccgttggattaggccagaggctgtagcagtgacctctgtgcctagggtgctgcctcc

SEQ ID NO: 88090 - DNA, 1008 bp, Homo sapiens
gctctagcctgactgcattcaggtcctggaaagcgaaaagaggaaatatcatctggttcacatgcacccctcagtcatatttgctgtagaacgaattccttaaaacagtgattctcagcagggcacggtggcttgtacctatagtcccagcaccctgtggggcctaggccgggaggatcgcttaagggaattcaagaccagcctaggcaacgtagtgagacattgtctctacaaaaaataaaaaaatcagccaggcacggtggcacacacctgtggtcccagctcctcgggaggctgaggttgaaggatggcttgagcctgggaagttgaggcgaaagtgagtggtgatcacaccgttgcactctagcctgaccaacatagcgagattctgtgtcaaaaaacaaaaaaaaaacgtaacaaaacccagtgattctcaacagggccctccagggaacatttggcagtgtctggaaacatttttagttgtcacacatcggggtgggggtcctcctggcatcaagtaggcagaggccagggatgctgttcgacaccctataaagtgcagagtggccccccacaacgaagaatgaccagcccaaaatgtcagccaggcctcacctgagaaaccttgctttaaaatgcagaagccaagaaagagagcctggacagtgcactcccccttagaaaccgcagtgccagggaccacaggcagcacaggaaagccaaagcgtgagttagggagataagcggagggaggagaaatatcctgtcatctttctcacagataataggatttaaacatccctcccattccctgcacaattgttggtgagcttgtggaaaaaacccaggacaccaagtcagagaaactttgtccctggacctcacctccctcattgtaaaacacgaggccagaatctttaaggaaggcaccttccaggactggcatccaggccttcttggggtcggggtctcggggtttcttgctttagtccctgcccagcttcc

SEQ ID NO: 88091 - DNA, 1024 bp, Homo sapiens
ggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggt

SEQ ID NO: 88092 - DNA, 1103 bp, Homo sapiens
agatggagtttctccatgttggccaggctggtctcgaactcctgacctcagatgatccgcccacctcggcctcccaaagtgctgcgattacaggcattgagccaccgcacccagcctccttttttattttatttatttatatatttttttgagacagagtctcactctttcgcccaggctggagtgcggtggcacagtctcggctcactacaacctctgcctcccaggttcaagtgattctcctgcctcagcctcccgagtagctgggattacaggtgcccaccactgtgcccatctaatttttgtatttttggtagagagtgggtttcaccacgttggccaggctggtctcaaactcctgacctcaagtgattcaccccacctcagcctcccaaagtgctgcaattacaggcatgaggtaccgggcccagcctgtccttttatatttagagagcattctattctagtgatatgtgatttctcttgtgtggcctgatttccaggcactgcaggccctagccttgagttatttgtagaagcaggaggatctattgtcccagctcctcagcatcctggcagtagagtatgcaaaatgagaaagactccaagcaggtagatgtcagactattcagagttactaagagtccctagaggctgacacacacacacaaggacaaagttactaagggcagcttctaagtgtatccttcctagcagatcacatctttctgtttgaatttgagtatagtatattattttaggtacatcttccaatatggttgcttataagtaagatatgtaaattagccgggcgtggtggctcgcgactttaatcccagcactttgggaggctgaggcgggcagatctcgaggtcgggagttcaagaccagcctggccaatatggtgaaaccccgtctctattaaaaatacaaaaattagctgggcgtggtggtggccgcctgtaatcccagctactagggaagctgaggcaggagaattgcttgaacccaggaggcgaaggttgcagtgagccgagatcgtgccactgcactccagccttgatgacagagtgagactctatctaaaaaaaaaagggccgggc

SEQ ID NO: 88093 - DNA, 1044 bp, Homo sapiens
ggtgaaaccccatctctactaaaaatacaaaaattagctgggcaacgtggcatgcgcctgtaatcccagctactcgggaggctgtggcaggagaatcgcctgaacccaggaggtggaggttgcagtgagccaagatcgcgccactgcacttcagcctgggcgacagagcaagactccgtcttaaaaaaaaaaaacaactaatacttgccattcttctttctccttccttactgagggtttcattccagatgtttgggagcctgaattttcattttcagagataatttctgtttcattttaacagagtttaacataatgctggttgtttgaagttaaaaggagtcttatatccgtataactgataatacttcgagtgaaaccgttcacagacctaaaagatagcataattgtcttgtaactatctttttaaagggaaaaggaaatgattgggtttttttgttgtcttatttcttttcaggttttgaacgaagaatgtgatcagaactggtacaaggcagagcttaatggaaaagacggcttcattcccaagaactacatagaaatgaaaccacatccgtaagttaagctccattagtcttggaagggttggacccacctccttgtttcaaacactctttttaaaattgagatcactgggatggatgtcatactttttattcacgtttctagggaattaacaaaggatattgattgtgcatgttaatagtatataataatatatcatagtcaataatattatatgttttagattgataataactgtcagtgatcttcaaaaataaaacgatagttggtgcaggtccgtaattctttttctgttaaatatgtcttagagccagatgtgttttataattctgcattttttttgagttttagaaaaggtacttagatgattttgtgtttatatgtgctaatgctgtgggacggtatcttaatatctttgtatccccagagtacggtgcttggcatctaatagttctcaataaatgtttatccctccatcttagtgttcctacttacaag

SEQ ID NO: 88094 - DNA, 2193 bp, Homo sapiens
gctgcagagatttgggcatatccaaatagaatacaggcagcaatgaagtttgtgcagaggttggctctttctaaagtgaaactgtagagttagaacaatatcaaaaagcaaaccttgaggaatgccaaactttttttttttttttttttttttttttttttttttttttgagacggagtcttgctctgtcgcccaggctggagtgcagtggggcgatctccgcttgctgcaatctccacctcccgggttcacgccattctcctgcctcagcctcccgagtagctgggactacaggcacctgctaccatgcccggctaatttttttgtatttttagtagagatggggtttcgccatgttggccaggatggtctcgatctcttgacttggtgatccaccctcctcggcctcccaaagtgctgggattacaggcgtgagccaccatgcccggcccgctagtttgctcttaagctcagcaaaaattcagagttgtgatttaataagcgtgagacttagtaaagcattttgtaaatagagtataacattccttgcatttgttgtacttttggtttcctgaaataatagacagtgtatctatcactctcctcaccacaatccacatagctttccagagtagaaaagatactccatggagaaagtttagaagcagaaaatgaaatgagactgtgtggaagtaaaagtagcctatcctctgtaactgattttagaggtgacctgtgacctggcagttccttatttatgagtgggtacagggcacacattgaccaaagaagatagtttaggtgaggtgctaccctatctttgagaatgggactcttggctcttaaaattagaaaccaggagatctatgggatggaaaatagccttccctttcccccaaatcaaacagatacacatactttgtgacaggaatagattatgaaatatggtgtccagaacaaactgtctgctgggcttttaaaagggttttatactttctgctgggcacctagagcacttactctcccttctgtctccttttattacccacctcaagcagtcataatttttttcctttccattccctaggcttagccctcttccttcctctacccccaaaatgggaaagcctttagtatttaactgtagtactttatttggctgtcagtatttgtcatattagtaattgggtgagcttggctggaggtggggggctgttctgccctttttaagattggcccacacaccattgtacttaggtacccacacaggagcagagcaagttggctagattttgaatacaaaagcatgatattgtgggtgggagcatgtatagttttagaatttttaaagtaaggcaaaaaccatgtacctaatgaggccagtggaataaactttacaacagatagaacttctgtttctgtttaacacccagcaataaaaatgctaagaacagggataaagtgaaaattattaagcccttgtatctattgctgactggtaaaaccaacacatcaaaaaatatcttttggctcccaacttgttaatagtttctgacttacgtgtgttctgagtgatttggtggagtgaatgagctaggtcttgatttttccctcaaaggattgaaatttggttcttggagggtgaaaaaacaaaactcaactcttcatgcataaagcacagataaacagtacagtacataaatatatgtgtattttcatctgtggtatcagaatttcatgagaagtggtaattaaggaaaaaatgtctacaaagacatggcggaggtgatgatgattaataaaaagactgagatatggggctctcccctttgaggacctgtaggacctacgtatctgtgtcctggagaggctagtggcccttctttatttttctcatctctaaaactgggcctgagggtgatgaatggtgtcactagctgaagtgcttcaggaatgccagtgggtactcttaggattattatggcacaatgtatgtggttctgacacttaaccaggaatacaagcagtgctttacatactttccttgtattggagagcctagtggttgcattaaacatgagggaaaaaatctgaaaaaataccaagtatgacaagaaatgaatattattttaataatcccttttttttttttaataaagacacagactggtctcgaactcctggcctcaagca

SEQ ID NO: 88095 - DNA, 1010 bp, Homo sapiens
gtcactgcccaataaacattccaagtttccactagtttttgtttttggacatttgttccatccaacatcgtggtggcattatattttagtagattgtccaaacatgggtaagaaagatcaactatgaaaggaggtgtcgaacacattggctttcccacctgaatttgttctttattctttggatgtataaaaaacaagaataaaactcacagggagagtttgaaggaactgtgaagattcgttctaatttacatagtttacacaacccatagccctagggaaagtgccaaagaacagctttgcagaggactgaagtcctcctgggaagaagagtcccttcgcatcagatggctctcttgagtttactttgctgctaaaaaagtgagctggattgaggggaaggttttctatttttcaagctttgccagaacacttggcttaacaaacagctgtttgaagtcttaattgtgtctctgtatttccagggacgcgttctgacctcttattagcaacacagctagggctggctggcatgctttgtggtgccaaacatagctgtaccagcctggaaggtatccaaaccgaacaagatattgaagtcagaaggaacaagtggtacaaattctctcttagtcagagtttggaaagccttcgtattgaaattcatgcggacagatttgacacacttctgaaaatttttttcatcaactgacatttcagttcttccaggcctggaatagtgggtttcagtcaacaaggcaccaatatctttttaaatttgcccatagtagccagcttttggggtgtatgaatattagtggcagccttggagcttgaacgttgcatcaatgacctctgttaacagctaaccatatgatatccacaaaataatgaatttacatttctcatgggccctggctttagccattacctcgagagtcagtctgagcatcacttttaagcattcattcattgagtgtccctgtctcttagtactgtgatggtccatg

SEQ ID NO: 88096 - DNA, 1070 bp, Homo sapiens
gtagctgggattataggcatgtgccaccacgcccggcttattttttgtatttttagtagagacagggtttcaccatgtcggccaggctggtctcaaactcccgacctcaggcgatccacccgccttggcctcccaaagtgctgggattacaggggtgagccaccatgcccagctatcagttttattaaaagaaaaaagttacattcagatagtaagcagtttacattctgcatctagtttaccttgaaggatattctaggaaggtgaagtgctctgctgaggagtggttttgtttcttaagcgttgagatttaacctgattttaaatcttaggctgaagttcactgtgactgtgctcaggatcataaaactttgagacatttgaaaaactgacccaaaatgactttttgaggaaaaccttcgtccttttggcagctactcccttaattttacctccttctggatgtggaatgagagacatctgaagtattgtaaagaatactggctctaggcgagacctgcctgcttggaatcctagctctgtcacagacagatcgggcattgcgatcttgggcaatttacgggatggctttgtgttttggttctgacatctgtaaaatgggaacaatagtttcctaccttcctggggtcatagtgaagactaaaagagccaatatgttggtgttttttgttgttgttgttttctttttgggaaggagtctcgctctgtcacccaggctgtagtgcagtgtagtgtagtggtgctgtcttggctgactgcaacctctgcctcctgggttcaagcgaatcttctgcctcagcctcttgagtagctgggactacaggagcgtgccaccacacccagctaatttttgtatttttagtagagacgggctttcaccatattggccgggctggtctcgaactcctgaccttgtgatccgcctgcctcagcctcccaaaatgctgggattacaggcgtgagccacccgcccagcctatgttggtgtttttaaagcagtaactagcataaagtagacagtaattgctagcttttagttttattaatgc

SEQ ID NO: 88097 - DNA, 1070 bp, Homo sapiens
ataaaagcttgtgtttttcttggctcggggagggagaggacactgggatgtaaaatagaaggaattgcccttccactgcaggtttcaggcctggtgtggttggaatacatcagaattcctcccaccattgtagggcaggcttgagacagtcccagaggttctccactgacaagacccctaaatagtctacactagagcacataaaacttacctaggagttgcaactgccatttaggggcttatgtatacatacttcaaactgtgcttataggaattaagagacccattttgagctctcagatctgtgctcattccattctagagccagcctcttgctttcttcagctctagtggagagccagcctggatcatctaggtgtattctaccctctctggcactaactacctttaccagtttcttaaactactttaaaaacaggtcttgagttcacattgagatcttcaaagcattctgtctcagcactgcctggcctatttcagtgtcacactgactgagcatctcttgagccagatactgggataagttgctttgagagttgggagagaaatataagatgtactttctcccttcagaagctccaaaatctcaagtaagagaattgagattaatatgtgaaacagtacaagatggtatataaaaatttttttagaacaggaaaagatcttttaaaatttatttttatttatttttttatttttttgagatggagtctcgctctgtcacccaggctggagtgcagtggcgcgatctcggctcactgcaagctctgcctcccgggttcacgccattctcctgcctcagcctcccagtagctgggactacaggcacccaccagcacgcccggctaattttttgtatttttagtagagacggggtttcaccatgttagccaggatggtctcgatctcctgacctggtgatccgcccgtctcggcctcccaaagtgctgggattacaggcgtgagccaccgcgcccggcaagatcttttaaaatttcttaagttagacttactcttttacagatgaggaaatggtggcccatataggt

SEQ ID NO: 88098 - DNA, 1174 bp, Homo sapiens
ctgacagtttaaaaatcagcttctataccatgtgcagcttattttgagccccactatttatgtgaggattcgctctcccccagcacatgttaattatgttgtttacccaattgactgtagcagtttgctcttttggatgtgtaatttattttaacgaggatgagtgttatcaaagagtatgttaactttaaaggaggaaaggctgaagcttcatgtttgagtgttccctgtgtctcaagttttgacatttttccttctgagccttagactgattgttggaatttgctacctcatttgtttactacccctgaatgaaattcttagaattttatgaagagaaagcaagtggagatgtagaaatatggttctttataaaaggacgtgcagtctttttacttttaagttatgtggacttattgatagtctttattttgccctcattgcccaaggcgtagagttctactctgaagttaactgcccagtaatttcttaatgttagaaatgtaggttgagcctcatagaagatgatgctgcagagccctttaaagagaagaaaactttgtgtctgtgtgttcatttcaaagctgtgtttgtgacaccacacttttcgagggtattctcaaagtcaacactaaattgtcagaaagcagacggaaccattttctagaaactaggtttctattttcttgaactagagaaaatatgcccagctagagatcagggcaaagttaacttagactacaaaattcctcagttttcattggtgtatgggagaggtaatttgatgtttctgtaggtgattactgttttctgtagataacccacttgtgatggtataagatgggctactcaaatgcccacatctatagcctgtacaaaagcccttttgggctagtattttttgtttttgatacaaacttagattttttcataagtttatcttagaaacttgaacctagaaggctggtggttcatatttttctctaaatctgtcccattgcacattaagcactgaagcaacaaattaaaacaaaactaggggcatgcggtctctttttaagaattttttttttttttttttttttgagatggagtctcgctctgtcacccaggctggagtgcggtggtacaatctgggctcaccgcaagctccacctcccaggttcatgccatt

SEQ ID NO: 88099 - DNA, 1798 bp, Homo sapiens
gttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacggtgagtacgggaggctgcgctcggcgcctctctcgtgccttttcctcttggctctacagcgggagtgggccccgggggaaccgggaccggccccggggttcgcgtcggggcggcgaggcttgggacgtggagcgcaatccccggggctccggactctacgtttccccttttggggcgcttccttcctggggaccgtcctcctccggctcttggctctgggcagtccgggggaagaggtcggggttctctggcgaggtcccctgccttcatcgggagggtttgcacggaaggggcccgggaagcccaggcgggccgaacgccgaccgagtcagtctacccgagcctggcggcgggggactggtgtgggctgcagctgtggtgattgatgtgccttcgacctgcacggcaaccacgtcaccatctcctggcgtctttgggcttaattttgtgcgggaatccactttggggtggaacgtttgctgctggagccgggggagatacctttattctgacacttaaaaaaaaaaactatttgaaaaatatttgtcaagaaaaattcagcagtagcaggttggactgcaccgaggaaggattgcggcgagagcgggcgctggtaattttcatttgcagcgcgccctctctatgattgtaagccacacatgagttatggcttgtttagaaagtttttcaaggctggcttcaaacgctgtgaaagtgcagtttgcaggggactgaagtgcacttgaggtctgtctctttttgatgctgttgactttccgaaatgtcagacacatgagagaaattagcattagtctattttggctttcttactcctctttctccagttatttccttccttctctatctgcttctgtcctttccactagggacacgaaatgcttgtgtaatgcaagtcatttgccccttcctccccccacccccccctttttttctaatgtacttccccttcctccttgtagtccccactctggcgtaatttttcgaggtttcttccctttcgtgctgttcgttttctctcatttcaagattccgtctttttcctcgggaagagactctctttccttgctttcgttcctttacttttgcgcgtcccctgcgttccctgcagtcagccagaagggttgctagagagccgtgggaggctgaagtcccctctctgagaacggggaggctcaaaagattgaattcatccctaagaaatcagtcctgccactaggtcgcaagtgtggtttgcttgtattatttttgtcttttactctttttcttttaagattatgcttctgtgcctgcttatgttttcttctagtatgtctttataataggaagattgggtcagctcagtgactttttttttttaggcagagttttgctctttttgcccaggctggagtgcaatggtgctatatgggctcactgcaactctgcctcctgggttcaagcgattctcctgcctcagcctcccgagtagctgggatcacaggcgcccaccaccatgtccagcgaattttgtatttttagtagagatggggtttcactgtgttgcccaggttggtcttga

SEQ ID NO: 88100 - DNA, 1014 bp, Homo sapiens
cccctattctcaaatcctgaccaatcggtggcctgaactttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccggtaagtacgagaaggcccgtggcccgaaagtggggagcaagggggcgtggggctcggccttgcgcgtcctttggattcttggccaaggaaaggggagtctggggtctgcacccagagaacggcttaaggggatgcctcctgagggggagtccagggactggctctagtctccagctcttgaccattgccttcccccgagtcttcagactcttgctctcagccctggattggtccattgtggggtctctcgccagaaataaagcctctcgccaacaaagaatccctgccccaggtctgtcgtgcctaggccctggcccagagggctcccaacgccgacgccctgagtatttatttcgaggcccctgggagtcctcatccccgacctaaataaagaccgttgtcccgcctgcgcgcgctctccgcagccgcccggggtcctcgcgcggccgtccccagctggatggagccggccgaggggctcctggcagccatccctgatcttgcagtttggagcgggcttttttttctttccgcctttccagaagcgttttcaggctcctcggaagctcaccatccatgccatcggataaagtgactcctgtggaatgccctcgttcctgtaccgcacacccctggagcccaggtctcctggttcctagcatgccacgatgcggcccctgcccgctgcccagcgccagatgcaagcaaagccccgctctttcattggtgtgtcaccgcgggctaaactttggcgttgccttggtcacgtgctgctacatcccaccctctctcctgagtttttcggtggctctt

SEQ ID NO: 88101 - DNA, 1019 bp, Homo sapiens
caaacattgcaagtcttagctgctatgttagctctaacttccttgctcactggttctctttgtcaaaactgcaaacagggaaactggtggatactgtggagtagtgcaatgaccagggaggtgaagtacaaaccatcttcttcatcatcagcccccaaataattgagagttaactgcccttgaaccaccagaccaccatgccccttgtttgtggtgacttgacatcagatgagactgggagagccaggccttgacagtgaaatggaagagaaaccccatggcatttctattttgagaagttgctaggtgtgccagctcctagtgctgagaaccagccttttggaaaccttaactcctgtagaaactaatgagaaatgaaggttgtgatcgtcctgttcctgcctgctgctctctccctaagttgggcttgagaaacagtttctataggagagggaggagtcctaatgtaaataccacctacacccaaggctgtatgtatttagcttaatctgatgaatcaggttgaactcgtaccttagcagtctaagcctgaacgccataaagcctttaagtccattcctggtgttcaagtgagaaggttctgggtcaggcgtggcactggttggtaaatatgtgtcaatatttcttatcttactattgtgttagtgttgtttttacgatggtgtctttctttacccaaatgataggatttaaaaatattgtttaaagcccgtttccaagcaggcctgggtttgtttatagcagcacaggtgaactagagggtaggccatggctgaaacaggaatgcttttcttccgagcagacccgccagccagaatgtgtggtttggtgatcaggggtttgtgtaataataagctttgcctgtggccactgagacggtagtaaacagtatgggtcacatggcatgacaagtaggttaagggccagatttagacactgatggcctgcgtaaggaggagcaaaccacacactgcttgctttgggtttctctagctccc

SEQ ID NO: 88102 - DNA, 1029 bp, Homo sapiens
gctcctgtttcctccctccttctctttcctcttctcccctccctcccgcccttccagggctgctgcctcctcctccctccctgaatctgcagcgtgactagaaataggctgaattaatcagcagattgaagctctgctctgctgcgcctgattctgtgcagcacccggcttcttgctcacacactctcagctgtctccgtctcttctctcctcttctctctctctctcttttcaccctccccgctttgagggaggtgttggaagttcttgcagctgactgcttgtggctcagactctggcccatgctctttaagcaggcagagctatggatgccccatcagggcaaaggcaacaaagtgagtatgctggcagggcttttacgcttctctttaaaatgctgtgttccctgctttgtgtgggagtcttcgggttagcggttgctgtgagagtcctgaagacaatgcaaaatgggaggctgcttgaatgagcatgggtagctgggacctgggaaggggattgggaatgagagccagaaggccagtgtgcctgggtagctgccagccaggtgcccgagtcacccagagcaggactggacccaagcctcccaggggataccctgccaaggcatgtgaggacctgggtttccatgcacaggtgacagaagctcagggccaggatgccatccctcctcagggccaatgaaggcactttgaaggcacaaggaaggaccatgtggggaactaagacaagagccaccagggtggggaggattttttcctaggtcctggtggctacaggaggtggggaagaatgtgggtgaaagtactaaggtcagcatgagccaggaaaaggaggaagcagctctgctcaaggctctgatttgcctggctgcagacagtccatctgtgtctggcccaactcagaagagtgtatagtggctgaatctctgcttccgtgattcgggcattgtgtggagtccagctttgtgtcgcttccatacctgcactgacgacgacagtggggacccag

SEQ ID NO: 88103 - DNA, 1230 bp, Homo sapiens
caaaagatagcatctctatgttagtttccctctctccatttaaaaaaagatatattttaggccaggcacagtggctcacgccagtcatcccagcactttgggaggccaaggcgggcagatcacttgaggtcaggagttcaagaccagcctggccaacatgatgaaacctcgtctccactaaaagtacaaaaaattagcccgacatggtggtgtgtgcctgtaatcccagctactcgggaggctgaggcgggagaatcaccagaacccgggaggcagaggttgcagtgagccgagatcgtgccactgcactccagcctaggagactaagcaagactctatctaaaaaaaaaaaaaaaaattgtccatgcaatcaaagactggcccccttgcaataaattgggagatcagtggtgagcacagcctgggtgggcagggagctcgccaggggcagtggggaaagtgagttggggaacatggaataaaagaaaaagttgttttgttttttaatttggctgtaaagagtagggtaggaggctgtgcacttgaacagtttgtaatttggtggagatggacatggtcacaccttgagaggccagagctggtaggggaagagatgtgaggatcccagaggaggggaaggatgaagggccagggaaggggagggttggggcccgcgtgccttgcatagccttggcctggcagtgacgcccagcgcctcctgcttgcctgcagggcgagcctccctcagccctgggcctgtccacgcggaaggccctcagcgtcctgaaggagcagctggaggcagtgctggaaggacatctcagggagcggaagaagtgtctgacgtggaaggtgaagcttcttctcggggctaccagggcctggctgggatggcagggaagtgtgggaggccccttctcaggactctgatgtaccctgtcaccctggacagtgtgacccaactgaggcctcatgaaatatcagaaagaagccaaggttcccctcagagtggctcctgagcctgcttgctgcaggagcccaacaggctggagcccagccgaggtcaaagagaggggaccaaggcggccatgggggctgggaagggtgccgggggaggcagccagattggagtgggacaggcctctcattgtcccctccctgtccgaacttcccaggaggtgtggagaagcagcttcctccaccacagtaaccgctgctcctgcttccact

SEQ ID NO: 88104 - DNA, 1056 bp, Homo sapiens
gaccacaagagtcagctggcactgcagcaggaagaggaagcacttacggatgccataggtggcatgccgagcctagggaccaagagggacagattatggcctgggtctacctggcctctcccaggcccaacagctgacacactttagccaagagccagacgcccaggatgcttctacgaggggagcagaggcgaatgtaactgcctgggagagcccgctcggagggctggggaatgaggtccccgggttcaaacaggtcctttgctgctactcccaccccaggcgggtcctgtcctgcgtctctcctcctttgcctgccgaagcacccacctgttcgataagccggatgatgctgatggtctcctcctggcgaaaggtcagggaacagggcaggctgttgagctgccctgacagctgcaggggagaaaggccatccgaggcctgggccatgctgatgctggtggcgtagccaaaggtctcccaggagcaacgggatgggtacaggggatccagggcaatgctgctcagggtgggggacacacacacttcagctgtatctcccacaggactgggcaccccaccctcttctcccaccatgcccaggtgcattggtcccagccagggcgaggtcggctatagtacacacccccagccccacgcaggcccatctgatcctccggtctgggaggtagaggctggcccgcaggctccagggtcccgccctgacctgatgtcgctctggaggaagaggcagctgttccgcaggttggcagagctgcccaggcagcaggtcacctccccgtactcttgcatgatctttatcatctcacacatggctgaggacagcgtataagggcaccagagtcaggcaggcagagcaccaagtgggcactgggcagagacccatgggacaggagagcaggaggcgatgggaggtgggcccctctttgaaacaatcccacccccggcagcgggatcatgtgaacatcggcacttctgactccaacccacaagattccccagctgatcccagcccaggttcctttactccctgca

SEQ ID NO: 88105 - DNA, 1102 bp, Homo sapiens
tcccgctgccgggggtgggattgtttcaaagaggggcccacctcccatcgcctcctgctctcctgtcccatgggtctctgcccagtgcccacttggtgctctgcctgcctgactctggtgcccttatacgctgtcctcagccatgtgtgagatgataaagatcatgcaagagtacggggaggtgacctgctgcctgggcagctctgccaacctgcggaacagctgcctcttcctccagagcgacatcaggtcagggcgggaccctggagcctgcgggccagcctctacctcccagaccggaggatcagatgggcctgcgtggggctgggggtgtgtactatagccgacctcgccctggctgggaccaatgcacctgggcatggtgggagaagagggtggggtgcccagtcctgtgggagatacagctgaagtgtgtgtgtcccccaccctgagcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggtgggtgcttcggcaggcaaaggaggagagacgcaggacaggacccgcctggggtgggagtagcagcaaaggacctgtttgaacccggggacctcattccccagccctccgagcgggctctcccaggcagttacattcgcctctgctcccctcgtagaagcatcctgggcgtctggctcttggctaaagtgtgtcagctgttgggcctgggagaggccaggtagacccaggccataatctgtccctcttggtccctaggctcggcatgccacctatggcatccgtaagtgcttcctcttcctgctgcagtgccagctgactcttgtggtcatccaggtgaggtggggcccgcacaggcattgcccccgtgccactcaccccttcactcaggggccagctgaaaatctgaggaaggaggctggggttagcagtacagtcaaggggtccccccagagc

SEQ ID NO: 88106 - DNA, 1049 bp, Homo sapiens
agattcggtgagctgtcagcagggcgcctccctctgggctcaggcatgttccctaaacctgttactcccttggcgacactcccccacctttccgctgcccatccctccctcctcctctggtgtcctgccccggcccctggtctaaggatctttgccaacctgtactttaatctcctgccccaccagggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagaggggccctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtct

SEQ ID NO: 88107 - DNA, 1050 bp, Homo sapiens
aagcgggtgggcatccctgcagcccgcctcccctccgcacccacccccctgcgcccaggcttctcccggacaccgcagcctcctgccgaagaacccccgcaccctcttacctacagccagcttcctcgggtgggcctcagcccagacagcccaggtacatcctcccagggggcagtgctgggcactgtgtgggcgtgtggcctgggcaagctgccagacagctgtcagagcgacacttgggactctgaccccttggcttctgccccccacagcaggtgacaggaatagtgtgggcagtgagggcagcgtgggcagcatccgcagtgccggcagcgggcagagctctgagggcactaatggccatggccctggcctcctgattgagaacgcccaggtaggatgatggggtcacggaccaggtcagggctcactccccactgccagttccccaaatgctgagttggctcctgccctgtctcctccagccactgccctctgctggagaggaccaggtgctgccaggactccacccgccgtccctggcaggtaggaagggtcaggggacctgggttggctaggagaggtgcaagtaaggaggccgagggtgggcaccccttcctcctgccacctttccattccatttttctctctccttgaagacaacctgagccaccgccctctggccaactgccgctctggggagcagatcttcacccaggacgtgcggccagaacagctgctggaggggaaggtgtgacctccacggggtgcaccgtgggcctcgggggggaaggtgtgacctccacggggtgcaccgtgggcctcgggggggaaggtgtgacctccacggggtgcactgtgggcctcggggtgggtagggcagggtagaggcaagagcctctgtatggactgaagccccgctcaggcaggtcctgagcccctggtgggggctagggccttggtccagctcctgctaattctgcccccttcccccaccccgcaggacgcgcaggccattcataactggctaagcgagttccagctggaggg

SEQ ID NO: 88108 - DNA, 1035 bp, Homo sapiens
gtcctaaactagatggcagactgagaaatgtgactcccctccccagtaccttgttttctgtgtccttgtagccgtggtccttcagcatatctctgtgctgcagacaacacaccttcctgatggaggtgcccggtaagtttccaagcagtgccgtctctgcagtaccttgaccgccaggagttggtggttaggaactggctcctgaagtagggtgtaaactagaggactgttccagggactcctacccctacgcctagctctgagcaataactagtgttcgtgtgtgtctagggaagagggagaataaccagtgggttagcccaagggttcagagcccccaaccctcaagtggcacctctgtgaggctgcttcctggaactggtggagggaaagggtgggatggaaaagaaaggttggggagaagagttcatgtcataacgtttctcattgtattgtcaggctgttggagaagtctgggggcttggaaatcatctttgatgtttaccaggccgacgctgtggccacattccgaaagaataaccctggcaaaccctatgcccggatgtgcattagtgggtacgcagtgagccagcactgcccctcccccagctgctgccagttctcctgtgaaccaagtgggactcctctgtactcccctggccagcgtgccaatctctgagaggaacaggaggtccagagaggctaagtgacctacacaaggccacacagccagtttgtgctgccctactctgagctcctcgttgctggcattttagggtagtctttctccaatgccattttagtctaggactcacccagcagaagggatgtggattgtggggatttacaggctaagagtggtgagcaccttgctcttcctagcacctccccaaccagtgctctggggcgctcttcatcagagccctgtgttttggagacagaactcatgggtcagaattcttgcaccccaactccttccgtagaatctcttctctgggagccctagagcttaggagtgggctatggctgggtctc

SEQ ID NO: 88109 - DNA, 1045 bp, Homo sapiens
ctgcgtcggaggggatgggacgtcgcaggcttcccgaagggaggagggaggacggcgcgccatcggcccttccctgggcgcagcggggtgcgggtggcgagaggcgccacctgcagctgggcggtggagcgcgctgcagccccggcctccgcgccctttccgctcccgcctctcgtcgctccaacctcctccctcgcttgtgctaaaaattccacccgctgttgcagaccctccggccgacacggaggaggtgggcgcccccccgcacccccccccgaggaaaggcgtctcgccgcgacgccccggtccctacaccatccctctcgtggggctggaaacccggccctgcgtcccccggtcaccctctctgggctgggctctggcagaggagctggcccggatccgcccctccctcggcagctcccgggagttggagggacggctcccctggagtctgggaggcggcccgggaccgcaggcgttccgggaactatttccgcttgcgggaggcggcgggacactgggcgcggcgcgccgttctgcgtccaggtgcgcgcaggtgaggccggggcgggcctgcggaaccccgaggccgttcgcgaggccccgccccgcgcttcccggggccgcggattggcaggagcgcagcccccacccccgagggtgcccccgcccctgcggcgccgagctggggggcgggccgggggcggggcgctgggccccggcaggctcgccctttatgtaaatagcgcggctccgccccaggctcgccgcgccggaggtgagcaggaaggagacggccgcccagcagcccgtgggcaggcgcggcggagcgagcggggccggcggcgggcgccgagggacgccgaggcctcgggcgggggctggcccggggttccaggtgagatgcgtgccggactcgcccagccgggcccgccccctcggggcttccacctggggcggggaggccagggaggcccaggacccctgggctgtcgggccagggcgggagggctgcgcccaggtccgcgcgcctcgcccctgt

SEQ ID NO: 88110 - DNA, 1024 bp, Homo sapiens
tgaactatgatggcgccactgcactccagcctgggtgacagagtgagactctaactcaaaaagagaaaaaaagtctctaggggtcagaagtttttcagcgaggacctttttcaggaattgagggcagcagtggagggcgcggcttctcctaaatggaccttgcattccagtggcccttgatgcttcccttgctccttgggagggccaagagtgagagccggttgcctgggagtctttcctgtggtggggatgtcggagagtgcaggattaaacctgctgtgagttctgccccagctgaggagtgcttgctgggtacaccctcctcaccctgctgggtggcagggcagagagcacaggcctgtgctgctctgttggcattaggagactttctaggaatgccattgtgccccctttcaaccttgcttggggagaggatgtcctctcctgccaggacttcctggccccgggaccctccctttggaagacgaagtgctgcctgggaccaggtggcccatgagcccctgcccgcactgtgggagatctgcgcatctctggcaagagcctccaggagccatctaaggagtttagtttccccggggagctattcggccttcctggtctttccagatgagtcaaaagcagctgttgagacctctgagttgggggccagaatggaggcccaagagaccaatgttctttctcctgggccggctgctttgagcagcactggcagcctggactcatttgtcctcaatcctcaactctgagaggccctcttatctgtcttaggtgatatcgttctcagggttcctcctggggcgaggcacgccaggtctgcttggcaacgctgttttcctctgtcaggagcagtttgcagagagaaaactggggacagggcaggagacgggcgtcccccagcggggccaccagcactgtttgccctccccagccctggctccctaggaattccaaggagaccctcgctcactgtgcccgtggccatggctttgctcaggtccctttg

SEQ ID NO: 88111 - DNA, 1027 bp, Homo sapiens
catctgcaccccgcctcctccatccgcaccccgtgttatgctggagggtccctggcgtctttcctgcctcctagcccaggctctctgccatctgtctcctgtcttggcagaaagtgaccaatgtttgtcctggcttgaaatgttatgacctcattaaagggccttatgggcttgttttccgaggagtcaggggaccccgtccatggcatctcccctgctgggcagtggtcggctcacgggcagctgttcttgtcacagggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggtgagcccagagcccagctgctgttaactccatcccctcaagttaggcatggcttctccccttggtcccaggactctgtcaggagctgtcatttctctgctgggaattccatggggctatagcaggggaggctcttggcttcctacctgtcacctactgagaacctattggcctgtcataggttagcatcatagcactaaaaagggggctttgagggtccctcgtctaaaggccccaaatgactgtgtaatgtcaccgactgtcagtccagtgtcctttgcacttgccatgggtttcagaaccccaggggctccgcagcggggaagtcgggcccagacctccctgtgtcactggggcagctcctggtgccaccctttgcggtgggtactttgctgaggttccatttgctcgcaagctccgtggctaaaaagccttgaccgccacaggcatgtgggtctgttgagatcgtttcagaagctttgctccttgttgatgatactacattagagagggagttggatcaggtccgggtgggagaaggggacggggcccaaaaaaagagaggagatagcatctgacaagatcatgttggggccgggtcggtcatggt

SEQ ID NO: 88112 - DNA, 2801 bp, Homo sapiens
cccatggctgtgccatgctgggggccattccccctggtggacggcatcggaggctcacggcactcccctcgcccaggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccaggtaggcagtgcccaggacatggcaggcgccatgttgctctcccagggccccaagtggcacatacacactgtgcagaggcatggggtgcaggcgatgggaacgccgcctcggtccagcgtgctgccctctgtccctctcctcttcctccatagcaactggagaacatctggtggcagcgggacggccgcctgctcgtcagctgtcactctgacggcagctactgccagtggcccgtgtccagcgaagcccagcaaccagagcccctccgcagcctcgtgccttacggtcagtgtttcacccgccgggcagggcccacccccagtgcctcctggattcaggtgcaggttgctcaattctgaagcaaactccagggccagagagggtaaaggctttgtccaaagccacacagcagggttcgcctcacccagtttcttggggaacttctcggagcaagattcccaagcacaggtctaccatgtggatgtggcatgagctagagggatctgtgcctgtggggactgacacttgtctgagagtttgaggatccgttcaagccgattcctttcctttcaggtccctttccttgcaaagcgattaccagaatcctctggctgaccactaggcaggggtaggtatccatgctggtcctctttcctctccagagccttcctggagggctagaaaggtcacttaggcctctgcctgggaagttggtgccagtgaacactctcaggtcccgtgttggggtcttggacaccagggaggggagacagggtagacgctattcacgtctctcagcggcccaattcctgccaagttcattcttgctcctttcttccaccttcccagagagacggtactgagcagcaggtcttaaactcctttagttggcagccctgtttcttcagacaaaatcactctgggtgatgttcaaacagaattggtgggggcacccagcatgaggcaggagtggctgctgagactcagagcccccagcctggatgccctcaccttacctccaagtcctcctgggctgtagcagttggaaggagatggggtccagtctcccctgctcctggggaccttgactgagtggtgactttgattgccggcctgtggctgttgaggctgtgccaggagccccagcccactgccgctcctctgtgcctgccaggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggtgttgtggcacgtacctgtagtcctagctactcaggaggctgaggtgggaggatcacttgagcctgggaggtggaggttgcagcgaaccaggatcatgctactgtactcagcctgggtgacatagccagactgtgtctcaaaaaaaaaaaaaaaaagggctctgcacagatgttcctaagcctaccactgtcctgagtcccttagcctcactgcaccccaaggtgcagtgtcatcaagccctacagctcctttctctgcctccctgccaccctccccagctagagacccagcccagccacacctcctgtctgccccgggctctctgccctttccagactgtaatgggacttagcccacagggggctgatctgtactgttggatttaacacccaccccgctgaggcaagagggtcctggcttagagatggcaaagcccgccttctgggcagggcagaaggtggctgtgcagcctcctggagctccagcaggaccggcagagccctgagtcagcctcgtaaattgtgtgacaggcaagaccagaaagggctgatgttgaaacctggagaggagccctgcaggagctctccaggagggagggccctctcctaatgatgctggcctgaaagggcctgaggccgaaaggtgagggggcggggctgttcaggacacctggtctgtgtactcacggcctctatctaccctgttcaggggaaccccaaacctgcttttctttctttctcagcctctcctccctcctcacaccctggatgctgagagcagggcccagctctgctctttccacaacatttgggccatgttggcacagagcgggggcctcttgggctatggtggccacactccccgggctaactgagttacctgattcccagcggaaaggtcaggaagggagggaagaaacttgctgagctacaaattcgagactgctggggctttctaggacaggccaccttcctgcaattgtccctctgtgtccccaactccccgcagtcccgcag

SEQ ID NO: 88113 - DNA, 1025 bp, Homo sapiens
gagatggaaaggctttgctcaagcagccaagaacagggctttctggatctgcagatgccctggctccaaccctggagcttctgattccacagagctgggctgcttcctcctggccccggcccctgacccttgccctgtaccccagcctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggtaggtctggccctggccccagccccagccccaccgcaagccaaactctcccatggacttcttggtctctttttctaggagtggccaattgatggtggcaccagcctgaccccagccccaccccagagggacctgctgctcacagggtagggtactttgatgctaccccacctcttcccagtaggatatgtggggtgggagcagagccctgaggtggacgagccagcccctgggcatcccggctggcatccctctcacgcctggcaggtgggttctgcccacaggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgaggccaggagcctgggacccaggaagggcagaggccagctgggtcctgtccccgtggctgctcacagggcccctccccttctccaggtgggctcctttgacccctacagtgatgacccccggctgggcatccagaagatcttcctctgcaagtacagcggctacctggctgtggcaggcacggcagggcaggtagcaggctgggctggggagggggagctg

SEQ ID NO: 88114 - DNA, 1050 bp, Homo sapiens
gcccgggcaagggccatcgaggcgctggttgagctattcctgaatgagcttaagaaggtaagtgtggggcacgggttgagaggccgggcagacagccctcaccgatgctgcatctccctgtccgtcttccctgtgggggcaggggctgggagtttgggccaaatccctggaagtctggggtgctaggtggaggggcaggccagcagggggagcaggtgggcaggcaggacagggaggcacaggcagacttgctgctccaggccctcgcctgcttgcccacaggactccggctatgtcatcgccctgcgcagctacatcactgacaactgcagcctcctcagcttccaccgtggggacctcatcaagctgctgccggtggccaccctggagccaggtatcgccagaggccggcaggggctcacacagggagggcatccacttggcagaggctgcccgggggcagagggtccagtgggtgagccacatccctgggtgccttccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccag

SEQ ID NO: 88115 - DNA, 1021 bp, Homo sapiens
ccatcttgctcctgaagggctacgaggcagaagagggggcaaggtctaagtgaccacaagtgggactaactgggggccagcagggagtccgaccttctgcagtgggtgggctgcctcagcaggcggaggttcctcaccatcctgggtgctcatgcaaagaccacatggcctcaaggatggccgcaggccaattgcagggtggagggccccgttcgatgaccttcacggtggttctaaaccagctctgccaaggcagcggcaccgggagtgactggcctcactgacgtagccatctcagcgagaaccggctgagacctgggacaaggcaacgataattacagccaaaggtctggcaccagcccctggccacctgtccccaccaccacccctggattagagcaactgccttggtgaactggatcaggctgggttgggacaaggttgtctctggctcctctctaaagaggcaccagctccctcatgcccacaggagaggcagaaggggaaagccttctggagtggcaccttgggcctcttgggcaccctgagacaggaagaggctctcctggggcaggggtgggagtggagaggactttcctggtcaggctagagaaacagatgacgccagcaggggaggggctggcttgagcaacctgggcctcctgaccccctcccaacagacaggacagaaaccctggcaaaacctggagggacacggtgcggcctccccctctggcagaacaggcatgagtgtagaaactgggctggtgggagaggttggggggcctgggggacaggggggcagttttcacctctgactgaccctggccagaagccccatgaacctgctctcgggagaacctgctccttctgtccccacattgatggaaggcaagagtaccagcttggcatcctatcccagtctccccaccccgagggagctgtgccagtcccaagcacccaggcaaaacccagtagtggtacctcaagacaagggaatggaacagcgaagccagaaacc

SEQ ID NO: 88116 - DNA, 1012 bp, Homo sapiens
ggctgcacctggaccttcctgcctctccgctcagggcagcagcagtgagtgcagcagcagctgcaggctatcagcagcaacagcagaacagtagctggagggccgggagagagcacgggactcaggttgggggagagaaaggatgcccaccctcctcccagagaaacccactgcctgccagggtctttcccccacaggtttggtggaggtcagaaagatccgagaggctggtgagaggtgcggacggtccccatgccagccgccagggccaacctcctccatgttgtgtcttctctttcactgcccaagcctggctcccgtcatccccgcgtttgggatcccggggtactgctgggcccagtccccagcaccgcccatcacccaagcagcatatcagaggatgagggaagtcccttggcttcccccaagggacaactggttttcctccttgatccggcagacacccgccacctctgccagccctctggctggcaccatggtgtggtctctcccagatgccagggagagccatggggtgctgagtgccccaactaacctgtgaaaaggatgatgactgagaaggccacgatctccacgggctcagcctggggcagtctctgcagcttgagcagcagcctctcgcccacggcgcgcatctcctgcacgaagtcggtggcagccatgccgcgctggcttcctgttggggctcctgccgggctctgctggggcagagagaacacctggagcctccacggctggccccacactcgtcgcagcaccgagattccaccctcgcacccatccgcagcccgcagaacaagtttgtcaggtctcacacattgcacccctggtgacttccacctagtggtggccctcagtccccacccagctgacacagctcagggtggaggaagccggtgaggacagtgagaccaagggcttgcttcgggggctgccggccaaggcggcggctggtggtggtttctggcttcgctgttccattcccttgtct

SEQ ID NO: 88117 - DNA, 1059 bp, Homo sapiens
agtaaattttagccatcttcatcatcatcttcatcctcctcctcatgatcatcgtcatcattctgaatcctattctttggagggggctgagaatggacaaatttttgaatttcttttcttttgtatgaaaacacttactctctgggtctttaacctaaacctgtcagacaagtccgtggacactagaaagtgaaaccagagggtgagagcttcccctccctgcctgctattgccagtgtggcctggactgccagctggaaatggcgggggtgtggcaggggctgggatcccctctccatgacatgtttcccaggtagacagggctctgctcccaggtggccagagcacgggtcacgcaggccaagatgatggaagcatgtgaaaaacacagacttcttgaggctctggggaagccccggggaggcacctcgggatgctctgtctggacccattggcatttctggagccatgtgcctcccctcccctcactcctgggttcgtagctctacctggaaagttctctggaagaaaaactcagctgaaaggagggggtaaggaaggaaaggtgctgcttctcagcaagaccagtctttaaaatgggtccctgttgccctggttggtcccatgtttagaggggcaaataataacgggtcatggtgatggggctctaaagatatgcccagcaccgagctgagtgctagacataggtcatcttagtttatcctcacagcaaaccccaggaagcagtaccaggatttgctccatttcaccaagggggagttcggcttagggaagttgagtcacgcagctgacagggtgagggtgtgagcccagacagcacacaaatgggggagggccacagggtcaggaggcaggttacaggtgacattagggccttcctctggcagtttgtgaagacccactggtctgagtctgctagtgtgggatgtgcaggccaaaggtgcaggcagttgacagagtaaagtgctgttcctgagcttagctcctgcctttgggcaaacacagtctctgccactctgcagagtagtgcctcagcct

SEQ ID NO: 88118 - DNA, 1561 bp, Homo sapiens
agactggaccgagggcctttgccccaggccatcaggccgcctcacctgtggctgggctgggctgtcctctgtctgggtgacgtgtggactgcggacctgccccgagctcaggaagccctggggctgggactggcgtagggctcacttcctgtgttgtggggtgaatgattaactgcagccctggctggcgcctggtgcctcctggaactgtttctgggggaagtgttgctccccccctgaggcttcccattggtgcctttgtctgctccctgggcacggcctcagcaacattgtgtggttggtttctgcccactggcacaatagggaagctgggaagaggggatcaagcctgtgccctggtgcttgaaacctagtggccaccatatactcctttaaaagctaggatgtgagggcccgctatggccaggaaccatgccaggcactgtgtgtccagttgtgagatcagagaggcgggccctgccctccaagggcttcccttctagccctcgggtgcttatcccagctggtaaagatctaggagctttgagaaatgcccaggccccacctggtaccacttatatcagtctctggggttgccaggatgtcgtattgtttacacatccccaggtgattctccccaggtgtggccagggttggatgacagatggaggcagatttagaacagtcgttcttaactatcatgggcgtcactgacccgggttacctgatgttttctgtttccttgtgtgaaacttactgactaaggcccttggcatgctgaacgctcacagcagtgggccagtctctagctcaccctttgcgtgcagctccgtcagttaagtcagatgcttatcaagagtcaagtgttggttcccaaacctgttcatggcagttgtacttgtaattacataattgaatttaacatcccgggaaccaatgaagcaacaataatagctgaaaccccaattttacatgtggggaacgggcacagagaggttaaataacttagccgaggtcatcagctagtaagtaactgagttggagtttgaatccagcagcacacagtctgagcgctgaagcacctgtgctgcacctcagagcgagtggagaaagaaattctttctagaaatacctattgactactttgggatgactttggaatcactcagataatgttcctgttgaaaaagatgcagacatgataactaaacatcagggacattttgtaaaaacccagaaggttttcacacccagcttcctttgcctttaagttccaatgactttaagtttttgttctgctttaaagaaaccaaaactagaaaataacaatccaggagctgtggttggcaagcccacactcaaccaaaactagaagatagcaatccaggagctctggttggcaagcccacactcagagaaaaggccaggaaggccggccaaggaaaaggtgtatgtttccatttaatgtgagatatgtaaaaaagtaatagatgtgtagagaacttaggtgttctttaacaaaagttgctttgaccagctctttcaattaactgccggcccc

SEQ ID NO: 88119 - DNA, 1050 bp, Homo sapiens
catgtgctttgaactcacgcatctgttttacctgcatctgcaggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaactctttgggctgtgtgtttttatttccacctcctcctgttgaccagtgagtcggtggcttctggactgaagctattttcttctccaaactgctgtctctaatttggcctctgtggcaagaccacgcccagcaaaagtggtcggctgcagtgccaggaccacccttgcctgcagcctttgcgaccagagcccttttcaagcacaattaatatgggagttgctaaatttggccttcttaggcttcttgagcagagctcttatttctggtgaggaatgaaagggccaagtgttcctgttcattgtgagtcctgtttgctgaaaaaagctctggggctgtctgaggctctggaatgctctctggagggttaactctgcctgtccccagggtctgctccgcctgccaggcaagggaacaggtcctcccaagggcctctgccttcatttctcctgtcaccttccggggagctgggacttcttagtgcatcagtggcctggttgccaggggctggggtccaggcatctgtggactcaaggagtccaggtgacggtgttgcgctgcctcttgagcagcctcgtgcctgtctcctttgctacatgtgatgattctgaaatccaggcagcaggctggaataaacgctgctggtatgtctg

SEQ ID NO: 88120 - DNA, 1024 bp, Homo sapiens
tgggattacaggcgtgagccactgctcctggccgatttttaaaatttaaaaaaaaattttttgtagagacgttgtttcactatgtttcccagtctggtttcaaacttctggcctcaagcaattcccctgcctcaccctcccaaagtgctgggattacaggtatgagccaccatccctggccttcttaacttctttcttgacattttatttggcactttttataatggtgcccttagttcttgatcacaaatcttgcctgaagttcagtaggtgctggagaaaggagaacctgtgctattattaacaagaaagtctttagacacataatcacctgagcaacatgagccagaatttaagtttgcagaaaacgcaaggaaattgaagttggtgcttagcataagacaggcagagttgagtctagatgtcaaatctgactgcttagcaagttttaattaaatcacttaaaatatattatttgtttgaaatttttgttacatgttggtatgtaaatgttagcattaaaattctttccagccaagcacggtggctcatgcctgtaatcccagcactttgggaggctgaggtgggcggatcacaaggtcaggagatcaagaccatcttggccaacatggtgaaaccccatctctactaaaaatacaataattagcagggcatggtggtacgcacctgtagtcccacctactcgggaggctgaggcaggagaatcgcttgaacccgggaggcggaggttgcagtgagccgagatcacgccactgcactccagcctgggcaacagagccagactccatcttaaaaaaaaaaaaaattatttccacaacaaacagaaatgcgttttgtacatgatgcattttgggagatactttcatgcctttagccccatccattaatattgataattcagagttgactgaaattattcagaaaagttttgcaagttgttttctgacttttctgaagtacacacattctggcttaatattcataactcttttctttagtacgt

SEQ ID NO: 88121 - DNA, 1055 bp, Homo sapiens
ggaaagaaagttttggcgccagcatgcaggagggaaaaaaaagaacccctgaaaactgtaaatgcaacctgctttctatgctgagtgaaaaacctggaacccaggcctgagaactcgccctgcctgagaactggcaagatggtatgggcagacccatggccccatagttcaaagtcagtcacagctctcctcgggcttgcagaacaaaacactcagtagtgataatcttctctgcctagtatttagggtatgtgggacttggagcctgcacgtaaaacaagcccagggagccgttaagtgtttgggtttcagttgtggagggaagggaggatctgggtcctagagtctttctgggtacagttgcagccttttcttagggctggaaggcttcctggggaagttggctggagaggagggtacataacacttaacggtcaccccttctaaaatactgtaatccaggcaacaaatccttgggagatgacagggctttgtgagtcagggtgggggtcacatgaaaaacaaaacagactttactgctgtccagtagcagtcactaaagagcggggtgggagggacccaaaaaaggtgaagctgggaagattgtggaaatgccttttgtgctcaggctccccttctcagccctacatcacggctgacagcctcgtcattcctgcctgctccttgactgatgtgcttcgctgttcctcattcactcatgtgcatttcaagttttactgtggaatgaaaagttttcatggaataatttctgttcctcttgaggagccctcagaaatcagaacacaaaatccaaccctcaaagtcacttgatatagttcttttggagggtgatggagaagggtttagataaagcttgccagcttcaatgttctgcaatccccagtggctgccaggcctttaggagtcctcgtggcatctccaaggactacaaatgatccccagcatgagtcttctgtgatactcttatcttagtcctggccctgtcatccttctgcttgagctggcctcagactctcttccacatagcaacatgt

SEQ ID NO: 88122 - DNA, 1022 bp, Homo sapiens
agggatacaccacagtttgtttactgattcacccatgaggacacaaatggatctttaagcggcatcgttttgattactcaccattcctcattgacgagtagctagtttagttcctcttactgaagacgtaattagttgaaggacagtggcttccattcatgatgcagtgcctgtcagcccctctacctaagcttttgtccactctggtgtcaggactcaggttgcttaccaggtatgggaagtgtgtccatgcatgtagacagccccagcttttagagaacaagcaggagagcagagaagccaaaccacaggcatctgcagcactgcagccccttgacagagccgagcatgcacaccctgtctgtgccctccagggcctcgcagatgcccacggctgagcctggagcagtggtgctggtgtggcagtgcacgtgggttctctctgtcactcaggagctggagatactccaccgtcccctggggccccccagctcgctcactccctgccatcccataagcccgtccaactagctgttcctgcacagatccctccctggcagctgtgggtactctgggtgttttctgacttgggcacgcaccagggcaagtcacgctgacagctggcttctcaagtcctaagtgcggctgcctctgagaacacacccatcagacccaggcagcagccacagacccagcgctgcttccaagagactgtggacacatcgctttactggcttgaggctctgtctgcttacaagaaatgtggggctcagctggtcgcagtggctcatgcctgtcatcccagcacttggggaggctgaggcgggcagatcacgaggttgggagttcaaaagcagcctggccagcgtggtgaaaccccatttctactaaaaatccaaaaaaaaaaaaaaaattagccaggcatggtggtacttgcctatagtccaagctacccgggaggctgaggcaagagaactgcttgaacctggcaggtggaggttgcagtgagccgagataacacc

SEQ ID NO: 88123 - DNA, 1163 bp, Homo sapiens
gttgcagtgagatatgattgtaccactacgctctagcctgggttacagagtaaaacccccatctctttgttttatttttttatttcattttatgtattttattttcctttttgagacaagagtcttactttgtcacccaggctggagtatagtggcgtgatcttggctcactgcagccaccaccttcgggttcaagcaattctagttcctcaatagctgggtttacaggcatgcatcaccatgccagttgcttttgtatttttagtagagacggggtttcgccatgttggccaagctggtctagaactcctgacctcaaatgatctgcctaccttggcttcccaaaatgttgggagtataggcgtgagccaccgcacccagctgaccccgtctctttaaaaaaaaaaaaaaaaacggaaaagttaactgctgtatacatttattccctctgcctgaacttttcttctcccaagctggcacatggcccaccccttccggtcattcagtctcagctcagatgacacctcagagaggccacatccgaacactcagttgtactgttttcatagtgtttatccctacctgataacattttatgtgcttatgtttttttgtccatgtctgtcccttgttctaatccccacctacagaatttttccttcttctctcaacagcctccttttctgaaagagttcggaacatgtcgcctgatgaaatcaagatcccgccagaaccccctggcagatgttcaaatcacttgcaagtaagcatgagactcggctactgaggtcggatagattagatagcctgggttacgtgtttggtttggtcttaatcttaagagaccatggcagggaaagggactgaggcttctataaaagaaactgacaggtgggaaggatcccacagtccactttacctcctgttagcctcatctcaggagttggctcctacacccaccgccatgtcccgtggtgctgctccagcagggcggccctgtcttgccttcagtgaagtcctaagcagagacagagaaaagaacgtaaccttttctgtgcagccctactgggccagtggtagcttctcagaaagagctttgctaagaaactgaggaaccctcagaatgtaaaataaattacagaaatgaaaaagtcacaggcatt

SEQ ID NO: 88124 - DNA, 1029 bp, Homo sapiens
ctctccagattgagtttgtgacgggcaccaaaaaaggcaccacgaccaacgccacgtccaccaccactaccactgccagcacagctgttgcaggtagattgcagagctgccctgcctcctgccacacacatggagccagggtctccctggcttgtttgggcgacagacagcacgtggatctgggcctgggctcagccttgctactttgagaagcacctttggagtctggggtgggccacttcggggtctgctccctagactcccgctggcctgcagggggaagggaaagagggcaccgctcattggtggatcgtgatcctgatttctgctttatctccagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttc

SEQ ID NO: 88125 - DNA, 1071 bp, Homo sapiens
ggggtggggcagggtgcggtcaagtttggaagaactgttggtccatgtgggtgctaagggttccgctggtggtcagtgtccggctcacaaactcctgggtcacatgccgggtgagggagccgcctgcctccaggtgctgggcccccagggtcagcccatctgtggaggaggaggcattagatgacctggcttggggtctgcccttctccctctgctagctccctgtcccaggagagccgggatcccctagccctcagtgctcacccactaggaagggctcggtggcgctggtgtgggtggtggtgatgctgctgtactcgctttgcagcgggtgctggaagagcccggcacggctgcccagctgcgggaagggtcctggggtgggcagataggccagtcagagggtggtgccagaaggaggcacggcccgaggaggggtgggggtgaaggaaaggacaggtgcctacctccatcctgggactctatggtgatgatgccctcgcgctctggcccgaagccctcagtggtcctggcctgcaccttgaacttgtagggcacgttctcgctgaggcccggcacggtcagccggctctcggggctgtctccatccacccggaatgcggtggctggccctgagcagggaagatgccttcagcgtctgcggccccctctttacccctcccctggccactcctgcccccggggtgggcagcacctcctccttgggccatctcacaggtcaccaggtagccgacgatatccccattgggcctccgtggccgctcccagctcagctgcagcgagtctgggctcagggcagtgaacaccagcgggcctggggcactgggagtgctcaaagtgaaggcggagcctgggggcagtagaggaagagcatcagcctgtgggtgggtggtgggcatgatgggggcagctctggggctgggggaggcaactcacctggcaggggacacagtgggctctgcgggtgcacctgggattcaatggtgatgacaccctcacgctctcggccccagccttcctggctctgggcccgcacgcggaacacgtagg

SEQ ID NO: 88126 - DNA, 3135 bp, Homo sapiens
ttattttacatcggaaaatatttacaaaaattttgttaaagtagcctctctgggtgcatagcattcgcttgatgcctgtgagtttagactcctgctcattctgatagagaccaatgcaattcatttgcattgactttctattgcagagctttggaaccaagggaaggatccaaacatagctccattttatccaatcagaagggccgcttagtgctaaactctgattcgtccattcctctttgcatccatccaatcattaggccactttaacagccaatcagcggcgtagatatgcaccaatcatggaacagtgccgaagcacggcctttgtgtcgggggatgtcagcgcgtcggcgaaagcgcccaccaatagaaaaagtcgttggtgtatgcaaataagggttctatgacgcagagacgcagcgtgaagcgtgcctataaaaacggaggcgacgcgggggcttggagcgcagagcggtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggtaggtcgggcgggggaacaatggcccggcggtggccggctttgtgcggcagcgtccgctcactcctcccctgctcgctgcaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggtaagacaaaggcctggagccgggggagggctgggcggtttccgctccccgagtgggattaatagtgcggctctcgtcctcaacaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaactaagtgtccaaaacctaaattgaatgtactaagttttcacatgtcccattatctaggtccttgtatactaatgttttgaacttagatcatttcaggtgttgtttggtggataaaggaaccttttatttataaagatactgtagaaagcatgtgaacagctctctgcttgattaagatgccataatagtgctgtatttgcagtgtgggctaagacaaagtatattaataagcttttcagcccccccactcccgttccgtagtgtagaagcccacaggtgtagaactcagtcttaaacttcagtatgaaaccagtttccttgtgcgatgatggccactaaagcatagtac

SEQ ID NO: 88127 - DNA, 1562 bp, Homo sapiens
agattccgtgcagtttgcgcaggaagccttttgtgtccctaaggctcgtaggttgtccacgagggccacacttgcttgaattcacagtcgacgtagataaacatgcaaagatggaaacgtgtccgtgcgtgcccatgaccgtttccctcgcgggctgtgcggagcctgagtctgggagcccgaaggtgatgggttccaagtatgtctgcaggctcagcagaaatgtagcattagagggagccccaaatactgacactacaggagtccagcaggatgggaaaacctcttcctggaagtcttgcatctgtgtgcttttaggtcgctgtcttcatttccttcaagccacgttaagcattccctagagttaggtgatgtgggagaaagatgaataaggggcggtttctcctgttaagcaaaatgttgctttccattttccctgatgctctgtgaatgcctctcatccccatgggctcctgagtgatgtgcatgtttaaaaggatccccagctgcgagaggttttggaacctggggggttgaacagctcttaagttgttcagtgaacgaagaacagaatcatctgttggagtagaaagaactcaaaccagtcaggaggaactcttgttatagaagaccttgggaaactgttctggggttggggaacattggttataggaagtgtatggtttctttgtgggattctttgttgttggctgaaatcatttaagcttcttgactacagtctgactcacgttaaccattccttttctgatatggacattgctttcctggtcctttcttactggagatctttcgcagtctttccattgattttggtgagatgttcttagctcaaagactactgatgagttgaatggtgtagtcttgattttcgaatctggaaacttcacgtaattggaacttctttataatctctggttgctcagatcactgtttttagcaaaataaacacattttgagtcacgagagtcttggcttcagcaacttgtgtttctgtgttgtgttgtcattgagcatactatggaatctgtaatagaaaggctttcttattttggaattgacaggtgaaacaagtgaacagctgattaaatgtcagtatctgagtctttgtcctcttgatgctcatttgtttaaaacctgtctttcctgccgggcgtggtagctctcacgcctgtaatcacagcattttgggaggccgaggcggatcgcatgaggtcaggagtgaagagaccagcctgcccaatatggcaaaaccccgtctctactaaaaatacaaaaaattagctgggtgtgctggcgggcgcctgtaatcccagctactcaggaggctgaggcaggagaatcgcttgaacccgggaggcggaggtggcagtgagccgagatcgtgccactgcactccagcctgagcgacaagagcaaaactccgtctcaaaaaacagaaacaaaaacaaaaaaaaagcctgcctttccattccttgtgggtaagtatagagtaatgggacctggctcttgaggtgtcttaggaaatcaacaggagtaggtga

SEQ ID NO: 88128 - DNA, 1363 bp, Homo sapiens
tcccacaaaatccccgttaagtgttaagtgcccttgctaagggtagattcttaaacttaacacctagttgatatttgctattatctaaattattaaagtcaagatttgcttaatggttaagtttttttgttttaatccagctatgttagatactaaagaaggcttccccacaacccatatgcatctgctttgactggtggtttctatcatcctacaaagactgtgacttattggtgagggcagctggacaactctgagagcaacttagagaaatccatcttgggcacactctataaaggagctccttctctgcaaatagcaccccagataagtgcacaaaagcaagataccctcgtggacctacacgtcctcccgcttttcaacaccctgatgcctgaaggtgaggtctctttcctgtgtgtcttagaagccatgagcacgcttaggtaactagagccctgccacagcctgagcagcacagcacacatctgcaggctttcctgccagacctttacctaaaggtaatttttctcattaggagagactccaggtcaagagtgatgacagtaaggttgcatttaaagctgcattacattaaatagtggactggtctagtgattattttcccacactgggcaatatttgcttaatgattaagtttttttgtttttgtttttgttttttttaatccagctatggttgatactaaaggaggttttcccactatccgtatgcatcttctctgttttgagattgcaactatggacagttatggctaatcctagtagattgtcttcccttttaacatcttggatgaatttgggtcacactaattgttatgtgaagatggatgttgaatgtaagtttctctgccattcttagccaatatataaaaattacattagcctaattgctaacaatgccaagaatttaggtttactatccctctggacaatgtagcttcttgttttcttaccatatagataactctatagattcaccccagccagtcatcttaaaatacctgcataggcagcagaggtatctgtggagaaagtgcatgggataataggtacagggtgattttgggagtgatggaaatattctggaattagatatggtgaaggttacataatgtgggtgaatacactaaaaaccactgaaatgtacaagtggtgagtttgagtgctctctgaattatatctcaaattgttaaaaagttaattaaaaaatcagtgtatatgagtccctcttaccatagagagggcttcaagcgcatggcctattgccaaggctcagcaacagtggttcagtgtgggaaagcctgtggtttgcgcaaagctccttggtgcccttttcccag

SEQ ID NO: 88129 - DNA, 1131 bp, Homo sapiens
tcgtgagtgttttaaggtttacatgggcatttctttaaggacaggccatgtgttttaggcatttaaaatgatatcaatggctatactatattagttcaagtaatcacaacaaactttttattatttctctataaaatccctcaactttcaccccttttttctttgccagtgtgtagaatttgacagcagtatcaagagctgaggagaaggagaagatggaaaggagtctagcaacttaaaaatctcacagcattctctgtgaggtgaccttttttcctgttggtggctcaatttctttaggacataaagaagatactgaggcctgtgacagcctgtgacagtatcatcaagtcgtatctgaacttattgaactgtttcctccccttccttattctttattcacagtttgcttttcatgtgcataagttgactcatttgtttcctgttagcatttgaaacaccatatagccaccataagtcctgacaaaatgacttttaataaggagggggaaggtccatgtcccaccttcctatgaaattttggcctattcacaagtctacccccacataagagaagtagttatgttctgtaaagaagaggttgataaaaacctttagcatggtgttttgtgacttagaagttttaagtagtcgttcttatatctaagcatttattaattttggtaagaacattactatacgtttctgatgtcacttttactgttaagaggtgccaggcatctggtgacctgtcacttcaggatttgtgtgaatcagaccatctaaatataatataaattagagactggtacttgtatttcctgattaaaaacaaagtaacgtctgttttactattgaagtaagagtactttataatgaatacaaaaatgtatattaaatatccagtagagcatgctaaagtgaacatttctgtttttatttcagcaacttattttatggtattgtagttatggcctgtccgaaactctctgacatattctaaacagctttcagagagtcactgaggcttatttgctactactgttgtttttcctttagctcagttaagaaatgtttagttagccgggcatggtggctcacgcctgtaatcccagcattttgggaggctga

SEQ ID NO: 88130 - DNA, 1131 bp, Homo sapiens
ttcagaccagcctgtttcaggggctcagtagccacatgtggctttcggctgccttgtgggacagtgtgggtctggatcctcagcatgatactgtaggccgccaccagtctcagagacagagctccagtttgtacctgttaacacctctttccaccccaagatactgccctgggtctccttaacctctttccaggctcaggccctatctctgagatgagaatggaaaataaatcgagggccctgggcgggagaagcatattcttgatgcagaggtggtccccggccatgggcattgggaccgcctggctgagacggcataaggaagtgattcaggctttggagttgtacagatcagcgttcaagacccagctcctctgtgttttagctctgtcactttggtgggtttaccttacctctctgagcctcagttttcttatttataaaatggagaccatattactggtatcttctggtcaccatgaagattcacaattactgcaaagtgctggcacagtgcctggcacacagtaaatgcacagacatggtgttactagagatgtcgtaggaaccttccctttatgtgcagggggatttgtggtctcctttggaagggacccaggagcatttttggagggacagagctggctggggcctgctgacccctgcccctgactcttgcagagccacccctgagtgacgacctgcagccttcctcagctgtgtccagccccacccagccaggtcctgtcctgtacatgccatctgccgccggagactcggtgcctgtgagcccctccagcccgcatgcccctgacctcagtgccgtacgtgtccatcctggggagtgggtgggcaccatgcctgacagagccaatacttgcctcctaggccctttcagcctgggcttgggagaccatcctggtatttgtcctcaggccagggggatctgtcttttccatctcagcattcttcgtcaaaagtccaggcccgggggtggggtagggcagtccccagagcctgtgctgatgagcctgtaggactggtggcagggacaaagcctgaggtcactcccctttccttcgtgagcttcgggctccccgagtggtcactgctgctcgttggcagatgaaa

SEQ ID NO: 88131 - DNA, 1048 bp, Homo sapiens
ctaggtgcccgctttgtgccaggtcctgtggcaggcactgaggagacagatgacaacatgctgctcctgccctctagagggaaacttcccacccagtggacatttgtcaagcacctgctatacaccagccactgagtgcccagagacccgcccacccccactgatcccggggctgagacccttgagttgtaacatcaggggacaagacccttgtccgaggcagggaccctggatggggatgtgatttctcctggaagtatcaaagaagattcagaaaggagaggcatttgggttggacatgactggcagacggtgtcagaagtcaggagtcaggattggcataggaagcagctgaaggaagggcacaggggcttgggagaatacggacccagcgtagcatgggcgtgaagatgcagcgtgggcagtagacgaggtggtcagggtcagatagtccctcgggaggtcacatcccactcttctctgtccctagagtctgctttggatgacctggacctgaatgagtttggcgtggccgccctggagaagactttcgataacagcacagtgccccacccaggaagcatcaccatcggtactgggtgtgggtgggcagggcagcctggaggactcctcgggttcctgcctggctcaggccccttgctctgtgtggcccgcctggcttccgctgccctcacccagcccgtcctccccgggcctctcttgcaggcggcagcttgctgcagagctctgcacccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtaagagagggagtggttcactcaggagaactggggcaggaacctgcgcctttaggaggtgcctctggccaccccatctacggcatatcagctaggctgggggttagggcagaggccttgggcgaggaggcag

SEQ ID NO: 88132 - DNA, 1044 bp, Homo sapiens
aagtgctaggcacgaggccagtgcaggtgagagcaggggtctcagttgccagggctgggcctggtctctttcacagcatggttctgttctgcccagtcaccccaggctccgagaggctggctcgcaccagccaggttcacaggggaccaagggagaagccagacaggttaacccctggcttcgggtgcccttcctgccgggcagaggctccagggaggcccagggctggcccagaaggctgtttgcccacagaattagaatggtatggaatgggggtttctgagggcacttcaaggtttagtggctagaagaatggcacagaggcctgtgccactgcgggccggctgtgcatctcctcttgtgtgtgtcaggggatgttcctgagggcgggatgggaagcacatggcaccaccgctctcactctcccccagcagctgcagacaccaggagctccctccccgagagtgccagcattttgctcgggcccagggaatgagcccttcagagttctgattgggtttggtggcttcccttatctcattcctgatcccagaacagcacatggatttctcagcgccttccagtttgaagaggctgttctctgttacgttgattctgtcagctttaggtgcttggtgttgcatttttcggacttgccccatattcggataggatctgttttttttttttcgagtagggtctcagtctgtcacccaggctggagtgcagtgcagtggcatgatcctagctcactgcagcctggaactcctgagctcaggtaatccttccacatcagcctcctgagtagctgggaccacaggcgtgcaccaccatgcccagcttctggtggcgtctagacttagctccacttactggccacacactccttcctgcaccatgtgactattgagcacaggtgtattgatacaggtgtaagtgcaacagtccctgctgtccagcagctgtggccagtgtgggaagcagaggtgcccagccattgggatcctcctgagaatcatagaggggcctacctggacagcagag

SEQ ID NO: 88133 - DNA, 1159 bp, Homo sapiens
atgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgcagtggtagcttgtttacatgggggtgagggggagtgggtcccaaaagagggcctctgaactatgaggtgggccaggagccttgcctcagccatggaaacggctgctgcccacacccctgagctgtggtaaggcagctggagagggctggaaacttcctgggcccatcaggccccaagacagttcaagtgctctccgacctaggcctagcggttgatgacacagggacccttagccttggacacagaggccccccaggccctaggactctttagggctgtgtggtcagcggtgactggcaatagggcccgtaactgtttctcagaggaacagtgtcttcccaactgggcatggtggcgcatgcctgtggtcccagctactagggaggctgaggtgggaggatcacttgagc

SEQ ID NO: 88134 - DNA, 1049 bp, Homo sapiens
ggggtttcaccatgttggccaggatggtctcaatctcttgacctcctgatccacccacctcgacctcccaaagtgctgggattacaggcgtgagccaccacgcccggcctggttctgtcttaaatcatggttgtcactgggggcctggcctcctccctgtctccagccttgtttgtgcattccgttagtgtgctggggagggttcctcactgaggttgagaggtgtgttggataggactgatcccacctgccccttgctggtcctgtacccaccctctccccagcctcacctggggtgggaggcggagggggaggttgggggtgggaggagctggggtggggctgggtcactgaggccgcccctttctcaagagcgtctttgcttcctcctccgccaccgccctgccgtgctgtgtccgcatccctccggccccgccccagcctcctgaccctgctctggacccacacactcacagtgctggtggaggcggccgcctcccagcgcagctcatccctggcttccaacaggctgaagattgccctgcaggtaacagaaccggtcacagcaatgataaccctggtgggagggtgcctggggtcacctctgatatctcccccagaacctggagatctgcttccacgctgagggctgtggcctgccacccaaggccctgcacactgccaccttccaggtaggggctttgggtgagcttccccgtaggaagtctggggagcctgccttttggcactcacctatgtccagggtcggctacataatttatggggcccagtacaaaatgaaaaactgggccccttattcaaaagttattacaaattttagaacggtgacgacagaacctgaaaccaagcctgggtcctcctaagcacaggggccctgtgtgcccgcatggggggtggggtcggggaagcacgcctgtgaagccagccctgtctgtgcctctcctgctgtctgtctggcctgagggtggccccagcccgttgtcccatgacccaatactttccatttcaaacggacatgttacccttga

SEQ ID NO: 88135 - DNA, 1161 bp, Homo sapiens
ctgcaggcagtggctggcctacagccgcctctaccagagcctggagttccccagcagctgcctcctgcaccccatcaccagcatcgagtaccagtggatccagggtcggctcaaggcagaacaggtaggcatgcagtggcaaggggcactgagcaggcagggctcagggaaggggcaggggagcagcagcagctgtctaggcccctaaagcatctcctggctcttcagcaggaggagctggccgcctcattcagctccctgctgacctacggcctctccctcatccggaggttccgctctgtcttccccctctctgtctcggactccccagcccggctgcagtctcttctcaggtcagtggctgccttcctcttcctcggtggggtcagggatgagggagcagctggggtgcctgcaggagtgggagaattgttggaggagtgagtgcagtgtggggcagcaggcactttcgacacagctctttccatcttgcagggtcctggtacagatgtgcaagatgaaggcctttggagaactgtgccccaacaccgccccattgccccagctggtgactgaggccctgcaggtatggtactcgcgctggggatgggggagaccagcgcctgggcctggcagtccctccctgctcactgcctctttgtcgacagactggcaccactgaatggttccacctgaagcagcagcaccatcaacccatggtgcaggtgaggggctgggcaagggggagggcagggggtcacggggggtggtgcctgcctctggcagccctgcccagcccacctctgtctctgcagggcatcccggaggcaggcaaggccttgctgggcctggtacaggatgtcattggcgacctgcaccagtgccagcgcacatgggacaagatcttccacaagtgagcagatagccaggtcgggaggtagtggggcattgcctcagagccggaaccatggggaccctggtgtatgccactgggtgacacctgctgcctttcctccagtaccctcaagatccacctcttctccatggctttccgggagctgcagtggctggtgagtccctcccccgtctctagggcatgccctccaacagagctgtgggccccgccctccacacctttcctttgcaggtggccaagcgggt

SEQ ID NO: 88136 - DNA, 1014 bp, Homo sapiens
gaggtcgtaggcactctctctgcttccttctcaaacctctgtcctgccagggacctggacactgtggagtctgtccgacagaagcttggggagctcacggatctgcatgggcttcgcaggttcgtgttgcagggctcacagggaaggggttggggctccttttgccctccatcccccaacatgcacactggatgctggggtgcaggctcctttggggtccaggtggctgcggccgggggtggattccagcctaatcccttccgacccttgctgcgtcccccttatgggaccctgcctgacgcaggatctttaaagaggcccggaaggacaaaggccaggacgactttctggggaacgtggttctgaggctgcaggtgaggaggatgaggaaaggggcccaggagcgaggcagagggagggggttgggaggggttctggggagaggctctgtgtcctcacaaagctgagcctggggtccacctcctgtcgcctccgctgccccgactctatgaggttctgacgctcacgggctgggcatccccgcctgtcaggacctgcgctgccgagaggaccagtggtaccccctggaaccccgcactgagacctacccagaccgaggccagtgccacctccagttccaactcatccataagcgggtaggtcgggtactgggccagtggccatgcccagctcttgcggcggtctgctgggttgcggggctggctgcacccagtgtgaggccctgtctgctcacagaggcctcattgcagagagccacttcggccagccgctcgcagccgagctacaccgtgcacctccacctcctgcagcagcttgtgtcccacgaggtcacccagcacgaggtattgccctcctggggctgggcgcagccggggctgcccttcaggtcctgacactcctccacctgctcccctcaggcgggaagcacctcctgggacgggtcgctgagtccccaggctgccaccgtcctctttctgcacgccacacagaagg

SEQ ID NO: 88137 - DNA, 1038 bp, Homo sapiens
gcgcctattacaacccaggcaatcctcacaacgtctacatgcccacggtgagagggcttggcagtgccggtgcagccccacagccgcagatgctgggagccgcagggggatgaccgcaccatgttttaaaccttctaatgcaagtctctcctttctcccttctttagagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccc

SEQ ID NO: 88138 - DNA, 1991 bp, Homo sapiens
ttctcagttctggagagttcaggctggagacccccctctttcaggaacccatccctgccttgcctctgcctgtccttccctagcttcgtaggccccttcacttaggcaacactgccaccaccccaccacgtcagtgacaaagcagtctgccctgctcatagatactatctgtgaccagcacgtttttctcccgtgtgcgtgagcttggcctctccaggctgcggtgagccctttccctttccaaagctctctccaggagtgtctggcacagagagagccatggggctgctggaccctggcactgggagaggattcgtcactcccaggaagcaggcgggaagcatggcagcgtgggctgtgcttctagtactgatggcctcaccctctctccctgcaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtaggtgatgggaactcagggacacgcatggggcctgcagggaggtgtcctgggaacctctgactgccgccgtgggggcgtccccttcagacccttatcgccctagccatgacctcttcccagctctgggctgccagctggtggggtttgattgccaagaggtggggaaaatgctggcatgaaagacagcagctcagatcagcttttcagagcgtgaagtctgcagaagcctgcggactgagtcaagatgcttagtgcaacttggcgagcgcatacaaattttagactcaggaaggagctgcatcaggttcttgagaggggccttttcatgagagccaggaagaggcagctgcctctgggaagccagagtcaccctgctttggggctggctttttggcaggccccagagacctctgcattgaacttgccttccccttgacacccagccaggcccgcccttgctattgagacactcttggtccccctttgggcagaagccaggctagaggggccggagtctgtccttgggcccccttaggacgagaggtctgctctgaattttaaggtcggctgttgctgagtgggcttgttcctgtgaagctgccgagtgcttgactgggggcggagagaaaccttgatgtggccttggcacccgtgtacatattgggccaagggtgggaggacaggcttgttccaggaaggagaggccattgttccaaagggggaagcgagtacagcagggccaggccaggctgcagtgctggctcctatgcaggcagcaggctggaaaccatggcaccaggaagtccccatcacagtgcaggcccagcccccgcaggcctcccgggcgttggatgaagtcctggagaggaaaacagccatctctttgggcataagttttcttttcctgtgctgtttattcactgtccttcccctttcaggtggctgggaaggctctgcttcctacaagttgactttcacggcagggggcgccattgagttcggacagcggatgctccaggtggcatctcaaggtatccaggctccgaagattaggggctaaagacacactaaacatgtaggggtttggtatgagtttgcttccttttcgttttgctttttcaagaactcaagaggtaagtgtttgggcaccaggctgaccaggcctaggagttgggaaggaaagctgtcattggcatcagctctgtcctgtacctcagagactgcgtttccctgcctggggcaggtggatgacgttttgacaaagctgtttggactcaaggacactttactatggcctcataaaacaaacactaaaccaaccattcgactgcggttccgcagccattgaaaatgaccgagggatgggccagcagacatcctccgccagctcactcctaccccagccctgagcctccctcccggcctctgtccaccctccagccttgcccttgacct

SEQ ID NO: 88139 - DNA, 1059 bp, Homo sapiens
ttggggtggcggggtgaggggctctggtgccccactccacactctcatacgctctctatcttctcatagctatcagctggcccagcggaccttccgcacttttgatttctacaagaaacaccaagaaaccatgactccagccggcttgtccttcttccagtgccgctgggatgactccgtcacctacatcttccaccagcttctgggtaagggccatggggctggggcactgggtgggcctgagctcccaggcctcgcctgccctgccagggagaagctttgttaggggaaggctgcggcaggtccctggtgggcaggcctcagcctgagggggcgcaggccagcagaccaccccgtacccctcactcttcttgcagacatgcgggagccggtgtttgagttcgtgcggccgcccccttaccaccccaagcagaagcgcttcccccaccggcagcccctgcgctacctggaccggtacagggacagtcatgagcccacctatggcatctactaaggagccagagtgtgcgcatttcagagcatgggattgatcggcagcaagagtaaagacacagctccagaggcccacactgtggggtctgggccctgccttaggcagcccccctctttggccccctcccgtcaggcccagggcttggagtgaaagtgactctcaggtggtggggtggggaatgtgaataaacatgatttcttgccgggcttggtggctcacacctgtaattccaacactgggaggctgagaagggagggtcgcttgagcccaggagttcaagaccagctggcaatataatgagaccctgcctgtattttttaaaaaaagggatttctgccatagctggcctgggtcggtgctccagggccagaggaccccgatggagcttcatgggtgggaaacgggctgcctcccaccccactaagtgcgtcctcacctccgtcttctgagggtgtcaggggccctgggatccgaagcaaaagcaggcagtgggccaaaaacaggtgtggcccagggaagggagacatcccaatccagcaggttcc

SEQ ID NO: 88140 - DNA, 1060 bp, Homo sapiens
actacaggtgcaaaccactacacccagctaatttttgtatttttttatagagacagggtttcaccatgttgcccaggctggtctcctgagctcaagcgatctgcccgcctccgcctcccaaagtgctaggattataagcgtgagccaccatgcctgggcccttcgtctctaaactcatttcttcacctgtaaaactgggataatggcaccacatgccttactcagcgtgaggtggactgtgacagtcacgtgggagaaggagcgggagaggcctagcagctgtggcgtcccccaggtgctccttgaaccactgggcgctccttccctgggcccagactgggcggccttccatcttggtagcttttggctctgaacaccaggccagggggcagaggtcaggccagtgaccccaactttgagccttctggttaactggggacagtgactgggaggctggtttccgtcatttttattcaactgttaccagcctatgcggcaggaccctctggggatttgtgcctgaggcgttggccgcccctgtgccaggctgggcacacactccctgacgaggtcctggagacttcaggacgcagagggaaaagcagccaaaagtggcctggctttctagcctcagtgactgtggcggacccaccggctcccggggcctggaagcggctgcatggccttgctgtcaagctgatgctctctggagccctgtcccccactcggagctcctccagcccgcttcccgtatttgcagcatgtcccggcgttcacagagcttggctgcctcctctgtcccaggagagagatgcttagagctgtcctcccagggagtcatgtcagcctctagggtgtgcatggagctgaggggacactcctgctgcctccctggagtggtaattaaccgggactttcctcctcccagaaccaacatcccgggtaaccgggtggctgaaggacaggtgacgtgtccctacctcccccccttccctgcccgaggctccggcatccaccgtcttgccttcctgctcttcaagcaggaccagccgattgactt

SEQ ID NO: 88141 - DNA, 1075 bp, Homo sapiens
ataaatattaaaaatttaaaaattagctgggcatggtggggcatatctatagtcccagctacttgggaggctgaggtgggaggattgcttgagcccagctggtcgaggctacaggtgtgttcacaccactgcacttcagcttgggtgacagagcaaggcacttgtctcaaactaaacaaaacaaaactataatgataacagttgtcattatggagcatttcctgtgtgccaacctcaatgccgaaggctttgtttatattttacttatttatttatatttagaaatggggtctcacgatgttgcctcggctggtctcaaagtcctgggctcaagtgatcctacccccttggcctgcggattagctaggattacaggcatgagccactgtgcctggcctgctttgtgtattttttaagcttttaccctcacacagccctgcaaggaagggctacaaggaatgtttacagacaaggaaactgaggcttagagacatgaagtcatgtgctcgtaagttccacagcaaacaagtaaccttgccaggattgagactgtggtctgtctcactccatacctgggctctttcatggcccctgctgactcccagagccaggcagagtcagggacgatgtggggaggggcctcagtgacggctggctcagctagcatccagggctccacctccctctcagctcagggaaggtgaccgcccatccaaacctgccttgcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcctctggggctctgtggtgtaggctatcttaccatggctttggctgccctgccccaaagccattggcttggatctgagg

SEQ ID NO: 88142 - DNA, 1154 bp, Homo sapiens
aggtcgatgcggccaccagtgccacctcccacacgcggtatgtgcgctgccccaaccatgcccgcctgacgttgggggccggaaggtccccgagaccgtcaggagggggtgacccagtcttcttccaggtccctgaatagcatcatccaccagatggagaagttctccagcagcctgcacgagttgtcctcccgcgtggaggcctcgcacctcaccacctcccaggagcgggagctggggatccggcagcgtgacgagcagctgcggggtacgccctcccctctcagccaccccggctcctggtgggaagggggagcagctgctgagcaccctgtgggttgcccccagcactgcaggagcggctgggccagcagcagcgggacatggaggaggagcggagccggcaacaggaggtcatcgggaagatggaggcacggctgaatgagcagagccggctgctggagcaggtgaggcccgtcctcctggccctcctgcccctcctgccacggggcctcttctccagggcacccgcaagtgtagcggcactcccgtgacctcacttcctcaggaggtcaaggccccacctgccgcttcctgcctctacatctccctgccctggccaggctctcagcactgcccacctgagcatgcaggggccgcctggccaggccccccaccacgccctgtccgctcctcagcaccgcaagcccctcggccaccttggctgccctccgcagtctagcccccgcaaccatcagctgcacttcccacttcctgacactcgaatctgtcacattagctgaggcctgacattgggacagatgctcttgcccattaaatgtcatcctagcctcttcagctctcacagagacatttgaattccctagatacctttcatatataagcacatgctttatttaaataatgatgaccttagccaggcacagtggcctgtgcctataatcccagctacttggggggctgaggcagcaggatcacttaaggcccagaatttgagaccagcctagcgagaccataaataaatttttttatgccaggcaagttggctcatgcctgtaattccagcacttcaggagtccaaggctggaggatcacttgaggtcaggagttcgagaccagcctggccaacatgg

SEQ ID NO: 88143 - DNA, 1087 bp, Homo sapiens
caccacacctgactaatttttttgtgtttttagtagagatggggtttcacatgttggccaggctggtcttgaactcctggccttaagcgatctgcccaccctggcctcccaaagatctgggattacagacatgagccaccgtgctcggcctgatttttctttagacctgtgtgcccatggctgtcatttgatcctgttcctgttctctgtgggtagaactgtccctggttcatgtgatggaagtcaaggtctctgtacttcgtggtgttctacagacagcacgtggcctgccacctgagccggtccaggagccactgctcactgggcctcagctgactgtgcagggtccctgggcatcgtgacgcccagctgcaggctgctagggggccactgggactggctgtttcccctgcctgacaccctcctttctgtcttgaagtaggttcttcgcagacagtggcgcagaccccaagggagaaccaggctccaaacagagccctccaatggcttccagccccatccagcccaggaagggaggagctgactggttgggcctcaaggacgaggacttggacctgttccctgcctcacccaccagagaggcccatcgggaaagttcagtgcctgtcacgccctcagtgcctcctcctgcgagccagcactccacgccagctgggctgcccccctccagggcaaagccaccaactgaaggtgcagggtcccctgccaaagccagccaggcttccaagctgcgagcctccaaggaggagaaagaggactggctgagccatgccctgtctcggaagaagtcccaaggcctggccagagagcagcatgctgggacctctgagggcctgcatttggcggggacagcgggccatcccccttctggcaggtactgacttaggctgctgtggctagtagggggaggactggctggggacttgaggagcccctttgccccttcacctgttgcagcctcagtcagcagttggggaacaaggcagggcgccgtggccacagaggccgcttcttggctttgctactctgccttttaggcactgcagagagagcctctggctcccag

SEQ ID NO: 88144 - DNA, 1029 bp, Homo sapiens
aaaaaaaacaaaaacaaaaacaaaaaacagtatactatttaacatggcaaactctttattagtagttcttctctctcctttccccacaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccct

SEQ ID NO: 88145 - DNA, 1019 bp, Homo sapiens
ggtctcattcactcatgggcacccttctgtttcgtggttgcctgttggatgaggtccagagataactaaatgttggtatttcctgaaaagaagtatgtattctgagaacttcttctggttgaaagtagatcagatatgaagatctgtggggtttgttgttcagtatttttagtgttatcagaaatactgtaccatgttgattatttgtcaatcaaggaaatgtaagtggtgaatgtttagccaagtagaacagcttagatgggcatgggtagtgttctgtattcttctggccagtcggacagctgtgcttcttcagtttgcatgtgtggcagctgtgttttgacagtggccaagatgttagaggaggggtgtgttttctcattggttctcgggctctcagcaccacagatgtcctgacagatctgtgcttgtcctctcagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggtgagagtcaaatcctcgattcctcccatctgttcataagaatgttctagtccttttcctaggttcttgttcccatggtttttcttcaccgtatatatatatttgttcctgaaaggtatacttttgccttccatcctgactcacggtttttatttcgtggtgaggctagagagtatgaagcacctgttacatagcttgcagttgtatcaaggatagagttactgggctgggcacagtggctcatgactgtaatcccagcactttgggaagctgaggtgggcagatcatgaggtaaggagttcaagaccagcttgatcaacatggtgaaaccgtgtctctactaaaaaaatacaaaaaaattagccgggcatgatggcacattgcctgt

SEQ ID NO: 88146 - DNA, 1058 bp, Homo sapiens
gctccttatttctatacagctgctgctttttatttggtgttgaatagtattttacaggattttcatgagactccaagtggaatactatttgtttcagttgtgcttttgaaaacattttgtccttatctgttctgtttaatgttatctgcttttctgtaaaagctgcttctttgatgaaagatgtctgtgtctgatttgttgactcccactcgggaaagttgtggattgcacataagttggttattcaacttggaagcttctaaatgtttcaaagtgtgtttaatgaggtctaagcgttatgaaagcagattggtaaaaggttcccaacgtttgctttagtacagtatttttgtagagactgccacctagaacatttttctatgactcttttcaaataattttgatatatttgtgttaagatttaaaacataagatcctgtctatcccagtacacataagaaactggaaactcttccttgccacattaatgaaccagcaggactaagttaggcctgccattggaaatctctagggtcaactgagaccttattattggacctttaggaatttttaaaagtcacatttcaggtcatttccccaataacagttatacttttatactttttttttttttttttttgagacggagtcgtgctctgtcgcccaggctggagtgcagtggcgcgatctcagctcactgcaagctccaccttccgggttcacgccattctcctgcctcagcctcccgagtagctgggactacaggcacccaccaccatgcccagctaattttttgtatttttagtagagacggggtttcgccgtgttaaccaggatggtctcgatctcctgactttgtgatccgcccgccttggccccccaaagtgctgggattacaggcgtgagccaccgtgcccagctttaatttttttgttgtttttttagtagagacggggtttcaccactttagccaggatggtctcaatctcctgacctcgtgatccccccacctcggcctcccaaagtgctgggattacaggcttgagccactgtgcctg

SEQ ID NO: 88147 - DNA, 1426 bp, Homo sapiens
aaaacctaaataaagcaaaaaaaaaaaaccacacacattctaaaaaattcaaccaatcaaaccagcaaataacaccaacaacctccccttccaaaaattagagaagtttttatgctaaaacttaggtagaatttgcttagtggattaaatgtaaatacgaaatgaactgtgggaactgtggccttgaaataattagaagaagagagatcatcaggttctgctgctggctttttaggtagtaaaatggtaaatcttatatttaatttcataagaagggggtttacattttcctgaccttctccttgaaggccaaagctgtttggcaagaaggggttgtaggatgcagtttctaaaggaaggctgagatccttttctcttctctcctgtagactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggttagtccacattgagggtctgtgggtaacccacctcaggacatcagttaacagtgattgctggcatttgacttttttctgctgctacctgtttgggattctatttttaagttgttaagtcaaaattcaacttcttgttttctcctagacattttccctggaaactggtccagggctctggcctataaacgtcattcactgttatttcctaaagccttttattattgaacagcttgaaaagatggggtttacagtgcagcggggaaccccattatgttactctgggtctaatgagtaaagactttgttggaaattcttcagagggttagtgcctcagcaatatctggaaagcgcctctctgctctaatgcagttaaagctgtggattttaatgggggcagcaggcagtggcagctacctgtctcatctcattgcccactagcagggttataaggcagtttggaaaaaagtccatgattctcttcatctgacttcagtctttttagacattttttcccctacatgtctgggaactcttgtgttgccagtaattctttgttaaattgttcctaaatatctggcttccttcaaaaagttttgcttttgatcttaatgtgaaataggtttgttttcatagacaaggccattggcaggtttgagtgtttggaatttgaactgcccagcctcatgtctaattatcaaaatggcaggagtaaagaaagggaaagaaaaagggatgcagatatcagggaaacatcattttgtgtttgattgctgatttcagtgtgtgaattggtttaaggaaaatgttatttattgtcatctccatgggtactgcagctttctggtcatggtttgatgttccagacactttact

SEQ ID NO: 88148 - DNA, 1039 bp, Homo sapiens
acctctgcccccagtggccctggcccctgggcagcccttcctggccgccatgtgtacccagagcctgggactggctgggctgggcagtgacccaggtgggaaagggtggtcttgccctctaaggcccggcacaagtgagaggcctgggggtccatgttgggctgggctgggcgaggggtggtctctgacttcctgggggttctggctgggatgggcagggggctgggtgggagagtgtgggccctgccctccgaggccgggcatgggcgagaagcctgggggtcctggctgaactgggctgggtgaagggggccccctgacccccttggggtccgggctgggctgggtgaggggcggtttccgacccccagccaggttcccaggcaggatgagctggggttggggtggctaggccgtgggccttgggagctgggcagtctgggctgggctgggctgggcagggcgccacatggaagctggaggagcaacgggagcgctgggcgtggggtgcaaattgcccggtgccttctgtttcccaggcagctctgtggccatggatatgttccagaaggtagagaagatcggagagggcacctatggggtggtgtacaaggccaagaacagggagacagggcagctggtggccctgaagaagatcagactggatttgtgagtgctgggacggcccctgagttacccaccctgggccatcacaacctgggcgctccctgatccgttccctctttcctggagtccacgtttaactcctctgggtgctgcccagcagcccttacctgtcctctccccagttcactgccttctgaccagcctttgccggggccctgactgtggagtttggtggatgacgtgccaaggagcacaggtctccattgccggggccctggtcattctgtggggttaaggagaagccgatccccctggctggaagtgcccttcttggcccaagtctctgcccacggctgtgcccttgtttcttgcagggagatggagggggtcccaagcactgccatcagggaga

SEQ ID NO: 88149 - DNA, 1074 bp, Homo sapiens
aagcaggattagtaacaaactaggaatgcatgctcattatagagcagtggaccctaaatttctaaggaaaccccccacctccctcccttctcttacccaacctcaaagcttcttgcataaagcttcctagatgtcagatcatccctgggaagagggttgaggaacctgttgctgtaaagagtagcacccgtgggtaagagctctaactcgtaacatggccaacaggcctgcaccccagtcctagcctgccactctcttagcctctctgggtttcagtgactttgactacaaggcagggatgtggtagcccctcctcgtaggaggctgtcgggattgagtgattgagtgagatggcccctgtaaagctctgaaccaggcagtcggcactcaggaatgttcaccaagggtgttctgtgaccgatgctacatacgtctctttgatttgacttccagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttg

SEQ ID NO: 88150 - DNA, 1024 bp, Homo sapiens
gggattacagatgggagccactgcccctggccccccgttttttttgttttgttgttgttgttgttttcaatttttagagtcaaggttttgctctattactcgggctggagtgcagtggtgtgatcgtagctcactgctgccttgaatacccaggctcaggtgatctcctgcctcgtgagttgctgggatcccactctctgttttttgtttttttttttttttttttccactgtgtggttcttgaaaaaggatgcagaaggtataaatcaagctaaaaatcaaattttgtgataagatctcatgcgggtcccctgcaaacttgccactggatagtagccaaatggagggtcccttgaagcccaagccaaatggccctgctgtggccacgcccccacccgccccctgcttcctctgggtcagccccaacttgtagtccagtcctcccagttcctccgcttctctgagtataacttgagctgacttgtggtgcattccagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacaggtgacccttgaggaccgggaaggcaagggcctgtggttttcctttgcctgtgtcggacacaaagtgacttaactttgtatcacggaagggctgtgacaagcaggacctattagtagctgggaagagacaaagatcttacaccagttctgcagtctgtgagcccctacctctcagacatgctgatctgcagagaatagtgaccccagatcatcactgagcacttgacctgtgtaagacgctcccaggtgccatagagcatctgagacctgagtccatgccatctcggcccccagggagtttgtcagtcagtaggactgtgagacacacacagtcaaggcatctgagtagatgctaagcaaaataaaagctc

SEQ ID NO: 88151 - DNA, 1050 bp, Homo sapiens
ttgggtcacatttgtaaaaggtaattgtgttggcatacagtagagcttgacaagtttgttctggaaggaaaagataaggaaagttctggtgtgctgtgcttcagtgtagagtgtcccaagtccagtctgtaaggcccctcaaggggtgccaggtcctgagcagagggtgaagcgctgcagggaagtagcaggaagctgtgctgggaagagacgtaaagcctttgctaagtctcagatcagttatgcagacagctttttcagcatgtttgcttttaaaaatagaactcccctttccatatgaataatgaatgactaaggctatgagaaaccattatatggtagagaacagtaacaattaaaatgatatctggtgtggcgtgcgtgagtgagtgtgtggttgggggactccatgtgcgattttgctcctctcccattaggtgactatggtttgctcaaaggaaagtctcttactttgatctgcccttgtttaggctgaaagcgaagaaactaaggagcgcctgtttgaatcaatgctcagcgagtgtcgggacgccatccaggtggttcgggaggagctcaagccagatcaggtaggaccctcagccgagccctggttcttgctctgggcgggtccaggtcagcctgtgtccccttctcaggtggaccccagtgctctgagtgcactgctcgcttggccactgtttcgtttttgtttttttgaggtgaggtcgtaagggagcaaacaagggcctctgggctccatcacattgagaaattaatttctccctcccctgttcctcctaatggtttcctatatggcctgtgaagcctgtggcctccaattctgtctccaggtggacttctccagtgcctcccttttctgaaaacactatccctgtggttgattcaggcatctaggctgaaaacctcagatctatttgtctcttttgtccctgtcaccaaacccaccttcttctccctttgcagggcctcttgcctattgttgcttcacctgtttctattagccttttctcgtgtgcctaggcaacc

SEQ ID NO: 88152 - DNA, 1471 bp, Homo sapiens
tggatccacagcacaagggaaagagaagcaccaagaatgggtttccagacaggcgctggcactcctcatgtgggggcagcagcagatttggggagcggatgcgtttagtgatggtatctgtgggaccccgaggctcttgggctggtgtctgctgggctgatggcaccagctagtagcaaacctcaacagctgcgtaggtgcaggaggagaggaaaacggcaggtgacggggactggagcctcacactgtcctccctccaggcagccttccatcccaggaaccctgctgggtggccagtcctttcctgccccgcctgggcccccacagaaaacattaacactcggccagaacgaacagtcttctcacttccccccacctcttcctgccccaatgaaaatagctcagcaaggcccaatttccttttcctgtctattgtaacatataggcaaactttaaaaccaagtaattaaaatacaaaagtggatcccagggtaagttcgcaaaacaaggaacatctttcatgtccctccctgtccgggagccacagtggcagtgactgtacctagcccagggggcaggagcaggctctgcacctgtcagcacctgcttctctccgttctcacacacgagtgctgtggctcgcaccgtcatcggagtctcaggtgacacgcatcctgctccttccgtgccggctcctgggctgccctgctggagacaccatctggatttggccaaaggtctggctcctgtaatgttcattttctcttccccaggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcag

SEQ ID NO: 88153 - DNA, 1019 bp, Homo sapiens
tttgcagagccatgtggtcctaaacacacccagctcacacccaaggcagatgcaggcatgagcaggatgacctccccactggcgctccctagcttctgctggttggtcgcagcctcaccagcctggcctctgcccagctctgctcgctctagtattctctgttgagcctgtgtcccacagccctcctcagtgatctgacttgttagggagcagcagacagaaagggctctagggaaacagcaggaaagcgcgagaacacagacatgcccacacaacgtgattcctttcttgtccactctttatccgcttaattattgtcttttttttaacatatgatttgattttttttgtctccatccttaagatttttattttaaggacagcaacgcagagaaaaacacagccagcccctctctaactgcattaactccgttacaggccagaggacgtgcgcatttctaggtatggagtgtgacaataacaatgactttgacatcgcaagcgtgaaagcactggacaataagctgtgctctgaggtctgcttacctggtgagtgtcagtctgctgaacatgaacttggtgggagacgatccctgtgctcttacccctgctctcaccctggtacacccatctcctgccctgcagttcctgccaagaaggcctggggtgtgctagtgctggagaccagttgctgaaggaagtaagaaggcctgggagagtccttgagctttttgcaatgagccagccttgctctgagtgagagtattaggataggaagaaagaagcaaaacttaacgatttggcctaaccactctccaccccacatcacggccttgcaggtaccatgtcaggtggcccagtcttgttttcatcaacaggaagtttgagcagacagacaccacctctctacgaaggtcttggaaggattgcctgcgccctttaaaagtgaagctgtagctcctcagaagaaatgtgtttcagctaggatcagagaggaatgtgaaagccagcgtttcaga

SEQ ID NO: 88154 - DNA, 1042 bp, Homo sapiens
cttcagccaatcagtttactcattttgccgcttcatagactcacagggccttccttctgtcctagggaaatgatgttatagaggaagaggatggatcacccacgcaggaaggtggtaaaagatctggtcctttacttcctttagttatctttctttcctgggtattctttaaggggtaaagaaaagggtaccggtatgacgtggtggcgctgctcagttgtatggggctgttagaggaaagatcgtcttcttaatggtacatcaaagcaagcagagcattgatgatctctatgacctcctcagctctttctgggcctcagagccatggatgtcaggtgcgggtgctgcaggagatacatacaggtccatatttacctgaagtagattcggaagctctctaagcagctcccatcatcagcctccctgctgcaggttttcagtggagccccacagagctgttctggcattctcagtgttgaatagcagtagccatttcttccactggggggagggggaggactatttggcagctggtcaggtcttgctttagttaggaatatggtcaacattactgtaaaagaggactctcgggccggcagacgtactaaaggcgtggtcaaggagacaggtccaagtttcttcaggagctcagcttaggcaagtattttaaaggctgttgtaataatcttcctttaccataattcaggcctcagttacatcttcagttggaagaatgttgtttccagtaaggctagaagagaaggaatggcccacagagcaaggacgtaggaggaagaaggagggcaggaaagtctcccccaagcagggaacactatgtgttccaggagccagactcttccccctgctgctctgaggcccctccctcaggggcacctccagagcacacgtatgcccggcctggatacagacgcaccagcagatgtcatcctattgcttctgctttagcgctggccatcgcttgggaagtgttggaggtgtgcatgtggacctgacggctcccacctggccaaggagcttgaag

SEQ ID NO: 88155 - DNA, 1050 bp, Homo sapiens
tttctgtggcagagtaaaggggagggtattttacagatgaaaatattgagaccctgtaaatggcagtggtttttcccaagtttagatagcaagtcatcagaggagctaaaagtaaaacttagcgcttctgacacccaaaagaggtctccatccctctctggttctatttccctagtcctacttaagatttgggtttcgagccaggcaagttagcccagacctactcggctactcaggaggctgtactcctcctctgttaaagcgtcaacaagaggatcgctgaagcccaggagtcccagcccagcctgggaaacataatgagatgctgtctcaaaaaataaacaagcaaaaaatatttgggttttcccctcagctccccttgcagtaagttctgttctttaaatggacgttggatatagctgcttttccactggactcctacagatccacttcccaaaactcttccgtgctgcatgaagaggaagatgagcattcctgcagcgagtcggagacacagctctctcagagaccgtcggttcagcatctcggagaggtaattgacattcctctcctcttcttgggtgttgtactccagggacttccctcctacctgcatgcctcatcaggtccctctgctctcattcactcatcaaacaccttgtcagcaccctctgaggcagtggcaaaggtttcactggattcatgcattcaacagtgtatgcagcctgtattatttgccaggcactgtgctatatgctgaggatagtagctgggacactacaaaagtccctgcccttgtagcatttatattcttgctatctggggtggggggcacaaaagacaataggtaaaaaaatacatgtgtgcctgatggtgctgtggatcagcatgtgtgacatgtgggaagggagtgtcacggctggaagtgggggctgccattcttaaaaagcggtccaggagccaagaccaagggaagtggtagagctagctatgcagatatacgaggagagagggccctaggtctgggaacagcaaggagaaagtcctggg

SEQ ID NO: 88156 - DNA, 1160 bp, Homo sapiens
actctgtgatcattcagaatgaagaggtagacctatgcttatgatcattcagagaagcccacaatatattgctaatttttttaaaggtaaattttaaaatattgatatgctactctgcaaatgctgagtctctggttttctagatgtgctgaggaagtgaagagccctggagaagaggccagtaaagctaaagtccactacaatgttgagttcacctttgacacagatgctcgggtagccatcaccatctattaccaggccacggaagagttccagaatggtattgccaggtaagatcaggagaccaggagagccacttccttcccagattattaccaggccacggaagagttccagaatggtattaccaggtaagatcaggagaccaggcgagccacttccttcccagatagggagagtccatgtcttatccactcagcaagggcggaaaacattctttttctgcagccagatgagatctggttcctgaatttagactttcttctacaaagccctaccctttaccttttcccttcaaattgtgccatcttggtatagtgacaaatggtggtatagtccttcaggtccttaacatgctgttaaaaatctagtaagctacctttctttggatgtgtgggttgaatagaaaagtttaacgttgccaagcaagagcaaaggaaatggattataaaggaccctttcttctcttcgctagaccctgttgataattgagaacaggcatgagcagaggaagttgtcagacccatctgtgccggatactgacttttgctttgcctcccacttgtatcaatagctacattcccaaagacaacagcctccagtcggagactgtgcagtacaagcgaggagtgtgtcagcagttctgcctgccctcccacaccgtggatccctccgagtgggccgaagaggaggtgagctgcctctggggagggtttcccacatccactcagaagggcctaggggctacttaggactcggtctgacagcaaaggggctgctcggatgcttgaaggccatgcttacctttcagccttgtgacttcatcatgtccttttaaagctctgcttattttgcatcaaggatatacctaactttgttaatttttccattccctaggaatggaaatagcccattagcct

SEQ ID NO: 88157 - DNA, 1037 bp, Homo sapiens
cttcagctctgtacacatgatggggccctcttttatttgcggtccctaaactcctgggataccgcatggcctcaccgaaggaaagggcttgcaggtctggttccctgtcgtctgaggtcagatggaaaagccttttgtgattaactcggccacagtgtgtcctttggtatttggaacttcagcggtttttttttttattattaattctccaggttttgaacactgaccgaaataagcttcatataatggaaaaagaagataaatctggctctttgggccccaaattgcatcccagttttcccgctagctgtgaccttgagcaggttgactcagtatgtcggagtttcagtttcctcacttaattaggagagttgtgccttcctgcctcacctcttagggctattcttggcaaactgtaaagcgagggacagctgtgggtctttttaaacacaccaccttctcctgctttgtttctgacacagtttccttacgccgccccacctccccaagaacccgtgaagactctgagaagcctggtcaatatccgaaaggacacactgaggctcgtcaagtaagttcccagaggctggggccaggtcccaggcaccttcctttggggaggctgggggctgggggacagacttcccaaggaactcatacagcagtttccggcagccccagagcttgcttctctgggcctcagacaggagtgcgggcgctactttctgctgagatcaggccgtccacacccatgttgttcagcactggatgcaatcgtctgtgtttgtgaaaaactttcgcttgcctagaaatgcttagtatccttattttatggatattttttaaaagggaagaagaattattaagggaaaatgggaatttttgcagctactccaacaagccaatgtaaaaatgggaaatttgaacttagaatatcaaatcctttattttattgctatattttctttttcttttctttttttttttgagacggagtctcgctctgtcacccaggctggagtgcagtggcgcaatct

SEQ ID NO: 88158 - DNA, 1207 bp, Homo sapiens
tttttttctttctttttatttttctctcttttgcggcagggagtggctatggaggagaaagagtaaagaataagggaaaagacgcatcttttttttgaaatgcaggtaggagttatggataacgcccaagtacctgtacaaatgaaaatgattaactttgctactccagaaaaaaattttaatcccaaagtcatttattttggctttagaatagactagcgtttgtgtcggattttcctgcctaattactttttgcttaagcttatttaaaaattgttttaaattcctttagtatgacagcctaggaaagttgggggaggagaaacaggccacagatgggatctgaactagaatttcagttttaccatgtcaaggcctcctgatgcactgcttgcaggagggcaaagttggagtcagctttgtggaaaactgtttggcaaaataatttttaaagtcttaaaaatatgcttactctttgatcctgtaattccacttctaggaatttgtccttaggaaataatcaaacaagcatgcagaaatatagggacaaggatattcaccacaacatttatagctgcgaaaaaaagtaaaaccaacataaaatattgaataatatggaattgattaaagtatgctattatctgcaatgttatcaaaattatggactttaaaaatgtttaccacatctttttaggtgaaaaagaaactgcaaaatagtatgttcagtgtgaaacagcacatagatatagaggtggacaggatggatggatagacggacggatggagatacgtattccataatgttaattttggtattgccgagtagtaaaattagggatagttttgtacttttttgtgtttttcaagttttctgcttaaacatatattactttgtaattagaaaaaactatcatttttaaaagaatgtatggttaatatatcaatgaaaaagtaaattactgcatcatgcccacaaagtgagtaatctgaatgaagataatttctattgaatgtaagagtcacattcatacctgtgaattataagcaattatactgcgtacattaagtcagatgcaccttaactatggtttaactatattgtttcccaagtaaaataaccatattcaataaaaacctgtgagggcacaatttgattataacttgggtgtcctgttttgtgataccacactatggaggtagactcttc

SEQ ID NO: 88159 - DNA, 1047 bp, Homo sapiens
agaaattgctctaattattcattcagagggttaacttttttgtttttgtttttttgaaacagagtctcactctgtcgcccagactggagtgtagtgctaggatctcggctcactgcacttctgtttcctgggttcaagccatcctcctgcctcagcttcctgagtagctgggactacaggcatgtgccaccacacccggctaatttttacatttttagtagagacagggttttgccatgttggccaggctggtctcgaactccttatctcaggcgatctgtctgcctcagcctcccaaagtgctgggattacaggtgtgagccaccacgcacagcccaaaaggttaacattttaaaaatcagctttttttttttactagatttaggttgactgttttctgcttgtttgattttttttgtttgttcctctctaggaagctattttgccagccacttcattatgggaggagagaagtttgactcaactcatcctgaaggttacctgtttggagagaacagcgatctgaactttctggggaacagaccagttgtggtatggctgtaatcagtttactcctacttggagcttaagtggccaattcaaaaaatgtaacaaaaataagtttgcagttgcttgttcagcagtttgtagcttggtctgagttgagagagatgcactagaagacaaactgcagcctccttggttgtatgggatctcttgttgctagaggactggaagagctcctggagtcttgtgagggagaggatgagtctcacaaattaagctaggacagatctctccctgtcacctctttaggcaacccttttccaagggcttaccttttttttttttcttcatggcacttaacaccaaccttttattgatttgtctctttctctgcttattgtctgcctcctcctctagaacgtaagtttcataaggcaaggactgtttttactgtagtatcccaaacctagaacaaagcctggcacgtaatgttaagcccttaataaatgattgttgaatgaatgactgaaaatttttctc

SEQ ID NO: 88160 - DNA, 1008 bp, Homo sapiens
gaaggccgaggtctcccccgccccgggcgaattagcccaaggggcgtcctgccgggtctagcagggtcaccgagggcaccgagcccctccacgggaggacgggagcggcctccattgtaatcggccccgtgacggggacgcgtgcccgcagggaccgaggctcctggggagcggggctgcggcgtcgtaggcgaggtcggcgccccgcacggacccggccggcccggcccaaagcctacctgcctcgcggggtccgagggccgcgagggaggcgacctcggcatccaaacaggcacttgcgccaggtgctatccctgcgctgccgtctcctggcctctggaaaggttagaattaggtttctcctggaaaagcttccattgcctgctgaaggatggaagccaaacaggcatttgcagtgctggtgcttttgcagaggctgtcagaagccggggggtggggggggtggtggtggtggaaagtaacagaaatgtttgggaatctgagtatcagagttactcggattgcccctttgctagcgtagtggcaagcctgggttttggagtgggaccagctctgggacagggcagaggtattggaaacgtatagaagtatgtttgttattagaatcatcccttcacttaaatgtctctagcctctggattgtggtatcagcattggaggtggaggaggattttgacagcaaagcagagaatcacaaggtagttcagttatgtgagcaccggccagtatgaattgcatgacctagccggtgtttacttttaattgcaagtagttttattttaattaattacttttaattttattctcaagacttctgaggatgaatggctgcgacattctgtctgcttaggacccgatggagattttggtgatttcggaatgaggtgtcagaattggagcagagcctcgtctctttttggtagaatagagacatactgagatgagctggtttctcagcagtgtgtccagtgtctgccaggtgaaagc

SEQ ID NO: 88161 - DNA, 1038 bp, Homo sapiens
tctctatgtggcccaagctggtcttgaactcctggcctcaagctatccttccgcctcagcctcccgaagtgctgggattataggtgtgagccactgcacccagctggcaatttcttttctttttttttttttttgagacagagtttcactcttattgcctaggcggagtgcaatggtgtgatctcggctcaccgcaaccttcacctcctgggttcaaacgattctcctgcctcatgggattacaggcacgtgccacctgtaatcccacacctggctaattttgtatttttagtagagacggggtttctccatgttgatcaggctggtctcgaactcccaacctcaggtggtccgcctgcctcggcctcccaaagttcagggattacaggcgtgagccactgcacccggcctggcaatttattttggacaaagtaagtcaaaggaaaaagatcaaaaaacgaaacactagagaccagtaacagcaaaatggcaaaaccagaagtcatgagtaactgataaatggttgtcccgtacattactgtagattcccatagttggaagcttcccagttgataaggagggcttcccagttggaagtggagaaaggcactacagacttgaagtgggaggacaaaggtacaggggacaatgggttttcttgagaactggccgagagggcatatctggttcaaaaccctcattttacaaaagcagagagaagctccagagaggttcaggaacttgcccaagcttacacaggcaggccaccacaggcctgccagccatcatccctgctgttctctggcggctgtttgaggagacaggcctcgctggctggcggggaactggggaagtcggtcacgatgctgtgatgcaattggcctccacccccacccttcattcattgtttcctgctgccgagaagtcatccccagagggtggggggggggcagggagtagtggagggaggaggggaaaggtctgggtggggccaggcctctgcattgggtcctttggcctccccctgaggacccctag

SEQ ID NO: 88162 - DNA, 1129 bp, Homo sapiens
gattacaagcatgagccactgtgcccggcctaaatgcattttctacttaaaatattttcaacttataatgatgcgtttatccagacataaccctgtcataagttgagagttatgttgagggtctgtatatgtctatttgcataacggtttgcttgggtactttaatttgacaccctaggagcatttctcttgaggctggaattcttcccttatgatctgagagttttgcatagcactggggctcactgtgtttctgcatggagaccatgccattcctaagatttttgtcttgtgttctgaggccatgtaacttttcctttgcataaaattagttaattttggtttataaaaactatactcggtggaacaaggttttgtagtttggaacttaggctgtgggaactcaatgttagataagcttttctgtgtaaccagcttggagaacagacttcagtaacagcgtttgttttccatcactgtgtgactaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttat

SEQ ID NO: 88163 - DNA, 1003 bp, Homo sapiens
acaaaactcagctgggtgtggtggcgcatgcctataatcccagctactcgggaggctgaggcagaattgcttgaacctgggaggcggaggttgcagtgagccaagatcgcgtcattgcactccagcctgggcaacaagagcaaaactccgtctcaaaaaatacatacatacatacatacatacatacatttttatatcagttacatgttgaaattataatattttgggaattgcataaaataaaatgtattaatttcatctgtttttaatgtggctactagaaaattcaaagtaacatgtatggcatgccttctatttcttttggccaatgctgctgtttctgagagattgcaggttcattgagggggaatttgcatggtttgtttgttttttgtctgtatagtggttttgccaccatttccagggaattaggttgtgattacatttctctagtgatacatgaatgactgagatcttgtaatttgttttgttttgctagtgatgatggccaaagagaagccaccgataactgtagttggagatgttggaggccgcatcgcaatcatcgtggtatggttatatgtcatccatgtgcagaggtggcactcctggctcttggtcagtaggttgtccactctgggactgtatttctaggaacgatgatccgaatggatccatgtatcctttctcacccaaactcccttgtgccaagtggcagaaacctgtatccaggtgaacatacattaaagtataacctacagataggaaatgagcacagtactcccgtgagaaaattcagcaccttcaccttcatcatgtggattctaggttctttaaaccagctcacctaatcatgcttgagcgttagggccgaaagatgaactgaagatgagctgttccgttttcacaagtaagaatgggtgtccccgtgcagactcgttctgcatgttgacatactttttttcccagctctaaatatctgctggctagtgggtcatgagtc

SEQ ID NO: 88164 - DNA, 1032 bp, Homo sapiens
ccaagccgtaatctgcatttttagctttttattttcaactgactttagacttaaagttgaaagaatagtacagatttccagcatatgctcttcactcggagtccccaaatttaacatttatatacatggggtttttttttttccaccatttgagggtgagttgcagacgtaatgtcccttcattcctaaataccttcgtgtatatttgtaaagacaaaagactcttatataaccagagtatcattatcagactcaggaagctaacattgctgtaacactgtaatctacagaccttactcaggtttcaccagtggtcccagcagtgtcctttagagcaaaagaataaacttgttttcttgttcaagacctaacccagggtcacacattgcatttagttgtcatttctttttagtctcatttaatctggagtggctgctttattctttgtttcttatgaccttgatacttttgaacagtgcgatcaagtgattttgtagactctcccttaattggggcttgtttgtgtcctcaggattagattcaggttatgcatttttggcagaaaatcacaggaaacacatgatgtgtcccattactggtgatgtgcattctgataagttggttaaggtttctctggcaggtttctccactgtaaagttactcttttttttttcctctttgtaattaatactacctcatgttaagactatgttttaactgtaaatattctgcttctcatcaaaatgaacatctactgatgattcttgcctgaatcaattattgactgtgattgttgtcagtgttcatttttctaactctatcattccttctacatttattagttgaccttctaatgcaagaaagctttctcttcttccctattcatttcttcatttatatcagtatggattcataggcctatttcattcagtgggttataattcattgtcgtcacaggaataccttaaatattgcaggttcagttctgcaccattgcagtaggtgaatattataataaagtgagtctcatga

SEQ ID NO: 88165 - DNA, 1415 bp, Homo sapiens
gaggttgaggctgcagtgagccatgttgacgccactgcactccagcctgggtgacagtgagaccttgtctcaaaaaaaaaaaaaaatgtctagaatcagatacaatcccaaaccctaactcacgtgccctttgagtcatttacatgctggcctgggcctcacattctcatttatataaataatgcctttgtatgtccctgaaacgttaaatattttcattttatggttaaaaaatgatgccgtagtgatgcgtgggatttcttcctgtcagtttcaccatttccctttgtccttctagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccatgtaagatgagctctgtgtttttattttatttgtaaattgaagaaagtttttttttgttggttttgttggttttgttgttgttgttttgttttgttttgttttgtttttgagatggagtctcactctgtcacccaggctagagtgcagtggcgtgatcttggctgactgcaacctctgcctcctgggttcaagcaattctcctgcctcagcctcgtgagtggcaaagattacaggtgtgtgccaccacgcccagctaatttttgtatttttagtagagacagggtttcaccatgttggccaggctggtctcaaactccagacctcgtgatctgctccagacctggtgatctgctcgcctcagcctcccagagtgctgggattacaggcatgagccactgcacctggccctgaagaaagttttaagtagtatgaatggctaggagttatcgactatgtagatatatgctgtcttgttgttttttaataatggaatggtatttgctatcctccgcctttttttttttttttttgagaaaggatctccccctgttgctctgtacagtggcacagtcatggctcactgcagccttgaccggggcgcaagtgattctcccacctccgcctcctgggtagctgggactgtaggggtacactaccatgcctggatagttttctgttcctttttttttctttttgtatggagacggggctccctgcattgcccaggctggttttgaacttctttgctcaaacaatcctcctgtcatggtctcccaaaatgccgagattacataagattacagacatgagccccatgccaggcccgatttcctcttttgtaaaaggaagttgtgttatacacatttgtagactgtgtatggacggttctgcgtagcactcagcattcagacggtgtttgataattttagcttcagtaaaaaagttgtatgtgtgatggtgtgaaatcttaa

SEQ ID NO: 88166 - DNA, 1307 bp, Homo sapiens
agctggcctaagcccaaatccctgggaggctgccagcaggtgttgggtaactctggtcaccagcagttgcttcagatgtcactgcagtaacggggtatgacacaggagacccaggcaaatgtgagggtgggttaactgtgctgtgaataggagtaacctcagatgaaagctagggcttactcagctacaaaaagtcagaaagcttcccctgccttcatgaggtgccattgtaagctagtgtgatggtaaaattcccacaacacccatctgggcagcccatgttaagttgataaagtcaagatcttttctagggttgatacatggaattaatccccaaatacaaactttgactgtttcagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtgagtgtgcgcgggggccctggggttccagcatgatcctttagggctctttcctagttggacttagctcatacctcagatatccaatctgggatctgagtgtttgtttccttttgaacagttttggctaaggatatgtgagctcggttagaaattcttttttttcccttattcgctttgtcctactttagaataccattgctttagtgtcttctcttctctgtcatctgtcacatattttctatttcatcttgtcatcgctaaattcttagctggcagtcttggcattcttatgtgatcttttgatcttcaggtctagatttctatatctgctttgttagctaaattccatttttgttcatagtattcaagctggattttcttttactccctctcccccacccttgcctttctacatagtggctcattttcattgctttattctccttgtgtggcgggggcacgctttctggcctgtaaatcaatgtaatattttacaattgggtttctattcatctgatgtctgttctaaaactttaacgtatatttgggtcctcggaaagaaatgtatggtcctccctcaatgtccttataggattggttccaggaacccatctcccgcttccccggctcctcagcagatacaaaaacccaaagatactcaagtcttccatataaaatgccatagtatttgcatataaccaacacagtcatctgtagattatttataaatacctaataccatataaacactatataaattgttgttatgctg

SEQ ID NO: 88167 - DNA, 1095 bp, Homo sapiens
tctgtcacctaccagtcctgccaactccccagggaccacatggcgctttgccagctcccactccccgggaggaggaagcgggggatacatgggggctcctgtcctgccttatctgactttttccccctgcagctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctg

SEQ ID NO: 88168 - DNA, 1132 bp, Homo sapiens
cagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgt

SEQ ID NO: 88169 - DNA, 1027 bp, Homo sapiens
tggcacttcccttctgcccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctgtgagtcagcccttgcctggtcttcgccttcccccgccttctcggggctcctgtttgtgtcaccagatctgggtgcagggtggttagtcccctcgccagaccccagctactgccccagggcaaaccatttccctgtgtggtcacagtgctgaggccagcagcggcgagtgggaagtctgtgggtgtgctcacctgtccagccaggttggcagatggagctccagggcctctccatgagggactgactattctcttcccccctctagcaaatcattcttttaagaaaattgagttccagcctccagaagcc

SEQ ID NO: 88170 - DNA, 1067 bp, Homo sapiens
gcagccagcgggcacaggcgtggagagcatggtcacccatggagacaccgctcacggggactttcctttggccccacatcccgcagggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgggtccgggcccaagggtaggagatggagtccttgacctccacaccctggagctgagctgctgcccctttccttcctgctcttgagggttgagccccgctcctcagcatctggaccctgttgatctcaaagggctttggggataaagggaacccaggctctggtcatagtgaccaaaagacagatgtgccccagcccagcctgtacaggctgagcaaggtgggagggtggcaagtggcagttccagtggcccctggctggtatgagcagtgacactggtcctgggcattgggtgggggccgtggttacagttggggcctgctctgatgtgtctgtacttggtgctgcactaggaagatcagtttcctgctctggaggtcaagtgggctttgggcagctggctaaagagagtgctgtcagagcctgccctgactggcgtgtcccacctgccatccccaggtgcaggttgtagagttgaaagttacatggattaccaagagtttctgtccagggggcacggacagcgtcagccccccaccctctgtcatcacccaggaaaacctaggcaggtaagcatgcccttactgccagcaacccaggggcacgcgtgggacagggctctgggccctggtcacatgcctggggaggcttaagaacactgctggcctcccaggagtccagcccagctcacccccacttcttccccaaccagggtgaagcgtctcggatgctttgaccatgctcagcggcagcttggggagcgctgtctgtatgtcttcccagccaaggtagagccagccaagattgcctgggaatgtccagaaaaaaactgcgcc

SEQ ID NO: 88171 - DNA, 1016 bp, Homo sapiens
taccgttctccttatctgccgtggcctatttctgttgctcagtttctgatctgtcctggcatggggagaaacgttttcactgaggatatctgctagaggctgatgctttacttgaggcactgtgatggtgctgagcaagcactccagtggcacttggggtcttgttcgttgtgggagagtttcttgtactacctcgggctgagttgatggtagaagacgaattgtgctatttagggcatgtgggcgcattggcatctcagaatcgcaactttttggtactcactgtgtcccctggtggagaccaaacctctgttctctgttttaggtgctccatgaacacggaagatggcgccaagctctacgacgtctgcccgcacgtcagcgactcggtagtgtgctccatccaggccagcacccttctctgattgctcagtcctctggaaggaggacttcgtagcaaagacctggacccagctaaacagagcggtttcctagaaaaggggcgggtgcgcgccagagggtctaaaagtttgggtataggcagaaagtattagaacttttttttttttttttttttttgagacagagtctcactgtcgcccaggctggagtgcaacggtgcgatctcggctcactgcaacctccacctcccgggttcaagtgattctttggcctcagcctcccgagtagctgggattacaggcgtgtgccaccacacccgtctaatttttgtatttttagtggagatgaggtttcaccatgttggccaggctggtctcgaactcttgacctcgggtgatctgcccacagcctcccaaagtgctgggattacaggcgtgagccaccgcgcccggcagtattagaacttttatttgcatttttggtagcttttttttctcatcctttaaggttccactttgtctctctcagtacaggatgatgtgttagttacaatagtacatggacacacacagcaaacaagtagatatacagggggtgcgtgagcaaacaggttt

SEQ ID NO: 88172 - DNA, 1018 bp, Homo sapiens
atttttatttttactgtatttattttttagagatagggtcttactcttgtcacccaggctggagtgcattggcacaatcagggctcactgcagcgtcgaattcctgggcttaagcaatcctcccacctcagcctcttgagtagctggggctccaggtgcgtaccaccgtgcccagcttgaccccatttttaatgtcttgaaaagagacccttcctcagcccacatccaccccctcacctacctcttcctccttttcctgctcttcagccgtagttcctgaatgagctccatgctgtgattcctgtttcctgcattgccagatgttctccaggccccgccattggggattctgcccacgccacccattgggactgctgagcccaggtcagcagggacacttccccgtggcactggatctctcagcagcatcaggcattgctagccactcctttcttgacacttgttcccaattcccatggcttttccttcagctgtctctagtgactcctcagaggcacccttctgtgttccaggcacttgctggggtgcactggtgcccagtgcctgcccttgtgtggttcacattctaacccccatggggcacacagactgcaggtgtgggaacagtaagtgctgtgaagaaaaataaagcaggtggatagagaatgaggaggagcaattccagacagggtggccagagaagcccttctgaggaggtgacatctgagcagaaacttgggtgcagctatctgggggaacatttgagccatggctgttccctgtggtggccacacctccccaagcctggcgtgcctcggcttcattgcagatggaacctccgtcctgctcggacacctgcaggactgtctcgtgttccagatgtttcattggcatctggcacagcgtctgcccacccagtggttattcagtttgctgaatgggcgagggaacaactgaatggatggtctacagcatatgatgaacgggaggaagaggccactgggtgcccagaccttat

SEQ ID NO: 88173 - DNA, 1040 bp, Homo sapiens
atgcttgtgactgtcactttgtttatagccatcctagtgggcatgcatgggtattgcattgtgatttggcatgcattcctagtgatgagtgatgctgagcatcttttcatgtgcttattggccatgtgtatatcttctttagataaatgtttattcaaataagtcctgtgcttatttttgaactgagttttctgttggtctgcttattacaccctgcatttggatcttccctctctcccatggagtctcgcaggtgggctacctcttgtggcaggtgcctgtcagtgtcattgggatctgtgctagccattttgcattatgttgggatttaaccccctttcctatttcagtatgcttaagacccttagaaactgaaagggctttaagtcctaagtctttccaggaacacagatgtaattgttttaaatctggggctccacaagcatcctaggatgagaaaggggttgctaaataggttttcttggacagtgggcaagctttcaaatatttaccagtcacatgtaccgtggcatgctgggtataagtctttctaaggcggagaccatacaatctatttcttttgagtctctctcatagtacaattatagtacttcttacacagtgggatgatgaaatatttgtggattgacaggaacatactttgataactgagtcctttccgtagcagtttgacgggtctaagacatggttgtgccgaaatgtgcatgagagtgtcgggtgtgtgtgcctggcgatagggggccttgagtttccaaaggctcttggctgctgctgcctcacagattctccatgctgtgtggctgtctgctgaggggcacatgtgctgctatttatgtttggtgactttctcagtgattgtttttagtttagccttttaagaatctaatctaattttgtgagtgtgtaaagtgtggatttatccatgcctgctgcgtgacactgacagggagtgtcttccaccctaagcctggatcagttctgactgtcatggttagatcacagcaatccatgggacttaa

SEQ ID NO: 88174 - DNA, 2117 bp, Homo sapiens
atgtattcaaaatattatatcaacatataactcatatgataagtactaatgagagactgtgcgttctttttaccatagtggctactggattgggtagcactgcttcagagacttagataggagagagaaccatcgctgtgatctcctactcagcttttttccctcatagcacctggcattacctgagattatactacttcatgtcctgtttactgtccccagccggaaggtaagagaagcacagaagcatctctgtcactgctatatcctcagtgactggcccaaagtaggtgctaggagagatttgtttagtgagcacttgggaaatggcagattgcacacatgcgaatgagtggaattagtgggtgaatgactgatgcacataagggagcgagagcctagttccacctgcaggacacagttgagatgctgaaggatgtggtggggagcattaggagatgctgtcatggaggtgccttttgagttcactcttgaaagataagagcttggaatagcagcagtggagggcagggcgtcctgggcgggaagtccagtgcgcataaaggcaagagaggcaggaagttcatttcagtggtttcagacttaggcctcagaactcctttaacttaaaaattattgaggaccacaataattttttagctttgtgagcttttatttgtatgggttgtttctattaacatctaccatttaagaaaacaaacttaaaaaccaagaatgcctgggcatacattctattggccatcagagcagtgacgtcatcacacatcatgtagcctctggaaaattccactgcagactttggagaggatgagaggaaaaaaggcaaataacgtcttggtcttgttatagaaaatttttgactttggacctcctgaaagggtttcagggatccctgggccatattttgaggaccactgagctagaggtggggtggaagaagtcaggtgagagagtgctggcaggcgaggctgcacaggactgtaaataacgataacaacaaaggtttgttggcacctgccgcgttctaggcacagtcactggagaaccccgtgaagtaggtgttcttacttcacagaggaggagaggttaaggcagtgagcagaaaggcttgggctaaagccaggcaagcgcctccaaaccacgccgtcagctgcccctggaaaggccactggtgtcatgcttgctgtgtgtgtgcaggtctttggatgactgactcaggagttgggatttgttttttacataaagaggacttacatcagagtttacaatgggtgatttggcggcagtttacaaggtggaatgtggggagctaggaagcctggaggccagttaggaggattttatggggcagatgagttgtgtcctctgtgccctcggtgtgcatggcgtcacctatgcatgcatggcgtggagtgctagaggtgctgacttctcacacaaaatgacccggaagtgtgaacaaacatcttcattccgtattcagtggaagaagcagtgatctgttccagtgcaagaggaaacactggttatgttggtcttactgatggatttaagggatttttcaaggataattttaatgatgttcaatttgacttagtacctaaccccccagtaaaatctgaaatctatcgaacctaagagaacagtaataaagctttcaattattagagtagtgaggtagagagaaaggtgaggtggttggagaaggtttctcagatggggcgcaaaggtgtgaaggacgtttgaggaataacaggtaaagcatgtgtttcacagccttgcacgtacagctgagccggggtgtagtgggggaggtgggagacagagcaggagtagggacattagtgtgccagggctttgaggtgatcagaagagcgacgaggagcctttaagtttttcttttttaattgtagtaaaatatgcataacaaaatttaccattttaaccatttttaaataaacagttcagtgccattaagtacattcccattgttgtgcaaccatccccaccatccacccccagaacttttcatcattccccactgaaactctgtctcaattaaataataactcctcaaaccattaagttttatagct

SEQ ID NO: 88175 - DNA, 1089 bp, Homo sapiens
atgccagcagccacttaaaccttcatgagcactggctagacgtggtgggtccttctggtctccacctgtcatggttgggcagaacagccccctgcgaggtaagggagcaggactgctgtctgtcagttcaagttcagccttcgtttcggaggcaaagcgtttatgctttagctttcttgtgctttttcatctcttttgcattgtcttttgttttaagttgccatgacattcagggtttcaccaggtttgagatatagtgcctctaaattagggctgtctgtgatcaccctgcttttatgaagctgtgtgtgtgaaacatccctgatgacaggtccctcgggaattggctttgcagtttatttttggctcctacgctggccagcatttccatggggaaagctatttaggtgtagcatcatggcacgtgaagtttgtctcacttgtctgggtgctgggcccattaaaagcaattgttcttagtgatgtaatgtgaagaagttatataaggttaaccaagatgcaggactaagtgaatctaaattgcgttttattcagataggatcacagcacttgtagactcttaacagctgttctgtgattttattctttgtcccttgatttttccccttctagccctcgggcctcagtgccctgatggtgcttctgtctggctgctgcctgactcaagggtactttccccagatgaagggtgtgtgttttgtactgtgattggaagccaaaacccttgggtgctcttcctggctgtcacctactctgaatgaccttgaccaagtcactgcctcattttctccctctgcaatgaaataagaggtctatcttcctaaccccgatatgatcctgctcggatggaataaccagaagtgtagctgggtcaagcctaggatggccacttggttattagcagacagcattctgatgtctgtcagagagagccagccctgtgccttcagaagatcacttccatgagaaagagggtgatgctgcaccaaagaggcaccttgggaagcaaaaggtgcacgaggcgggttgtggggaaggtggttgtttcaggggcataggaattcctaa

SEQ ID NO: 88176 - DNA, 1087 bp, Homo sapiens
cgcctgctgttttctcacgacctggtgtcgggccgttaccgtggctccgtgcacttcgggctggtgcgcctcatccacggcgaggactcggactcggagggcgaggaggagggccgcgggagctcggggtgctccgaggccgggggcgcgggccacgaggagggccgggccagccccctgcgccgcggctacgtgcgcgtccagtggtacccggagggcgtcaagcagcatgtgaaggagaccaaggtgcggcgggcgggggctgggcggcgcgggcggcagggggtcggcggccgggccgaggccagggaaggacggcgtgcagggccctgcccggagcggtgccactgcagtggccgacgcgggaggacagccccagtggagggtacactccatgcaaagtcattgcagcagctctgggcgcacacgccagccaggcactgctggcccgggaccgggcgggccctgggcttcccgacttgaggggacttctaagacatgttatgctgtggtgtcggcctcgagatttagagacgtggaccgactcccgtggggactcaggttctggggcgcgttcggcgttacaccagtgcggcgttttgctgacccccaaggagctcggtactgcattgtgcatccagaaatgaaggccgtgccgggtccgtgcagggaggggttgtgggcattccaaaacaaagatagaggtgaaaatcccagccgaacccaagaagttcactagcttacaggctgcattatggtgaagccacccagcctctttttgttttaccctgctgcctccttttaattgctgcagggaactttgtgagtaaaatcattagcaatcagagccccggtatgaatagtacttgggggggaggattctgacagctgcgaccgggattgatgactcctaagtgcatatggactccttgaaaaaaataatccagaaccctgggtagaggggagtcaccaatttggaaacccgaaggttttttcttgacctgaagctgttaagcagacatctgactcccgtatggtttttggggtgatgctagtgagtatagcagttttacaaaacaaagaggct

SEQ ID NO: 88177 - DNA, 1471 bp, Homo sapiens
caaatgaccatcctgagggacctggagaagctggccggctggcaccgtatcgccatcatcttcatcctcagtggcatcacaggcaacctcgccagtgccatctttctcccataccgggcagaggtaaggatgtggaggatgggaccccttccgcacatagggggccagccctgctgctcctattccacccacctgggatctgccagagggacacggtgcccctcctgtactgggctccacagcggagggacagctaatctgggggcttactggctggtctcttaatcccagtgagagggaacagtgatgctcttgagtcaccctgtccctccaccgcctcatttatcttcctaaccgtgcccactgcctgacagtatgctaggtatctgcaggtcgagcggtaggaaatggcctccgtgcgccgtcggcagtctgatcagttccacctgactgatctagtttgttcagtgtccgtcctctccccaccgtgtgcggcctggaacaggcttgtctgtcttgcttattgctacggacccacaccaggcacgtacacagtaggcgctcagtgtttgctgaaagaatgggcggagcaggcccagctttggtccagcagctccagccgaccccctgcccctcagcctcaggggtccccatgcctgccagggaggagctgatcgatgggatgacccagggtgcaggcccggcccaggccacccacctgatgcctgaagccacgtctcccctgccccgccccaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctga

SEQ ID NO: 88178 - DNA, 1066 bp, Homo sapiens
ccaattcattgtgaagagcccgtctgttcagctgtgtcctgcccttgaattgaggttccggggggcagtgtttgggacagactccttacactgtattttcttgtcccccaccccaggaagaaatgagctccatgcctgatgatgtctttgagtcccccccactctctgccagctacttccgagggatcccacactcagcctcccctgtctcccccgatggggtgcaaatccctctgtgagtgctggggcagagtccctcctccaggccagccaccagcctgggggcatccccagacctcaccctggcccccaagccccttctgagcaccctggtggggtctgggagtattttggtgggggattcaggctgaaagccaccatccccaccaggaaggagtatggccgagccccagtccccgggccccggcgcggcaagcgcatcgcctccaaggtgaagcactttgcctttgatcggaagaagcggcactacggcctcggcgtggtgggcaactggctgaaccgcagctaccgccgcagcatcagcagcactgtgcagcggcagctggagagcttcgacagccaccggtgaggtgtcgccctggagcccccaggagagcctggaaggttccaaattcctctgggccctcctgaagcgcccccttactcattcagcaagtgtttcatgagcatcttctgcggatcaggagtgtagtgacaagctcgaaggcgcaccctgtcccaagggttgtgcacatgacctgggaagggccaggggtgcttgctgcctctcttccaccccatgctttctgagcctggtccccagccttgctcccagacagcagtcagtcaacaaatgttcattgagtgtcactgcctgcaggccctaaaatggaacccccagagggtggagcagggagggcagggtcggtcagaggacagttagaagctggggccagggctgggcgccgtggctcacacttgtaattatagcactttgggaggctgagtcagaaggattgcttgagcctaggagtttgagaccagcctgggcaacatagtgagaccc

SEQ ID NO: 88179 - DNA, 1056 bp, Homo sapiens
ggcgccagatgtaggggcaagacgattgggcagagatttaaacctccggaggaagagaggagactgcgcagggcagtcccgcctgcgtcccagaagtgcctgcagttcagacccttctctcccctccactttctcccgggtgagcaccgggcggaccggggccgaagtttgttggttgagccagccaaggtggaaacaggtgcgggggtggggatgagggactcacacagcagggctggaccggagctcagaaattggacccaggagtcctgacttctggatggaggggctggggaaggttggccctgggcttgccttttacctgtttggcccctcggatgttcccccagggcattgggatagagacggataagttccctagggtacagaccccgccccactcccacgccagggcgcaaaggaagcctaggttttggccctgccccattccatgaaagattaacggagggggctctagggttggagctactgagagggtggcagcgggtgtgtctgaggagcagaaggcggtggggagctgaccccacttggggagaggctgctgttgcctgggcggctggcatcaggcccccagtgtgtgccatttgctggtaatataatgagaccagcatctgccttattcgaccctcactgtccgtagggcaggcagtggaaagggaggcgtgttttagagctgtggttctcaaccaggggcgactttgcctgccatgggatatttggcaatgttggagtcattttgggtgtcacacacttgggaggggaagtgagtgttgttgttactggcaggtagtgggtagaggccagggacgctaccagacatcttcagggcacggaacagcccacataacgaggaattatccagcccaaggtgttgggctgtgctgaggctgagaaaccctgcgcagcagctggtccatcaggttccttctcaatgatgctccctcactggggaaactacctcagttttccagagtggttaggggaggaacttggaataaacctgaatgagatgaggggtaaggcagtgtgagggca

SEQ ID NO: 88180 - DNA, 2095 bp, Homo sapiens
tcactaacccagcgaaccaccccaaatgcccctatcctcccccaaataaaatccgcagagcaattaacaaagatactcggccaagccccggtttcctcatctgtccctgccccctcgaactttctgtgcttccccagtctcgaccagggacaaactgtgttgaagctcaatgactttctggcagaagtgaacctccagcttcgttttctgacagccgtggttcttcacaggcctggtttcccactccggaccctccactgcccctggtggcggccaccatcttacccccagctccagggtcgcgctgaggacgcggccagcccccagccgccgtagttttgaactacatttcccaccagccctttctcaacatcgcgagagttccggagagattgccgagaagacttgcgcgcaggggcggtctcgcgttcttttcgaggtcggccgcgtggctggaagacatggccactccagtcggtgttgagcacggcgagcagtctcaggcctttagtgatgatggtaaggctgcctgggtgggaaaacggggtcttccttgacacgacactaacatacttggcttcccttcctcagagacgaagtggtgacgataatctcggtttctccctcatagggtggttaggagggttaaaagtactggatgagaaaatgctttccaaacgttgagaaaatgttactatgtgaagggagagagctcaagcccgtcctcggcgtcatagggccggcttctgcgggggagagcgcctaacaacctgggcagccccgtgcgcctccgccgcgcgtgtgctgagcgtcatgcccaggggtcttcggtgcccgcgcacgggcagactctgacgatggtggttcttaattcagcatcaggagtgttaacgtgtgaagacgtgattccgcttggagtgtcttgaggacggccccaatcggtagttcatatttagctttacagataggagtcaataggattgtaaacttctggaaagccgtagttttaacaacgagccttttttcctcccccagaggcctttctttgtttggcatctgcagagacggtgaaaagcagagctccaggttgaaggatcagagtaatagatggagcccttaacatgagtaagagtgggtgcaggcagggcctgagtggtcactagaaatgagaaagcacagttggtgccatcacatacattcacctcctgctttattctgaagttcaagtatgagaatacgtgttgacatacaagccagctatggtaagaaattactcaaaattcagaatgctaattattttaatgataaaaatgagtagcgtctttgcccgtgtgatttggggccactaggtgtcattgtaaccagcgtggatcctcgttagggcatgcagggatgaaagagacatggcaaatgaattttggatcgctaggatttaggaatctttgttattggctgagctgaggatgatttaaagttatccctgtctgaaatggtatcttttgtgaggaggtctgacttgctgaggctcagctgtttaatacaaatctggagaataaaccttaaggtggtttctgttagaatgaagcctgttatccttctcttttagattaaaggtggtggctgtggccttgaaaacagtcatgtgaaaactcatcaccttaaggtgttaagtgtaaggatcttcatgatgaaatttctgtaaatggtgagatttttagtactttcatagacttgaatatgcttatggtcctctttaagtattggtttgttagttttggggatgtgttggtcttccagggttacgattgcccagataatggaagtagtatggaattccttttgatagggtccttgccaagcactctcataaagagcattttttgtttgtttgttttgagacagagttttgctcttgttgcccaggctggagtgcgatggtgcgatcttggctcagcgcaacctctgcctcctgggttcaagctagtctcctgcctcagcctcccaagtagctgggattacaggcatgcaccaccacgcctagctaattttgtgtttttagtagagacggggtttctccatgttggtcaggctggtc

SEQ ID NO: 88181 - DNA, 2518 bp, Homo sapiens
ctgtctgaaggcaaagaaaggcctttctgtgtggaatttgaatatctgaaactcagtttcccaagtttgccttacagaaattttaagttacttgagagttactctgtgtgtatcttcttaagtagttttttttcttaatttctcttcccaggtgcagtcagcctcagtttccaaagccggaaaaggatcctctagtagccacggtgtggcagctgctctgaaccaggacctggacccggacccaaagtgccatgtctttaatgtgagtaagtagacgaactggtaaacaggcttggtttggtttgggggagtggtaatcttttttgcttcccctgctctggacttaaagcaatgggggcagggagactttagtagcattttgttgctaggtgtctgcaataagagacgaaactgaactgctttgccggaaacaagtgaaatgattgctttcctgtttgtaagatttgtttacatctttcgtatccgtaagaagtcccacaagcctatgatggttagttatccctgtctgaaaatctggactgagggaaataatctattctgaggcttaagggtttggctccatggttttttttttgtttttgttttttttcccctttttttttccctcagcatatcctgctgagagcccagtctagagcatcattcctctaaaacgtgaaaagcaaatgagtgattgtcctgctttctctagtcctttgattatggctctgaggatacaggctgtatgaggtggcaggaatgcacaagtacccaggatttgatttatgcccttattgtggaatgaaagtgcttgttacatatttcaagaaaatgaatgcgctcttagaaacagattggaatgtaggatgtatgccagcttgtggcaatgagaatgcttaatgactctgaccttgcctctgctccagggtcctgacatttaggggaaaccacggctgtttggtttctatgtgctttgttaaggacgccagggaggtctcctaagtttgtagcttagatcctgtctgaatgtcacgactggcatgtgagcaagaaagaaaccaagtggtgctggagagtggggtgcccagctttgttcccactggaatgccaggcttgaagtgcacacagattgcctttcttttctgttgaaaggggaggtgtgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcctgcctgggtgacagagcgagactccgtctcaaaaaaaaaaaaaaaaaaaagaaaggggaggtgtgtgcaaactctttgtatttaaggttgtgtttttgctggacaccaaagaagctgtattctgggtgagatttaatgagcctaaaaactggccccagtagtttacagcctgcaagtaaaacagtgaaaagggtagcttatcaagtggttattgtctgctgagtggacttgactacagaactcaagtaaaccataagatttgacttgaaatgtttctatccagagggagtgctttctgatagttgtttactggcctcttaccagaaactgctccctcagagatactgtctccttaaaatgagtcatcctggatctccaccagcctgcaccaaaatggtgtgatagtgccccgttacgctcccccaacgcgcacatgcctgccggtggtgagagtgagtgctcttggactgactgcctgttctcccaaattagttgttatatagcattcagttttgagtcacttccttggctgttacttcaaattattcttctgttttataggttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgt

SEQ ID NO: 88182 - DNA, 1880 bp, Homo sapiens
tcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtcagctgagttcaaatttactgacgccatgatatgaggatgaaggtttattacctggtgacatcatcctgttggtgacaaggtggtgatacatctctaatgggacttccctcagtggcaggcaggctgccaagcaactaacccccatcaagtgccagaccctcccagtgttctgagagtcatctccatgctaaacagcctgcgttttatatgatttctctacccagccaaaaaaaaaaaaatggtccatcatgtacgcagttatctagtcttaagttatattctggcttttttctcccactttattatggagcagaagtaagcctatcatgttcttagaaaggctcttaagaggtgtcctggagtccttgaatcactttagcatctggggtaggatgtgccaccaggaggatttgggctggagcgtgtgtgtttgcctttgacctggactgctgtctgatcttgctgaacactccaccgacatttcctaaagttgctcagtgccaatccagcaaagcagtccattttcccttggccaagattgagatgtattgttttagatacagaagagttcttggatgagccaaggacaagctggggtgtcctatattgaacagacctcgatgaaaatcttgaattcaccccagtgccctctgttggcaagggaaggtgaagattgaaaagttaaaaaagcttttggccacttgagaggatcagggccgcaactcttgaagaagcaaagggctcagtgcattggggtcagcgctggtacagctgaaggatgccggccttgtgcaggtccctccacagggcagcttccagggacagatcgtggtttgcataaaatatcaatggcttcatttttcgttcgaaatagtggtcggaaaatttccagtagttgcttgtgatgaatccataggcactgacctgggcaaggatagtcgctggattagtatttgttgagcgtctagtgtgtacagacacttgggtgaagtgacatgagtttagaaaggtgtccgtctgctgaggtgaggataatggtctagggcttattcccacttagcaagtggggagatggattcaggggtgactcactgtgtccccacttggcatagctggtgattgccagagctggatttggaactcaagggtggaggcaaaagcccattactactctctccatcctaactggggactgcagtcaagacactcctgcatcagaataggaaaaggccctgtgtggtggctcacgcctgtaatcccaacactgggaagctgaggtgggaggatcacttgagcttggaagtttgagaccagcctgggcaacatggtaagaccctgtctctacaaaaagtaaaaaaaaaaaaaaagagctgggcgtggcagtacatgcctgtgatccca

SEQ ID NO: 88183 - DNA, 1029 bp, Homo sapiens
gcagcactcttggaactggggattccacgaacagaggccaagagtcccagctccgaggtaagggatatcaggggatcctgttgggttctgttatcctgtgttctgccggcatgggcttctggaagagaaggcctcttacctggtcacaggtatgcaaagctgtcagcagcatgagagccccggtactaggcatatataggtctccaaaatgtgtgttaatcaactttgatttcaagaacctggaagcaaaaagagacatttcagctcactagcttgatggctatcatcacacttcacaactacacattcaaataggtgggaaaacttcaaaaactgagggccttctactccagtcagttctttattcggtccaagtggactaaatacaaagatctttgagaccttaggtaaggttgggggagggggtggtgagaaaggaaccacaggttcccccttttggcaacagcttgttttcaccccaagctactaagtaaccacactgccaagggcataggtggcctgtttatttagcctgagactgcagtttctctctactccacatcttgattaagtaggaatcacgtgtgagggacagggagctcagaccctgtgaccggacccacacagtccaagagtgaggccagggtgtgaccacgggctctgccctcaggcctgagttcacatcgagctgtgccaggccgatcacctgacctctcagagcctgtcttcctctgtagcacgggactaattagaggggcttcatttgcctccccacatccacacacccctctccaactgctccctgccctgggattcgagcctctggtccacagcagggtttctcagtctcagtgctgttgacacttggggccaggtgcttcttgtgatgttcagcagcatccctggcctctacccactgatggcacttgccgccaccacccttgtgacaaccccagacgaggaccatatgcacatccacattgagaacccctggcaggagggagggaagggggttgaggctggtccccg

SEQ ID NO: 88184 - DNA, 1049 bp, Homo sapiens
gagggcgctgactggatgtgggtgggtgtgtaaaagggggaaggaaggggacgctgttcttcaggcaccccactccgtacctttctgtcaggtagctgatgaagtccggatgtagcagcttgaatttactggcagaggcttctggtccaaaataggcgtgcggcctaggacccatgatagaagtggacagagcgcccagagccgtcgtattgcaagggggagatggaggggagggtcagggcgccggagtagccgcggtaccctgagcggtaggagcggggctgggagtagtagcgggagaagggggtgtagaaggtggcaggcagtacgttggggaccacgtgcggcttcccgctcaccaggacctccacgggcggggtgtaggagagagaggaggggggcatgaacagaccggggggagttgggaaggggcagttaaactgggggtggtgggggggcgggggaaggagaggtaagtagagtgagtcaggagggggtgggggcttccgggcagggcagggagagggacaggcaaagcatgggttttggggaagtggtgctgtggggggctggaaaaaggggggctccttcagaaagcggggcacatagggggtgatataggacgggatgttctgaattggcccgatataggaagatgaggtggcagggctgtagaaggaggacttggggggcacagcgggggttagggaagggtttcgagagagggatttgaaaccagactgggagggagatttggaggtgggtggggtgggggtttgggcagccccgcggggcacgtgttggacctgaggactggggttcagggacgaagtccgggaagagggctgtgaggcatttggggtgggagggtgggaggggggccgggaggaagagccccgagtgggggagggggaaggggcaggctgctggcctggaggggtgacaatgttgttggaacgggactgggagggagactgggtaggggatggattaggggtgtgggaaggggagctcattggtgttggggaggcttaggtccacccgatgtc

SEQ ID NO: 88185 - DNA, 1011 bp, Homo sapiens
cagagccccctctacattatacctgcacccaaacccccacaggcctccgattcttttcttttgcaatatacagtcttttttatttttgagatggagtctcgctctgtcactcaggctggagtgcaatggcacaatctcagctcactacaacctccgcctcccgggttcaagtgattcttgtgcctcagcctcccaagtagctgggattaggcacgcaccaccacgcctggctaatttttgtatttttaatagagacatggtttcaccatgttgcccaggctggtctcgaactcctggcctcaagtgattcacccacctcacccttccaaagttctggtattacaggtgtgagccaccgtgcccagcccagtcttttttaagccctgagctcacttctctagcaccagtcttaagaagataaggtattcaagttcttaagacaagtgaaggccgccaagccccctcttccactgtcagcttttcaattctccccccacagacatctccttcccctcccaccctctgtgcttcttgggaggggctagggtcaggcctcaggggagatggggcaccagaaccagcctagggaaggccccaggtgcccccgatgccagccctcctcatggctgctccccatctgcacccacagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcaggtatgaggggtaggagctggggaggggcgggagggagagttgcctggagggtgggggtgtctcccccaggggcagtgggctatggcagcagtggcctgggcggctcagcagttgtgaccagcacacgggcatggacaaggcaaaaacaaacagtaggccctgaggacggagcatgggtgcccatgcaggggac

SEQ ID NO: 88186 - DNA, 1062 bp, Homo sapiens
gggccctgaagcttctcaaaccttctgggcaagcaagggcatcttttcagagcttggagtttgctccagggtgagcagtttaaatgtgacttttataggaagtagatattttgaggagtagaatataaaattcacaggactatttaagatacaatcttaagactccaaagaactgttcagctggctacaccccatgagtacatatttattcatccttctctgctgttgggccacaagaaaccctattggtcaggtctgagaggccctgaagggacggatgctcagctgtaacttagggcgttccaaagagctcctgcccagcaatctcatgagagtgttctcgtttgctcttcttccctcctccccactaatttgagggtgctcaaaactgccacagggtagtcgaccactctacctttcctgtccaagaattcgatgccttggattgaaagaatgcttcaaatgatgtggtgtccctgggggaaaaagcagaaaaaagcaggggtcagcagctctgacctaccccttggaagcttttggactgaccgacccccttagctctaggggcggacaaagtctgtctgtgcccatcgtggtggctcacatctgtaatcccagtgctttgctggagtacagtggtgcaatctcggctcactgcaacctctgcctcctgggttcaagtgattctcctgcctcagcctcctgagtagctgggattacaggcatgcgccaccacacccagctaattttgtatttttagtagagacggggtttttccatgttggtcaggctggtctcgaactcccgacttcaggtgatctgcccaccttggccttccaaagtgctgggattacaggcgtaagccactgcgcccagctctgtgctcttattcttgccatgtctttctctttaggcacacaggatactgtcactttcttatgttttgcctcactgtgtaaactcaaagatcaaggcgtccctcagcaagtggcagaaatgtggagtttataggaacagtgagatggtggcttaaaatatatgaaaatagaaaagattgccagc

SEQ ID NO: 88187 - DNA, 1506 bp, Homo sapiens
cattccagcctgggtgaaagagtgaaactcctggccgggtgcggtggctcacgtctgtaatcccagcactttgggaggcctaggcgggtggatcacaagttcaggagatcgagaccatcctggctaacacggtaaaaccccatctctactaaaaatacaaaaaaattagccaggtgtggcggcgggtgcctgtagtctcagctacttaggaggctgaggcccaggctactcgggaggctgaggcaggagaatggcgtgaacctgggaggtggagctcgtagtaaggggagatcgcaccactgcactccagcctgggtgacagagtgagactccatctcaaaaaaaaaaagagtgaaagtttgtctcaaaaagaaaataaaagaaaaatgtgttctctaaatattatttttacctcctaaaggaggaagagaaaggatcttgctgtgtcagcctctattattagtgtcccttctagagggcagtaaggggatagtgttactatcccctcccaatgcccaattcccaggcgctaggtggcccctgaatcagggcagaaggaaaacatgaaggaaggaataggggtccttaccctttcaaaaggtggccaggcttctctcagacccctcccttcaccccagcagccacaggtggaggggactctgggttggcagcttgcaagagaaacaaaggtctcttgttacctgcttctaggtgctgagatgcctgagccacaagggaacccaggatctgcctccctttggtttccaggtttcctataagaccctggagggacggcccagaaagagcagagttgatcccttcccccatccctcccttgccccttggactgtccacttgtctgcccacataatcccgtagttcctgctcatgagcacaatatgaccccctctgggaaggaactaggacggtggtgctcagcctaggttgcctatgagaacccccagggaggcttgaaaaaccccattgctcagccccgaaatcctgagattctgatctgactgttctggggtcgggggagggcattggtgagtccagtccctaccctcccaccccaaccaggtgattctgctgtgcagccaggctggagagcctgacggaggagctgcgggacagggcagagttgagacgggtgggggacaggggtagagctgtaaaggagatgatggggaacccccaagttcagttttgctgccctgaactacccaccctcagggaggcctggtgtgactttagagtatccctggtgctcagccacttctcccagccccgctcctactgatccttccagcccctccctctcaggaatccaagtgcctgggacacctgggagggcgtaggaaggggaccagcctgcacatgcccttctgggaggttttaccagcctgaggaggtatacagaccatgtgctgcgtttttcagaaagctaattttactcacaacttagatcatattctcttttttatttttatttttattttttttaag

SEQ ID NO: 88188 - DNA, 1037 bp, Homo sapiens
tgtcgttgttgttgagacggagtctcgctctgtcacccaggctggagtgcactggcacgatctcggctcactgcaagctccgcctcccgggttcacgccattctcctgcctcagcctcccaagtagctgggactacaggcgcccaccaccacatctggctaattttttgtatttttagtagagatggggtttcactgtgttagccaggatggtctcgatctcctgacctcgtgatccgcccgccttggcctcccaaagtgctgggattacaggcgtgagccaccgcgcctggccaagataaacagagtttcttacaactgtgcatggatagatcaagagtccactgggctggtggcagatccctggtggcagcaatacaatggcgttgtcccaaatggacagttccagcagcaagatcttggatgtagtctcactgcctggtcacatgaccacttatttgaagtcaactttataccttatgaaagcactcagaactggattaagaaacagaggacgtaactgagactttatgtgtgtgtaggcgtgggtgtgtggtgagggcagtgccacccagtgacctccagctggtactctgaaactgtgcatgcctccccagcctccaatctactctggctgagtcctcttgggaaactcccagaggctgcactttcccccagaatgcaagaccaggcaagctctcctttttgctgctggtccctagtgacaatctctcacctcagcaccaaaacaaagcaagtcctcacctgctcctttccccagggagccctggatctcagatgtacttgccaagtcctgtgtgattgcctccctggctgctgtcttacttcagagaggcagttgtggggacagacagagtcagggacatctgctccagccactgttccccgagaatcccgtagctgggttcccttggaataaaaaaaggaagtggggaggaatgccaaggaagaggacacttcgaacatctctgagcttcacacactccaaacggcagtagagcacttaagagaggggac

SEQ ID NO: 88189 - DNA, 1054 bp, Homo sapiens
gagtcttgtagggctgagctctgcctcataatgagcttggggcaggacaagacaaagtctagaagcagagcccaggaggtgaggagagggtgggctgggcttcctctcaggaggggcttcagagctgggagccagagggaaggcgtggtggcaaaaactcaccgtctgaaggcctcctatttcgaagctgtatttttcctcaaaatcccaccgaggctcagatttgaagttggcggccttcagtctttggtttctctgcgtcgtggggctctggaaaggggcagggggtggggtggcctgaggtttcttctccttaggtgggatgactgctgtggtcactcctttctgtctcgtccttgttgacactgctcctgtgggagccagcattctgtgctgacttttgggaatgagcgtcttggctgtggttgccgctttgccctggtgcttctctgacaccgtcctggaggccgtcagcttcctggtctggcccccatttccttgggtcgtctttgtgtcctggctcttccatgattgtgcctctgtcctgccagaggccatccctgcatcttgccctctgggtgacagtgtgttcaccatggttttctctttttctgggctcttccatgctgccctctgtgctgtgtggggcaccttgtcctgctcctccggcggtgcctggttggcctcctttcctctgtctccggtggtgtgggccttgggctgggtttgtgtgttgagggcattgttctctggcactggctctgcatagatggttgtcctccttgcccttgtgggtgcctgggacttaggctttgccagggactgtagagacctttctttaatgttctctgtgcgttgatgcctagggacagagataacctttgatgaaggctgaagattgtggaaacaggtcagaagcataagtagttttttgtttttttttttttttttgagacacagtcttgctctgtcacccaggctggagtgcagtggtacgatttcagctcactgcaacctccatctcctgggttcaagtcattctcctgccccaccc

SEQ ID NO: 88190 - DNA, 1168 bp, Homo sapiens
tgttgttatcaaaccactaaaaccacaggccagctagcagggtgctctctctccgcctgtcaggttccaccctcccggcctccatgcctctgatgcctttcccagctctcagggtccagtcgagttgcagctacaagctgcacgtcccctaactttaaatttactagctcagccaacagatctgcatctagaacctgaagctttagtggttgccagttccagcactccccaggagcttcagttcacaggctctcatgacaattaggaagtgggactggaagcagaaggcccccaattagttccccgacatgctgaagtggtcagtctcatccttgaactactcacagatcaaattccttccgcctggggccagaaagcggtcaggtctgtaaatccagaggcagctgctgcttaagatcctgcttgccactgtctgcccgcctcctcagctctcccctcgggccggagtttcacacacttcatgcctctggtggcgtccctgggttccgctgaagctgctgtgggaagtgccacctccagtttcacagtgtggctaggacagtgggcttgcaggctggtgacagctcccctgagcaagaggcctcctcctcctcccccagagctagggaagctggcagggcttggctggcttcacagcttggcaggagaaagaacaggcgcggctgtcagctcctctccatcacttcttcccaccttgtggtctcagagggaaaatgaacccaggctatagactgggctggctctgatagatcaggacccacccctccatttgaggtctgcagggctgtcttgactcctctggaaatggacatgactctagaggaaggtgctagtgtggtaaaacagggaaggggaggaggaggccaaggaaccccagctgtggggtagttctggttcttccatctgatgtatgcaagaaactacagacaatagacctgccagtgtgaatttccagctcaggctggaaatgcgtgctgactgtgaccaccaggagagggcgtcagagggacaagatcagacctgctgggttctcagtggtcccagggctggcagtgtgtcttggttcataaaagacgggcatgcagttggctccatctggaagcgtgcatcctagggtgccagtatcccccgaggggacaaaactcag

SEQ ID NO: 88191 - DNA, 1057 bp, Homo sapiens
ctcagcctccctgctgagagggccagtaagggtggtggcttctgttctccctggactcttgggcatctgaggcccacttaccccgccccgtaggccactgcgtgctgtgatttggtcacaccgcaggccttatgatacaacaggtcttttgtcactggatacagtggatgccagataaggtttctgaaggggagggctgctgctcttcagttcagttttacgctcccagtgaggggggaccatctctgttatttgacacctcgtatttcttacaaatctaattgtttctactcttagaaatagaatctaaccaatgcaactctgatcattatgtgctgtgctgtggaaaggaaagatttttttaaaaatcaactgggaagggttcaggaagtaaaactaggaagagaaactttttgtcctaagggaataaaactaagactaacttaaggaaaattgtgcctcgtgtattggtggcacggctggctcatttatgcaggtggtagtaaattgtgtgtagttagtataattttccttgcagaaaaacatgggcaccgtattgggtttctcttgttcccagcctggggttttgtcctcaccattgtacagtatccattctgaacggacacacctggcattcccaggtgtttctgagagacacaggcctcgactctgagtgagtctttgtgagtgggtatggctgtcagtgcactgagaacaacacttcttgcctctcaggattttgaagcaagagcaccccgagttggcagtcctcgcagactcggttgaccttcaggagtccacagggatagcttccgacagctccagcgactcttccagctcctccagctccagttcgtcagactccgactcagaggtgaggccttgctctctggctgactcctggagcctccaaggctcatgtaactcagtcataaccaggtgtgactcttcctcctcctatccaggagaaggatatgaaagtttttccacgttgttctaagggttacacagttgtcaccattcctgctgagtggtgtatcttgcccattttacagct

SEQ ID NO: 88192 - DNA, 1094 bp, Homo sapiens
gaggctcacccgcaccccgcggagtttggggtccccgaggcgcggattccggggcgggtctgcttcctcccgtgctgtggccgcccgtctgctctggcggacgacgggagtcccacgcctgtggcgctctcaactagaaggcccgtcgtccctgactcctttgggcggcgggtcccctaggggacctggctgtcaaggctcatggggggtggctctaggaacgacgtggcctcacgcacgcgccctgcccccaccccggaggagccagacgagagtcaacttccttcggtttgtcattaccagttggccttggggacacccttatctgccactggactttttttttttttttaactggacaggtcttttttaattccctcaggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtaaagtattctgcagctaagtggttaaaatccttttcttttttttttttttttttttttgagacagagcgtcactcttgtagcccaggctgcagtgccgtggtgcgatctcggctcacagcaacctccatctcccgagttcaagcgcttctcctgcctcagcctcctgtaactgggattacaggcatgcgccaccacacccagctaattttgtatttttagtagagacggggtttcaccatgttggtcaggctggtctcgaactcccgacttcaggtgatctgcccgcctcggcctcccaaagtgctgcgattgcaggtgtg

SEQ ID NO: 88193 - DNA, 1059 bp, Homo sapiens
tccagggttcaagcaattctgtttcagcctcccgagtagctgggattacaggcgtgcaccaccaggcccggctactttttgtatttttagtagagatggggtttcaccacattggccaggctggtctcgaactcctgacctcaaatgatgcacccgcctcagcctcccaaaatgctgggattacaggcgtgagccaccatgcccagccgaaaaaccactttttaaatgaaaaaaagttccaggataatctctgtaccttaagacaaaaacaaaacaacattcttagctcacagaccttacaaactagctaaattacccgatttaaaaatatttaacaaaagctaaaaacaagcaatatacacatgtcaacttaacacatctgaacataacctagaactctggaaacttcaggggcatttgtacctctaagatggccttgcctggcagagatcttctgtgaaaccaaaggtactgggccaggaccacagcacagggccaaacatacattccatactggagatgcaggacctgaaaagaatgtttttgtgtgccataaataatttagctgctggaagttggaatcattcatacagcaatttctgtcaggcattggcatccattacaaaaatggcagccctgttcaccaatccacgacctttggggatataaaactgcaatgcaatgtgatagaaactcttgatagcactgtttattcaacaagtgcttctagtgtcacagtatcagggatcattctcagactggggatatagctctccctgagcacatatcctactgtagagaggcaacgagcaagcaaataagatatttctagtcaggggccgggcacggtgactcaggcctgtcatcccagcactttgggaggatgaggcgggcggatcacctgaggtcaggagtttgagaccagcctggctaacatggtgaaacccctgtctctactaaaaatacaaaaaattagccgggcatggtggcacgtgcctgtaatcccagctgaggcgggaaaatcgcttgaacacgggaggcggaggttgcagtgagccg

SEQ ID NO: 88194 - DNA, 4288 bp, Homo sapiens
gccaccatgcccggctaattttttgtatttttagtagagacaggggtttcaccatgttagccaggctggtctcaaactcctgacctcaggtgatccgcccgcctcatcctcccaaagtgctgggatgacaggcctgagtcaccgtgcccggcccctgactagaaatatcttatttgcttgctcgttgcctctctacagtaggatatgtgctcagggagagctatatccccagtctgagaatgatccctgatactgtgacactagaagcacttgttgaataaacagtgctatcaagagtttctatcacattgcattgcagttttatatccccaaaggtcgtggattggtgaacagggctgccatttttgtaatggatgccaatgcctgacagaaattgctgtatgaatgattccaacttccagcagctaaattatttatggcacacaaaaacattcttttcaggtcctgcatctccagtatggaatgtatgtttggccctgtgctgtggtcctggcccagtacctttggtttcacagaagatctctgccaggcaaggccatcttagaggtacaaatgcccctgaagtttccagagttctaggttatgttcagatgtgttaagttgacatgtgtatattgcttgtttttagcttttgttaaatatttttaaatcgggtaatttagctagtttgtaaggtctgtgagctaagaatgttgttttgtttttgtcttaaggtacagagattatcctggaactttttttcatttaaaaagtggtttttcggctgggcatggtggctcacgcctgtaatcccagcattttgggaggctgaggcgggtgcatcatttgaggtcaggagttcgagaccagcctggccaatgtggtgaaaccccatctctactaaaaatacaaaaagtagccgggcctggtggtgcacgcctgtaatcccagctactcgggaggctgaaacagaattgcttgaaccctggaggcggaggttacagtgagcaaagatcgcaccattgccctccagcctgggcaacagagcgagactccatctcaaaaaaaaaaaaaagtggttttttaaagaagatactgggtgtgatggctcacacctgtaatcccagtactttggaaggtcgaggtgggaagatgacttgagcccaggagtttgataccagcctggtcaacatagtgagacgctgtctctaagaaaaaagaaaagtgtgacagagatgataggtggaccacaaagcctaaaatattgactctctagccctttagtttgctgaccgctattctagatgaagcccctgaactgccttccacggccgtggcagtctttaaggccattgttttaggtgtcccagcagtgtcatgcagcctttttatattcaggttgctgtaacaaaataccataaactgggtggcttacaaataacagaaatttatgtctcttgccgggcgctgtggcccatgcctgtaatcccagcactttgggaggccaaggcgggcggattgcctgaggtcaggagttcaagaccagcctggccaacatggtgaaaccccgtctctactataaatagaaaaaattggctgggcgtggtggctcatgcctgtaatcccagcactttgggaggctgaggcgggcggatcacgaggtcaggagatcgagaccatcctggctaacacggtgaaaccccgtctctactaaaaatacaaaaaaaattagccgggcctggtggcgggcgcctgtagtcccagctactcgggaggctgaggcaggagaatggtgggtgaacccgggaggcggagcttgcagtgagccgagatcgcaccactgcactccagcctgggcgacagagcgagactccatctcaaaaaaaaaaaagataaaattagccaggcctggtggcacatgcctgtagtcccagctactcaggaggctgaggtaggagaatcgcctgaacccaggaggtggaggctgcagtcagctgagattgtgccactgcactccagcctgggcaacagagcgagactgcatctcaaaagaataaagaaatttgggtatcagttctggaggcagtgaagtcccaggatgaaagtccttacaggttcagtgtctggtgagggccagaattctggttcagacagtgtcctctgtgttcttaagtgtcttgtaccttaagaagcaaagcaactctccagggcattttataagggcactaatcatgagaactctgcctttatgtaattgcctcccaaggcccacatcagatgggtaattaggatttgaacatatgaattttgggtgaacacattcagaccgtagtgtagccctttctgtttttggaaatgttgagattagtgtaaaaatgtatcccattctctttctaacctcactacctggcctcagactggtgaaggcttggaaaaaccaattttatcacatttgcagaaatagactttcacaccatacttaagaccaaaggctaaatagacaaaccagaagcttaatattaacatcccactcttaacttttactacaccaagtaaatgaaattaggggtaggatttggcacacacctctggtcctagttgtaattgctgggcactcacaataattctatctctgtgtccttccttgaactggaaaatgggaagcttgtgtttatgctaatacttatgaaggcattccctggtattatttcttagtgtctgcaaagcatcttgccgctttgaaggcccaactggaaaatctttactagaaagccatgttgcagacctgttaggttttagctacagaaaagcaatcaactatagaacatgctaacagaagtgaaaattaggctgagtgctgtggctcatgcctgtaatcccagcactttgggagactgaggctggtggatcacttgaggtcaggagttcaagaccagcctggccaacatggtgaaacccagtccctactaaaaaatacaaaatactagccgagtggctgggcacggtggctcatgcctgtaatcctagcactttgggaggccgagacaggtggatcacctgtcgggagttcaagaccagcctgaccaacagggagaaaccctgtctctactaaagaaatacaaaattagctgggcttggtggtgcacgcctgtaatcccagctacttgggaggctgaggcagaattgcttgaacccgggaggcgggggttgcagtgagccaagattgcaccattgtactccagcctgagcaacaagagccaaacgctctcaaaaaaaaaaaattagctgggcttggtggccagttactcaggaggctgaggcaggagaatcactggaacccgggaagcagaggttgcagtgagccgatattgcaccactgcactccagcctggagaacagagcaagactccgtctcaaaaaaataaaacaaaactgaaaatcatggcagaggaatcaagtgccccaaaactacttctgtgtgcatagcaattaactgccagttacgatacatggccctttaatattgaaattgaaggttaagcttttaccttttagcagagtagattcataaggaatgtacttttgtcatgtttatagtaatgttcagttacggtacattttatacaaacccagaaagactgactctatgcttatttaaaaatgcaagaatataatgaaaaagtactaagattcccaattatttgcagttccaagtataattgtgaaatgccatctttcataacttattagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaaggtaagcttttttggctcaatagtacatttggccagtgatgctatatgaaaatctattcataaatcctttctcctcagattttgaagacattttggctacaatatattttttgatgcacaagaatcccaaggtccaattgtggtctacttatcaagttaggaggcaagtatggatgacccttactttttatatgtaacttaagccttactctaccctacccatgcgatacataatttaagaatagaatacatctgaagcaaaacagaaaaggcatgactttaaaagaacaacttttttttt

SEQ ID NO: 88195 - DNA, 3998 bp, Homo sapiens
caatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcaggtaaacggggctgaggggaccgcgggaggcggggcggggcgcgcgggaggcccgggcgacctcacaaaggtccgcggcgaagcacgtggtgcgggcccggacggggcgggggtgcacgccgcgtctcgcgaccctccggccaccccgcgagcttccgccgtctgcgacccgggagtggccggggtgtgggcggcgcggggcggaggaccccgcctcgcgactggggaaatggcgtctggcggcgagataatggcggcctgggcgggagcgcgcgggcggggccggccccgctgcctggaattaaccccgctgtgcttgctcgtcccgcccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcagaatatgtctcggtctttttttcccccatttatttgaaggacctattcaattttgtgattgtggctgactgcatagtatggaagtggaatgtttagtgcctatcatttcctaagttaaagtggaaatgccagttgaacacctaaaagcaatgctttaagtggcacttttcttgaggttgtgatacccccttctcaacctaatttatatcctatttaatgactaaggaacaatccaagtacttgtaatacgtattttaatttttgtttcatatgagtttaagtgttgtctaggtgacatcaaaatctaaggcaaacagacttgaccatcttcagacccactgcattctcaagctgaagtggtctgctcatagtttgtgtgccaggttgctcatcagtattgatactgtcccagaacaggttgtaggtataattcagagactgtcctttgcaaaggaaatgaccagcatttcaactgtatgtcttcctggaagggtagattctgctatatcttctttgtctgcatcaaaagactcaagaggaatgtggacacatttcatatcccatttgtagagtaaagcttcaagtgaccagtcagcacttaaaaaaaaaaagttgttcttttaaagtcatgccttttctgttttgcttcagatgtattctattcttaaattatgtatcgcatgggtagggtagagtaag

SEQ ID NO: 88196 - DNA, 1043 bp, Homo sapiens
aagcgcttccttagtacttggatggttacagctgcttttcctcccccctccctgtcattggtttgccttctgcagttctgttgtcctttttcttttctcataatggacttcagtattaagtacattatgaacttttactttattctcttgctgagtacttggagtcacacttcccaagggtgggagggagactgcaaaacattttcgttgattagttttatcttccacacagcaaactgtcatcaggagcttaaataggacagattttcacggcagtggatataccaggtattgtaccgtatgattgattttgctttatatttgacagtagttgcttaaatctcatcagaatcaccagcaatagaatattgtgattgaataagtggtgatggcattttctcttctcagtgcctagactgagagaacataatagaataaagctgatgagtttaggtttcctgtggaattaggcactaggtttgaaatcctgactctacaaggtatttattgcattgttatcttaggtaagtgtttccgtgagcctaatttcctagttcagacaatgcatgtaaagcacttggcacagtgcatggcattgaataagcactctagtattgtcatgattagaattcccagtcctatagaagatgttgtgattcttgaaacatttggtccttctgtttttgtaattcatgacgattaatatacgtatgtcaggagcttttagatttttgttaaggtgattagtcccaattttacagatgggtaaaatgaaaagaccttcacaagtcactagaaccttgtgattggacctgagaatgtaatatgtacaggtatatatacacaaacaggtttttcttttttaaaattagatttgttaattgacaaatgaaaattgcctgttatttattgtgtacaacatgttttgaaatatgtgccatggaatggctacattgagctgtagaaacagtttcttaatttctctagagttagagattggatcgtggcactcccccgccccccacaaacccataactcatact

SEQ ID NO: 88197 - DNA, 1050 bp, Homo sapiens
gcacaatgcaagtttcagtcctcagagctacagagtcagaatcttgggaagtggtgcccagcttctgtatggccaaaaagctgccctgtgattctgatcttgagtccactcttaaagctgctccatgataattctttagggaagtcagtgctttgctgattgttgactctctcaagagcctaacggttaatcatgccttttgaagtactttgttgttttgtttgattctattttttttcttccttttcatgtttttgttataagagctggaaaatgtgctgaggaaatgcatctgtagaatgtatttaagcacttgaaataaacgttttatttatagggcaaatgtagttcatgccttaagcattttaatctgaaagttatatcccaaagtgttcgtttactggcattattgacaaggggtgttttggttgaaggaagttttagaatgtttgttttattaactaaaatctaattaagtactcttaaatttttgtgtttacagaaaagtcttttaagttatgtgtcaccaaggagatgctccttcttagtattacaactgcttatacaggtaatggaattactgttcttattttctcttgctgcataatgacaataaggagttgaaaacgagccacgttattatttctcacaattctgtgcagtgactggactcagtgaatggttcttctcatggtgtcacttggggtctcttgtggctggtttccttcacgtgtcgccttcactgtggtcagatgataggctgaatatctctctttttgtgtagtctcagagctgctctccatctccacgaccccctccataagatcaccttgtgatctggcaggatagccagacaccttagttaatggactgatggctccaaaaaaggcaacaggaaagaataccagaccttcttaaagctcaggcttcagtctagcccagcatcacttctactggattctgttggtgacagcaaatcacagggttggcccaaattcagtgtggaaggattccacacaaggttcagaaaaaccaggacacgtggctctt

SEQ ID NO: 88198 - DNA, 1069 bp, Homo sapiens
caggagctcagtcagcactgcaagactgcacttttctgaggcaggaggtttggggccctcatccagacaaacacgtagctgcgctgaggactgccgccagcatccatgggatttgtgaaagttagagaaaggctccctctctgggtagccacagccctgcgggagcacatttgtgtcgatgacaaaaggtgccccttcttcctggcaggtaacccaggctgggtgcacgggagcccacgctgacctcagtcccacctgccccttgctggattgccttgtgcagtgaaaaacctacgttaccgtacagggccatcctgctcacttcctttctgagagtctgtgctaagctctctgcacttgtacagttcattctgggctctaaggaactggggtggccggttgggcaggtgggtttcttggggcccagaatctgaagggctcttctctcagtaacttaggggtaccgccaggccggggaagctgcccgctcaccatgcccctgcccttcgacctcatctacaccgactaccacggcctgcagcagatgaagcggcacatgggactctccttcaagaagtaccggtgagagggcggccagagggtgggcacgtggcccacatgccaggggagaaagctcctccttcacgccctgcccccacgtccccactcagccagctgggcccaggtgggagaacatactgtcctgcatcctgccctccgccctcccctcccctcccctgccacttccgtgtctgcctcccggctaactcaatgatatttaataaaccacccagggagttgctccatcacccctctgctgctttgaggctgggggcaggaggccggggtcatctacatggagcggagctgaggaattgaagagaagagtataacggaacaggacattaacctgggctgtgaccctgctgtggggaccttggggtggggagagcagctcagcacacccctctcttcctccaccccaccctctctccgtctggaggaaggccaaggccatcgctccctgtctcactgcagccagtgggatgtggggcttaatttagcacag

SEQ ID NO: 88199 - DNA, 1465 bp, Homo sapiens
ctagtccccattaatcacaccgcgcgggctgcgacccctttaagtccggcttggatgacccagatccaaagtcatcgactctctagctgctatctctatggtaagttatcacttccggccggaagttgctgacggagctacttccgcccaggggagtgggaagtaagtggagacacgtgctttggcctgttggaggggaaacccgctctcgcctcctggtggtcgccgactcgcagtccgcaggatgactcagggcagccctgaccacagttccgccgccatcggccctagcctgcggaattgggctcgccccgggacgataacagagctctgccgggggctggaggcactgaccgggtgaccagagacccagagaccagaccccctccacggcgcccgggatttcggggacggcttctcccatcgcaagtagggcttggacgggaggcgacaaaagagaacttggtccgcacacagccaccgaaattggaatgaggagctgtagggaggccccgtagccagcagaaaagcattggggtccctggctgggttagcccaggtttctaggagtgtggtaagcgtcgaatgacttttgtccttttaaagcacattatgttactttttcccccaaggtttcaacagaaaatgagaaatatcccccgacgattggctgaaaacatgcagcaaccactattttcttcctgcccctcgttgatgagagcattcgaagtgacctcagcagggcatccaggtatgtcaagcatggtgacaaagtgttcaggtcagacggtctggggaaaggctcctgtgttgttgagcctgccaagttgtgggtgcagcatggtaccaggcagcccaaccctgacctaaagtaaattcccggaagaagtctttcctgggttttgaatttgcagtaacaggtgtgagcattctagcagcagtttgatgatcatgtatgatactgcaaacaggacctacgtttaaagaaaatggttgtagttagtatcagagagcccttgcttttcaaaacttcataaacaatgttactgtcatgtctttcattcaataaacatttgttgatacattggcctgacatcatgttaaatgttacggatacagagatgaagaaaacagtcatggcccttgttctctgggaactacaacccagttagggagacaaggttaaatgatcacacttaagagggcataattcagccaggtgcagtggctcatgcctgtaatcccagcactttgggaggccgaggcgggtggatcacctgatgtcaggagttcgagaccagtctggccaacatgatgaaaccccatttctactaaaaatacaaaaaattagctgggcatggtggcatgtgcctgtaatcccagctactcaggaggctgaggcaggagaatcgcttgaacccaggaggtggagaggttgcagggagccgagatcacacacaccact

SEQ ID NO: 88200 - DNA, 1851 bp, Homo sapiens
tgacttcaggtgatccgcctgccttagcctcccaaagtgctgggattacaggcctgagccactacacctggcctgtttatggaatgtaatattgattttctcggctgtagtttagcctgctccttcatgaagcagcgtcttccttctgtctttgcctgttttttgttagcacacagattgagaagtgacatcatcagtgcaattaagtacctacaggggtaagcacattgagtcatacgccgtggagggaatataaagaaaagtatggtccctggtgttaggggcttagaatctagcgatgtcagtaggcactatggaacaacaggaaaggacattttctgttgaacccttcaggggatgggaccctctcggggaagtaaaggctgtttccatctgctgaaatgtgacaaaaggcgggaagcatggaagaatgtggggagctccctagtgagagctgtactgagtaatatgtggctggagggaagggaagaaaagtaaagttggaatatgtaggttgataaccaggttgtagggcccttgaatgtcaaagttcaagtggcttttttaacaagcaggtttctaagggcaacgtggtggtctacagatgacagcctggagaaagatgggttagagccgggcgtggtggctcacacctgtaatcccagcactttgggaggctgaggcgggcggatcacctgaggtcgggagttcaagaccagcctgaccaacatggagaaaccccgtctttactaaaaatacaaaattagctgggcgtggtggcacatgcctgtaatctcagctactcaagaggctgaggcaggagaattgcttgaacccgggaggcggaggttgcggtgagccgagatcacgccattgcacactccagcctgggctaaaaagagtgaaactccgtctcaaaaaaaaaaaaaaaaaaaaaagaaagggaaagatgaggttaggaagtccttgtgatgtctttgagtaggaggtgaccagcccttggctcagtggtacctgtagacttggaagaatgaggggtggctgggggcccattccccgcagggcagaatcccagggtacctcccatgtcatgttctaggtggaaggtggattttagattttagagagtatctcatggagctcacagttttaaatattcagacttggtaaagtagaataagaactgatgcatatacttttctttgcaggtcagtttctggaagacttgtgtgtgtgatgaatgaatatctggttttgtctctgctgggcctgtgtgcctggaaaggaattgttttggcctaggatcatccaggtttgtttggtttagttcttgaccacatattttttgaatggtgactgcttaagaccctgttgtgtatggctataaatagatacacgccaaggtgaccacatactctgtggttcctgtgcccgccggccatgtgtctgagtgtgtagcctctcatcatctaaaggaactttggctgcagaggggaggcctggtcccatgggaagttttgggagcgcagcagcaggtgggttcaaacgacccagcaagtgcctccttagcacttagaggcggaggccaccacgttgtccacgtggggtttctgatcccagctccccaccagcctgctggacctcgggcaggtccctccctgtttgtacctccattacttcttcagtaagatggggacactgaagatgaccatgcctcccaccagattggtgctttttttgttttaataagggacagagtctcactatgttgcctataggctggtctcaagctcttggcctcagttttcctgcctcagccttcaaatatgctggggtgacaggcatgagcca

SEQ ID NO: 88201 - DNA, 1044 bp, Homo sapiens
ttggggtcttgacgggtgctatttgccacggaaagatgccttcctgctcccagggcaggagagccgaggtaagacttactgtaggctgtcgttttttttgtttgttttttgtctttgcgatggagtctcactctgtcgccaggctggagtgcagtggcatgatcttggctcactgcagaacctccacctcccaggttcaagcgattctcctgcctcagcctcccaagtaactgggattacaggcacatgcccccacaaccagctaattttttatttttagtagagacagggtttcacatgttggccaggctggtcttgaactcctgacctcaggtgatccgcccgcctcggcctcccaaagtgctgggattacagacatgagccactgcgcccagccaggctgttgtttttttacctccttgtttgcacaatttgggccactcacaagagtgtataccctgtgataaacagttacctacattctcctctgcatgcttgtctttagaggaaggaaatgtattaattgcccaaagtaatatattgtgttaagatgtgatatatactggggaaaaaaaaagtgtatattgacatttctggaataaaccactttgattcccagttactgactcgttctcctgtgtggtgtctttcctgtatgcagaaggccggcttccccacaggggctgggggtgacttgtctgtccttggaatatgagtctttgcaagcagctgctgcccatgtgcacagttcctcgaggagttggttcaatcttggtttgggagtttgattggaaggattagatcctaggctcccctgagcagtaacatcttatttatagcgtggaaaatggacagagctgttgatacttaggagagctttcctcattatcaccccgaggagagtgcctgagtctccaagaggtcattgttggtctgcaagctcttaaggcagaagagtctgccagtaacagggaaatcaggacaggatgggaatgagtgtcccaaggcagtgacagaagctgaggctgaaccttcccaggaatc

SEQ ID NO: 88202 - DNA, 1068 bp, Homo sapiens
tcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcagggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttcgtaggtagggttcgtaggtagggctggtaggtagggttagtaggtagggctagtaggtagggttagtaggtagggttcgtaggtagggttcgt

SEQ ID NO: 88203 - DNA, 1028 bp, Homo sapiens
tgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcaggtacgcagacagccccctccccatcggccgccccccactgccctggactcggggctttatttatgcctgggggaataagcatgcaaagggcgcttttgctcatttttcacagaaatatttcttttctttttgacggttccaagctcgtgggatgaactccgtctcagaagctaagctctcctgagtctggcttttatttaaactcggctctcctctctcctggctacttccctttcattttccagtgtgccattcttgcatgtcatggccactgtcaatgctgaggctgttggcgccgaaaccttgggagggtgtgggggacctgcccccctggc

SEQ ID NO: 88204 - DNA, 1059 bp, Homo sapiens
gtgtcttcttccagtaacgcagacttctgcacgtgttctctaggagaaatcccgtcactcgctagagctctagatctggaagaagctctgcctctcttctctcctccagtgcagtgtgtgtgtgtgtgtgtgtgtgtgtgtccccacatgcattacacccttctacagaggaaataattcccgtccaagtgcaaaggttgggattggagcaggcagcatgtgggctaaaggagcagagaggaggaaacgggggcgggggtgagggtgggaacaggaggtgggtagatgccacgaggcatgccttccacaactagaagggctggtggagatgaccagaatgctccagacagaccttttatcaaacttccaaaattcaatcttgtttcatgaagcctgaggaccctgcagagtgaaagacaaggaagggctttcctgcaggggggtgtgtgtgcctgtgtgtgcctgtgtgctgtgtgcccccatgtgtgtgcacgtgtggacctgtgtggtgtgtgcctgcacatgtgtgcacgtgtggacctgtgtggtgtgtgctgagtgtgtatatgtgtgtgcctgtgtgctgtgtatgcacttgcacatgtgtacacagatctcattttccttttttctggcttactaagtgccagaaagaatttccgtgagcctctccacccttcccaaggctgcacatggagggacttgcgcaggcacatgtgcgcgtgcacacaacacacacacacacacacacacacacacacacacacacacacgagtcaggggcgagcactcctgtggattgtacctaggcctggcaggaaaccgggttctgggaaactgtaggccccacctttggcagaaaaccatgtttttgttgctgctcgttgaagggaacattaagtggggctggggacagtttatgttgagaagagcaaattttgcctatggcactggggacattgagtggctcctgtcccgggctctggagggcttgggagacacgtctgcagctctgggcatctctcaaggtcacgggcggccacactcaaggttaggccc

SEQ ID NO: 88205 - DNA, 1022 bp, Homo sapiens
tctgatgtgagtcaggccttgagctggttggggtctgggtcccactttggttgtgttttgctgtgggcaccaaggaagcttctagcagcctcatctccctggtatgacctagctccagggactggatttccccaaatgctcctgcccagcctggagcctcctttccagctgggggagggctgaacgacccctcactcttggaggctgccggagcccctcctgcctgcatgcggccgctgccgggtggacaggcctgcttgtgggttgaggctcccagcagctggggtggatcatttctcctcccaagaagctttgggagaagcagctgagggggccagcgtcctcctgaggccaattccctgcctcccccagcgcaggcgcgaagccatctttgcttgtgtgtttgccacagacagtggagggcggtgcaatcgtgacgcctgcttgttgcactttgcgtccttgaggacgttgacccctggccggtgctgggcgcttgctcttcagtcatcttgccctgacctggcgtggcaggcccgagcactgctcttttacaaggaaacaggctcagaggccttgagtcacttgcccgggctcccccagccaataattggctgagccaggatttccatccagctctgtgactccagaagtccaagttcttcccatcacgtcagggccaggaaaggattagaatgcttttctacgtgccgattatttggatgatctgtgcagcttagctcgttgtagttgctcaataaaaatgtggaatgaatgggcctatatgtcccattgtgtgactcagagccaatgactctggctgatcctcctgttttcattccgtggcccagcatctccctttggggtgtgtgaccttggaagcagtgactctctccatcccaccttgaatggtgtctgcgccgcagcaggggagcagctggggattgccagcgcctgttgctggtgggctgtgcgccagatcccgtcttggatgtgtgggtgattgtcagccacatgtgtgt

SEQ ID NO: 88206 - DNA, 1161 bp, Homo sapiens
ggacggggtgacagggagagcatgcaggagtgggtttctggctttccagggcgagtggaagaagcgcctctctctcttgtaggtgacagacctggggggcccttcttgaggatgagagcctgttgcttctcaagttctgtgtctaacccaggtccccaggtctaccccagcccctcggccctgcctgccttgtggatgatatagtttaagggtagagaccgctggcctggagggaaggctaggcctcaggttagggcccagaagggagggagaagcccttggggcagctccctttctgctcactcactgcctagctccttccttcacaccttccttcggaaacgtctgctcctgacaaggtctacttcctgctctcaggaggcccttattgtggaggaagggaggcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcct

SEQ ID NO: 88207 - DNA, 1029 bp, Homo sapiens
ggcacctccttgtgggaccccttgggtatgagggagggagccacctgggccacagatagacccccttcctgtatccaggaggttcaggatggacctgtctcatctttctttctggtgggaagagagcattcctggccatggggaatgtggcctggacagagccacctagcctctcccctcccccaggcagggccctgaaagatggagatggctctgctcctgccaggtcaacagccagcagtctggtggatttccatgcagtccaggcaggatctccttctgtccccaccccccaccccatgtgcaggaagctggttccaagcagggacccttggccccgctttccacgtgggtgggcagtttccctgcgaggggcaggccaggcccctgccctatgtcccccagagaccgatgttatctacagtaagagcatacaagtctttttggctccaaaccaggcctggaggggtggtcttctcctctgtcctctgcctcttgccccccattaaaggtcagggaatggagtgctctgtatgtttgctggggttgggttttttcctttggtttaaaatgaagggctggaatccctggtgcagactgcacggtgagaggtgctccttgggatccactcgaggagcattactgctgaatgccctgccaggccaggagcatcgctgggggtgggagaggcagttggcttatttgtttatccaacagccatccatgggtaccccaagggccagctctgttctaggcactgggggtctaggcatgggctcaggagaaggggtagaacgggagggcttcctggaggaaggcttcctaaccagagaccggggtaggagtttgccaggcaggtgatgctggccagcttctcttgccattttccttttctttttttctttttctttctttctttttttttgagacagagtttcgctcttgttgcccaggctgcagtgcagtggcgtgatctcggctcactgcatcctccgcctcctgggttcaagcgattctcctgcctcagcc

SEQ ID NO: 88208 - DNA, 1078 bp, Homo sapiens
tcaccctggagttcagcagaacctaaaccaggcagatccgtgtaggttcacgtgggggctctgtggccactgtggctctgccgtcacctccagcccagcttggcgcgctttggatcatgtcattcagtgccggtcctccaaacctctcccctggctctgcaggtctgggaagcagctggctcctgggtgcagctgtgaccggagcctgaactctgctccctggggtcaccgtcccctgtaattaggctgcagctcatattggctcgggcagaggccatcggctgcccgccttggggccacaacacagagagccccgtgattaatggaggctccacctgggccaagtggcccctggtgttaggcgcttttttttttttttttttttttttgcattttttaagtgcttgtaacatttcccctaatggacaatgagacgaggagggagggaggggtggcttctctgcccaggcagatcaggaatggtcaccgcctgtgtgtgcagtgacaggtctgggaacagacaagggagagcttgtccgggaggctggaccctcacaccgatgctgcctgtgcctggcagctctgtcccgggcctcagaacagacactgaccaacacgctcctcagggtctccaggtccgggtcctggtccccggcagagcttcccatccatgggaagaagcaccgagcagccttgctggctcctcgcagggagctgggatgcatttctaagagcagcatgcgtgaagcccggggtctgggcaaaggagtgtttggggaagagtctgctgttgttggagggtcggaagtagaggggaaggaggggcacgcggtaggctgaggaggtggctggcgaccctgtggtggggacgagggggctatgagcagaccaggagccagcatcacgtttctctgtctccagaatcgaggacggagagctgccagagaggccctggcggggtgtctggggccacctaaagggcgtgggtggattaaagctgaggaaagcctcattttgggggactccgtacttaacctttgaggccctcagagctgcagcctgtggtttttcgaagtca

SEQ ID NO: 88209 - DNA, 1139 bp, Homo sapiens
agagagaaagaagcctcctcctaacacttgagcaaagatagtcatcagaatccatcagagtggcctcctgtggctcttccctgggtgctgacccccctggtgcatttgaagttttcagggatactattgacgctccctgcacctccatccaggggttagtggaaatggttcttttcctccttgtccagaggtactgtggatgatgaccccaggtcccagacctcagtcattgggccacgtgtgcagataagcctgggcagtcagtaacctttggccaccaagctggcctcctgcggactgggccggcactggaggcgggtcttagctgctagcactgtggcccagccaggcctggccttgggaaggcagagggggaggggactgggaaagggattgagctgggggtggggtggtaccctggttcttccctcccagacctttggcaggtttgaactatctggctgcggctctctaaggagggagcgcctcctccgccttgatgtggactttgccttctgttcacgttgtccctgtccctaaacaaatgtggctctctgtggggagcctgggggccgccctccactgacactgctgtttcctggcttccctttgcaggctccgctcagcttcactgcgcctatttttaagcctttccttttggacggttttgcttcctgagaacacacccctccccatcaccccaactgtgtcctcctccctatccggagcctgctccacctgccccaggagccacctccctcctccaccaagcagcccaggccaattctggagggctaatttgtgtccctccagaagcaggtcctgagacagggatttcagtgggaggggacaccaggggatgcctgagtgtgggaatgggccaggcagggaatccagccaataaagggtgcctcaccagctcattgtgaccacaggtggctgcccagcccccataccgggcagcatggggagactgcagaccgtgcccccagccttgtcccacctggggttgggtaagggagctggggtttttatacttcagttcttggccaaggactgcactgctcactccttccagccttccgagggcttgggcactaggaaaggctctgggtggagacacggaaataggccatgtg

SEQ ID NO: 88210 - DNA, 1058 bp, Homo sapiens
ggtcagcagattgagaccatcctggctaacacggtgaaatcgtgtctctactaaaaatacaaaaaaattagccagacgtggtggccgggcacctgtagtcccagctactcgggaggctgaggcaggagaatggcgtgaacctgggaggtggagcttgcggtgagccgagattgcgccactgcactccagtctgggcgacagagcgagactgtctcaaaaaaaaaaaaaaaaaagaacaatatcgatggttttattccctgaacatgctaagtgatccccatgtagtataagcatctcagaaggcaggaaaatgtaatgaacaacacccaccgccattcattccatccagagatcgttattttctgcccgggtgtgagtgtgtgtgtgcgtgcaaactgcacatgtgtgtatgaaatggaattaggatctttgtatacatcttgtgtcctgctatttttacttaatattctcggcatttctcatcttcaaaaatgtgattttaatgatggtgcaggcctttgacatatgggtttagaaaatctgcggaaacccggactgtttccaggttttgtcagtttaatgctgatgcaaatgtcctcgtacgtaaatctttctgtacttctgattatttccttgggataaattcccagaagtgggccaaagcacatgaacggtcttcaggcttttggagcaagttgagatcggtggggattggagaagggacccagggaggcttttgggagcttgcgagattggagtctggctttaggggacttgaattcacagatgaaggagatggctggcaaaggtgggaacctcctgctctatgggtgggggggtgacactgctttaccttccagtgacagcatggggatcctcccaacatgacctggctccgcatctttctgacactgtgcacggtccacagttgtgatgctcagctgggagcctcttctgtgtccttcagttgcattaactccttgcagacagaggaggaagctgtccggtgctcctccctgctgcgtgggtcctttgaatctgcccagttgggcctgtgg

SEQ ID NO: 88211 - DNA, 1134 bp, Homo sapiens
ctctcagacctaggtctagagtgggaagtcccgcatgtgctgggggaacaggaatcaatgcgggaggattggccaggcccggtgtgtctccttcgtggtgggacggggtggggccagagaacagagcctggctccagagcccaggaagagaacccctcccctcgccggcctgccaagcaccgtgcagtggtgagaggaaaggagggctggtccgggaatgcagcgggtgccgagcagctgtggaataccttaaatagagcgcagctgcggggaagggtggggccaggaggcaggcgctgggggcggtttctctgctccgccccctgcagctctgtggccctgaccacccagcctggccccaggatggagccccggcccccagacacatggcactgggtgaggccgcctctcagcacttgtcccaggaagtcagagcagctgccagaagagagaggagctgtgtctgtacccgccgcctcccaggcccgggacagctgccgggattgagggtctgcacaatggcgagcctgtccggaggggcgcgccgcggccagacagccatgctctgtgcggtgtggacagagggcacattcagccctggaggagcgcactcagactccccgcctcggggcccaaagtgtgggcagcccctaaccagaccctggattccagcagacagcctgggaggatgccatgtggtccaccctgacacactgtctcacctgtgacctcatttctgagagctgcagggaggcgcttcctcagttggactccacttcctctccggggttttctgtgggtgttataagtgactctgtctccttcagtccaaggggggctcctggggtatgggctgtaactgacaggctagagtagcccatggccagggctgagcttccttcccgttctctctgaacactgggcccaggaaggggttaaagtggagatgctctgattaaagttgagggaggcatggagctcccctgaccctgtccccccatcccactgctgctactgggtgtactctgtggagccccaggactcttaaagaacccagagtggagattcccggtctcatccagtgcaggtgagggggaaagtgatttgtccacagttacatggctaccatcagca

SEQ ID NO: 88212 - DNA, 1053 bp, Homo sapiens
tagcagcctgccctgtctcttctctgccgatgttcctgaaactttcctgcctctccttacctcttggccagagagagactggagaccctgtgggaacccccgaggggagggagaaggccgctgtttgaacggaggtggtctttccctctgcccctccccaggcgggtcacacttgcaggcccagcctcctgctgtggcagcgcttggggtgtcggctgcctcctgggcacgagttgggagctgagggaggcgctttcaggaccggagtggcaacccagctggaggaggagtaacaggcccgtggtcagcagcagccgccgcagggaccccggcgctgtacctgtgccccagctgacccctcccgcttccctagggtgggccggggatggtggtctgttgcccagcccaggaagaagaggggccgtaatcagcagcagccacctcaggggaccccagcgctgtacctgcgacccagctgacccctcccccttccccagggctggctgggaatggtggtctgttgcccagcctaggaggaagaggggctgtggcttccactctagaggtctctctcccggtccctcccccggtgctggtctaactgcaggcctgccttaggccgtgccggcacctgctgactgacgcttagcggatgctgataggagagggctgggatggggaagcagcaagtcccggtcactgtgggctcgggttacagatggttgaggcacctcctggccatccccaggaagcaaggccccacgcagcctccgactcacccactgcccgtgtgtatttcaggaggctgcatcccccaaggcccccaccaggtaacttcattgggctgggtgtcgctgcaaaaccacccattgggtgcggtggtcttctggtggggggcatggctggggaggatgcggtggaggagaagccagctccgtggttggggggagggcggactatccgtttcctgtctgtcccctgaactggagctcatggtccctcccccaggtgcctgggccatggaagaggtcacagccctgccttattcctgtg

SEQ ID NO: 88213 - DNA, 1041 bp, Homo sapiens
tgtcctctggccaccctggccttggtgcctggcccctgtgaaacagagatacctgggcagtcccccacttgtgcttgcaagcctgtgtggcttcagtgatggctgattctgctccacccagaggacctgggaatcctcagcccaactgtccagaggagtctttctcagtggggagagcctgagctgtcctcctggtggacagtcctttagatctcaggcggacttccctgccggccgttcctcctgctgcccctgctcctctgtcccccatctgtctcccaccctctcccctgcagcagccagctggcacggggacctccccttccctctgggattgtgaatgagacgactttcctggtccttctgggtctagatctttctggcaacagtcagtgaaacccttgtctcaggtgggaggagaaggctcagtatgtggtcacaacaacggtcctaaccacatcactctcaaacgctggctttcacttaccccttgccctgcccaacagttactttcatcatcccattttccagattaggaaatcaaggcgcagagagcttcagccacttgcctgaggcccccacagttaagtgtctggatttgaaccctggagcagcctggctgctgagctgtcctggagacggggtactgtgcagtggtcggggtaggggtggagctctgccgtcgctgactcccgggctacctggagtgataacacagcccagtgtctgggcccctgcctgagactttggctggatgccaggagcccgagaccttccagctctttcctgtgtaaggcgccatggggtgaaatgaaagaaaaccccagttagaaggtgtccccctcttccttcagtccctcagctgccctggattttgaaataagacaccgcccgtctgtggggtgagcaggaacagattggaaccgcatttctctccccccagtcacagctgccaggagctcatctttctctgtctcctccccctgccgcctctccccacaagactgggctggatgctgctgggaaagtcaacaggaagtc

SEQ ID NO: 88214 - DNA, 1052 bp, Homo sapiens
tggcagagaatcagagagggcatccaaaaaggccaacagttcggtggggagaggaggcgcaaggctggttcctgttttctgggctttgatcgaaagggaacaggggacacatctggggacagtctccttcctggaggaagaagggcttagggtgctggtgtggagtttgcacagatggggataatgagctggagggtgctgggcaggagctggccagtaataggctgacgagggaggccctgctggctgggcctggttttcaagtgagcatcctgagctgcggggacccagggggtcttagagacctcagagctgagactcgggaccacagaggggtgggctgtgctcagggcaacacagcggatggggcagatgttgcgaaacctgtctctctgcctctctttctcctgctacagaactggatcctcccagctcatggctgtcaaatcctttagatgcttctgggttccatgggcgccttacactggcttccctgtaggacagcagaccctgggggttggctctgatggtattcaccatggggtaccccatgcaagcacagtgctttcacgcccagcctcccagcctgtggagtaggcctgtgtctggccagcctcactttgtggccagaggagggagacagtggttctggagacaggagctggcctggggctgccctcccagcccctgttctcccagctcatctccttgccttgcgggtgctggccaccctccccccgccagctccatccccagctttctctgcccgagccgtgacctgtcagtagggggcagtggaggccttgaaagtccttggagaggactttgaagcagtttttacaaatctgtccctggaaagtctctcctgtcacacccccagcggctccctccctcctaacatttttcctggggttgtcatgcagcggggggtggaggaacccactaggccgtggatagagcagagccatgttgacacaaaccctggctgaacccacatgctccctacagccagcggccgatcactggaaccagggaagtgacctcatagcaag

SEQ ID NO: 88215 - DNA, 1029 bp, Homo sapiens
tctcattcacttgttcatttattcatggccgaggccccgtctgtgtcaggcctggtgctgagaacgggggtagagagatgggggctgtgccctgctccctgacccaagggttccctttgcaatgtgaagttcttggagactggaccctcaggctgttccaccagcccctcctcaggccagcttaacccttccgtgctcgttttctgagctgttagaggaagagagcgggaggaaggatggagtggggtttttgtggggactgagcggggggtgtgtgaggccctggaaatggtgcctgcggcactcacgcagcattagcttttgctgcagttgctgtttggagaatattcttggatttcaggacactgatgacagaaggtggaacgctttttctggaagccatcaagaggggaccaccgcggcggctgagcagagttgctgacttgtgagctgtggcctgaccacagtcactgttctcatgagcgaggccccctgtggtccccctcccaggaatttctggccccttggcaggggacagttcagggctgggggtgggtagtggtgtctgcaggccctcttggagtcagagaatcccctgtcgccgtggcggggctgttccctcctgcccctcccctcccgctgtgctctcagctgctccgacaggatgcttttggcctgagagacagaaaccccaactctgaatggcttcagccctcaagagaatttggagcttttttgtgcaaaatgagatgttctgagcatcgaggatgctgtgggggatcctccatcccaccatctccagccgtggtgtccctctcggtcacaggatgctgcagccacgttgcagggaaggagagcctcccttcctgtgagcctagggagcccctccatgcagccccttcactggccattgcctgagacccgacctggtggctcctgccccaaggagcagaaagggggttcgctaggtcagggtggggctgggtgcgaggaccccccccggccaacagggtctgcttaggtgtccgt

SEQ ID NO: 88216 - DNA, 1037 bp, Homo sapiens
gggtggcctgcccggcgtccgcacagggtctgctggtgggtggctgaggctgcggtgaggtctccatggctccctcgtcctgcacatccttcccttgttgtgttgtctcgctagcatatgagcccgtactgcctctgagtctgcagcctgttttccttaccaggtggctaagcagggtggcagccagggtggcagagtcccattggcctgcaggggaccctctgtgggctgcaggtagtcccctgtggttgaaggtgccctggcaggacctgcaccatgacccccgtcaaagctcacgtccaaggcatttgtgggcacccccgccccagacgtgagggttggcatcttctcttgcacgtgaagcaaaggcctgtttgaaggagcgtgtggaagcctgggtgtgatgaaggcaaggaccggtggctcacccctcttgcacctggaccttgggtggcaggcctggggccttcagtccttaattcaggagggtagccagtcgctggaactaagagtgaacttcagctgttgttgccatagctggagggaagaggggaaaggaggcgctgcaggggagcagagacctcacccttcctctgccgacatcaggctgccggtgctggacggggccctggcaaccgtggcaggagtggtgatgtccgatgatggtaacaagggcttcctgaggaccccgagctgtcttaagggctctttacctggagtaagtatcccctttaatcctcccaacaacactgtgaaattgattctgttgttattcccatttcaccgatgaggaacccacagcccagagatgttaagtaacctgcccaagcctccctctgagcatggcagagggagggtccgaatgcggaaagtctggcttcagtgcccccatccctaaccactgtcatttacctcttcggccagccctctgattgcaaaacctgaggcccagaggagtgcagtgacttggccagcttcgcacggcaggttagtggcagagctgagcagtgtctcccatgccctgattctgtggcttc

SEQ ID NO: 88217 - DNA, 1062 bp, Homo sapiens
gctgtgggataggctggccaatggtgctccctcccctgtgacccttctgttgggtgggtcacgaggaaggactgtgggtgttgcccacagacaggtggacatgtggcaaggacaccttgggaccttctttctgacgccccttgaagggggcactttctcagctttgagatgagtctctgtggatgtgggaagttcactatctcaagagcagcagccttggaaaatccaacacagaaccccgagtaggggcgggaaggggtcctgtcccgctcactggctgcctggcagagttctgcacaaggaagcgcctgtgttgctgtgggcggaggaatggactgagggctacattcgcttcctgttgccgctgtaactgcttatcacaaactcagtggcttaaagcaacagaggctccttcctttacagtgctaagggtcagaagccgatcagtctcaccggactaaagtcaaggtgttggcagaatccattcctgcctcttccagctttgggtgggaggctctgctggagttccttggcttgcggctgcatccctccagcctctgcctccatcctcctacagcctcctccttctctgcagtcagatctccctctgccttcctcttttttttttttgagacggagtcacccaggctggagtgcagtggcacaatcttggctcactgcagcctccgcctcctgggttcaagcgattctcctgcctcagcttcccgagtagctgggattacaggcatgtgctactacacctggctaatttttgtatttttagtagagacagggttttgccatgttggccaggctggtcttgaactcctgacctcaggtgatctgcctgcctcagcctcccaaagtgctgggattgcagccatgagccatcacacctggcctgcctccctcttaaaggacgcttgtgatttggggcccacctgggtaatctcttcatctcaacatcttcagttacatctacagagtccctgttgccacatgaggtaacacagtttgggaagggagagttattcagcctaccctaggggcctgtggtgtatc

SEQ ID NO: 88218 - DNA, 1016 bp, Homo sapiens
ccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgtccctgggc

SEQ ID NO: 88219 - DNA, 1031 bp, Homo sapiens
tcactcatccacccatccactcattcacccatctatccatccactcatccacccatccactcattcactcatctgtccatccactcatctacccatccactcattcacccatttatccatccactcaaccatccactcatccacccatccactcatcatccgtccactcacccatctatccacccatgtatccatccactcatccacccatccactcatctgtccatccacttatccacccatctactcacccacccatccactcacccatccatctacccatcctctcatctatccatccactcatctacccatccacttatccatccatccactcatccgtccatccactcatccacgcatccactcacccatccatctacccatccactcatccacccatccacttgtctactcatccactcacccacccatccactcatccacccattcactcatctactcatccactcatccatctatccactcatccaccaattcactcatccacctatctactcatccacccatccatccagtcattcatccatttgctcattcatccgccaacccatccattcacctgcctgttcatccacctacccatccattcatccatctgtccatccatccacccacccactcacccattcacacacccatacacccatccatttatccaaccatccatccccatccttacttcagaaagcatttgaagttgctggggtgtgcacttggaaaatgcgtcataagctttcataggcctctctttggcttcctcacttctttgattggtctttctttcggacatgcaggattctgagcagctcttctgggaggtgggtgcagtccaggtaggctgcctgcaaagctaggaccgagggagccacatccaaggcactgtgggttcccaaggcgatggcactgtgggcccactgcttccagacctcctcaactcccaggctcctgagcaggaggactcctggggcagggcctggagacgggaagagaaaacaattccagtctct

SEQ ID NO: 88220 - DNA, 1057 bp, Homo sapiens
aagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctc

SEQ ID NO: 88221 - DNA, 1050 bp, Homo sapiens
aacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgta

SEQ ID NO: 88222 - DNA, 1041 bp, Homo sapiens
ggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctca

SEQ ID NO: 88223 - DNA, 1874 bp, Homo sapiens
cgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaaggctcctgagtgagaatgttttttctgcccctgaagtgcagttctttgggcctcgggacaggttggggtcagctgcaggtgggcaagaagcatgg

SEQ ID NO: 88224 - DNA, 1037 bp, Homo sapiens
cactgtgactgtcacagcaccgtgacggcattcaacagcaccttgactgcattcaacaacactgtgactgtcacagcaccatgacggcattcaacaacactgtgactgtcacagcaccgtgacggcattcaacagcaccttgactgcattcaacaacactgtgactgtcacagcaccatgacggcattcaacagcaccttgactgcattcaacaacactgtgactgtcacagcaccatgatggcattcaacaacactgtgactgtcacagcaccatgatggcattcaacaacactgtgactgtcacagcaccatgacggcattcaacagcaccttgactgcattcaacaacactgtgactgtcacagcaccgtgacggcattcaacagcaccttgactgcattcaacaacactgtgactgtcacagcaccgtgacggcgttcaacagcaccttgactgcattcaacaacactgtgactgtcacagcaccgtgacggcattcaacagcaccttgactgcattcaacaacactgtgactgtcacagcaccgtgacggcattcaacgacaccgtgactgcattcaacaacactgtgactgtcacagcaccatgacggcgttcaacagcaccttgactgcattcaacaacactgtgactgtcacagcaccgtgacggcattcaacagcaccttgactgcattcaacaacactgtgactgtcacagcaccgtgacggcattcaacagcaccttgactgcattcaacaacactgtgactgtcacagcaccgtgacggcattcaacagcaccttgactgcattcaacaacactgtgactgtcacagcaccgtgacggcgttcaacagcaccgtgactgtgttcaatgccaccaaattgttgacttttaaaatggttcattttattttatgtaaattttaccttcatataagaaaaaaagggatgagttggtccctcaaaccccttccaggtgtcaaattttgtggattatcatctcatgtgttcccatcactgcactcccccct

SEQ ID NO: 88225 - DNA, 1032 bp, Homo sapiens
gcagtggaagtgatactttgcgactgctgaggtgagggtggaaaagccttctggcttctgcctgtgtccgctgcctggaagacaattagacatcacctctcaataagaggagagtccaagacttggcagccatttttaacccaccacaccaagtagctattcatccagattggcttgaaaaagatggagtccttgggaatctattggaccttgaaatctatcagaccttgaaatctatcctccacatgtaattcccttccttcacatgtcagcccactgaaattatgtttatgttaggcaagttatgttatgcagatcaaacgcccccagtcttccaagcctttggggatgagtcacagtcacgtgtacagccaactgtgcaggtgtgtttatctttatctgtgttagcgcagaacctgggcctcagtcagtttgtgttctctccccttccaccatccactgggggccctcacatgcccttgatggtcagccctgacctcttcccatcactcctggctgccaccttggtgtcataatgggtggcctggacctcaatccttgcctgatttctttggagggatggggaaaccatccacccctcgctgttctgtggtcttgggggccccatcctaggctgcctgagctctggaggacagcagggaggagtgcaggaggctcacctggccccacactcatcacttttctttccaggacaggccgagagggtgcaggtacttgtccttgagccctgtgactccattatctcagggaaccagaatcctcccctcaggggccccatccctccctggcatcgtgttctccagtcttcacagatgtgcccgtgggtgcccctagccaggtccagacgtggcccacgttctcctcctggaagtctactcagcctccttgtaaacaggacctaagaaaacagatgcaggaagacttttgcacctcagctcagcccagctgggacccagggacctcaaaagccccttctctgcaaagctcccgtccatcccccaccatcaccaa

SEQ ID NO: 88226 - DNA, 1046 bp, Homo sapiens
agatgggtggctggatggaaggaaggatggaagaaaacatggaaggatgtccatttgtaaatgaataaaaggacagatggatggatgagtgggttaatggatagaaggaaggaaggaaagatggatggatggatggatggatggatggatggatggacagatgaatgaatgggtggacggatagaagcaaggaagggcatatggatgggtggatggaccctttgctcaagatactccctggaactgcagagaaaggggttaagcaagagggtgaggaaagactggttcaatacttcaggaaggctccacatgaaatttccacaggcactaaaaccacccagcagctgtccagagtcctggtgtccctgcttaccctagtgtctctgcccacaccttggagatgggaagtggaggccaactggggaataggaggaacccagaaaacctcagcagtcgccagagcaaaccaccttctgccctaagccgtggaaaggcttagaggccaggcctaccggccacagaaagtagaagagagttgaatggtggtggaatcaatgcagtaggcagcagctagctaagaaaggattttctccgagaagggctccaggtcccggcccaggccctggccctgcatgaaggttggggtgggcctcttcctccccgagtccagggccagggctccactcggggagggagctggcagccacctgggggctcctcgggcttgcatctatttgcagcctggactgcttgctttatttatttgtgcttttggctcccatgtgccacagaccccgtgtgctttgttctgccactacacggccacatggccttggacagtgctgcaaccttgcaaccccccaacctcctccgcatcgacaacagaaagccaccacacatgtgcacatacacacacacacacacaccagtgcatgcacatatgcacaccaatgtgcacatgcacctgcagacatgaacacacacacgtgcctgcaagcacacacacacacacacacaaacacaaagaggcgcccactctctagtca

SEQ ID NO: 88227 - DNA, 1816 bp, Homo sapiens
ttcgcgggccctttgttcggccgagccgagccggggcgggcgctggcccctagcgacccgcgtgcggcgccaggccccgggccggccgggtttgaggggagcggcgggaagcggccggggccggggcgcgtgtgtgctagtgtgagacggggctgtgcagacgcccggtgtgcatcacaatcaaacgggagtggaatggagggctgaagatggatgtgccccctcccttttaaaactcatgcagcggtgaaattcggtcctttccgggcagccccccgcagattttgcactggtgatggcaggcgcgaacccgccgtgttttggtgcaggagcccggtgccgttgtttgggggaagagaaaaacccggggcgtgctgcgggtgggcggagaaggacccctgggcgctctgcggctctgaaatcaggtggattttctaacggtgctgcggactgcggagtaatgcgtatgaggaaaacgagccgtacaacatctgtcctgttatcagataacgtaacccgagcgcctggttgccgcctctgctttaagcggtgcctcctttgcacctttaccttgaggacgagatttaattaattgattcgtagctatgaaaatgtgcagatgtggatgtgggggttccctgcctgttaacctggggaagaaataactggcaagcatgttacacggagctttggggatcttagcaaaaatgaaggcttgctgcttggatgttgtgccgggaggtaggggaggaggagccgctagatcgtggctgcacctattgcattcgaaggcatttgacggtattggtgattctgcacgtaattagtggagttgtctcaaacctttgcctccgccaaatgaaacctccatttgagtggtccgctcggttatttctaggcgtgaactgcggattctaaactcaaaatggtgctctgtagatgtccaacttcagcgtctttaaggagttgcaagttggagccttctgactgggttaatccattgtgtagccgaggttcggtttttctcgagtgtctggtgttcacgttgacgtacttcggccagtacaaggtagccaatttatggtgatcgctgtgagagcctcgtacgtccctgaatgtaatttgagcctgcataaggcctactttatgcaagtgatttcctgcagttggaattgaataactatgcgaatgagttgagaccctggaaacctggcttgagtgatttcagaggacagtggtagctggtttgaaatgtgtagggggtgttggcaatgatattcatagattccggatttccttcagtactgtatgaaagaataaatgataaaacttagccccaggccagatgaacttggttagtagagggcaccttgaagaaatttacattgttccagaacagcagaggtggcaatggtctttgagcatgtttcactgtagcacccctaggatgctttgttgggggaaataatgcaaaacagggtttttaaaatgactagttcagttgtcggaattaattttgtgtgtattaatagaacaaagtaatgatgtgaacagttgtaactttacctatactgaaagttttttttctacagaaagtttttaatatttattttcataagaatagacattcttggaagctgtttttcatacagatttctcatgacctgaccataggcatagtcaggccgtgagaaattgatagctcagaaaacggtaatagtaaacacacacacacactcgtttttattataaggatctgattttaaaagcttgtttgtaactcttctgtgcttcttgtccaaaacaaagaccttgc

SEQ ID NO: 88228 - DNA, 1053 bp, Homo sapiens
ggagtaaatagttgcctttagaatgctgattgtgaaggtagagtggaatgaactgtttcgtttgacattcggtgattaaaaaataactaagtcatacagaggatatatgaaactaaatacagtatttttcatcaccgctaccgccacctttttgttaaacagctggctttcctgagatacatttgtgcttttccaaatgctgtcatctggcttacttccaaaaccaagccagaggagggtcagggctggagtaggacaacctttctccttaatgaagggagtttccagtttggaaagaaatggaagacacagttcctgcagtgctggctgggaatgaggtatttacattacctctccaaccccaattgaaggggatgaggtcttgattgtaacttagtcttgcttggcccaggaaagtgatgctaacttgacattttttaaaaaagactactgatgaaagttaattgtttgatttgagtatatagaatatctttggcatcgtagaagttcaccaacaaccttttaagattgaaaaaccatttaaaagactatttgggggtctttttggccttccccaataggaattggagcattcgattgcatgcttatgctttggatgactgtttatctttcagtcagggtttattgtgcaaaggtgatacttaagattttataagaaagaaaatcgtttggctgtgaactctaggctgtcccgtataccaaagtaaaacacatgggacaattaagatttggggatagagcaagcaaagattaccaagagcaactgaagctggtggagaaggcacaagaaatggagaggaggagacaggaacagatttatagacgtccttggagctggcagaaggataggttgagggagcaggaggcggagtcctgaacagactgagcgtgaaagggtctatataagctgggaagaaccaggtaactttatgtttgttttgtttttgttatcttccgttgaacttgttttggcttctttctcataattttaagacatgggtttttaccttttctccagctctatctcagagg

SEQ ID NO: 88229 - DNA, 1048 bp, Homo sapiens
tgtacagatcgtgcatttgaaatgttaatttatttaatgaaaagtaaattatgtaattttaaaaaatctccacctgggatatatataacaaggttttacatgtttaaaacatgctgaaaatccatatcgtttgttccatttttggagttttactaaaaatgaattcttttcttagctttagatgttttcagagaatgaagaagctattgcaggaatggagagctgtttgttaagaatgcattcctcctctgtagccttcaaaagactatagagctgtgtgcagagctagacaatctgggcatccagccataaaacatcactgctgtagcacagatagttgttcgcactctcctgagccctctgtggctgcaaaccacaacagaagtaatggtcttgggaaaggaacactcaatgttattttgaactcttaatattctctgtgtctctctgagttccagctatgcattggaactttggttttctaaaatatagtagtgattaaggatgagcaataatatagcttcttaagtatattcctcttgtaagccagtggatttaaatgtttgctctaggaaataaggggtgtctaggaaataagagttgtctgtcccaccatcttcctctttatttgcctctttgttgcaatacttcttttctgttggagaaccactgccctaagacccatatgatcactgggccacacacagtgcacatggcccaaagagtcatctggaatcttccagatattttgtgggatggattggtctaatttggcccagtttccactttctcatgaacctttttggcataacaaatttttaatttttttgcacaaaaatgaagaagagtgtgactggcatctatttgtataaatccaaatggtttactctgaagaccctctctgtttttcttcttcagaccattttagaaattaatactctattgtatctttataacttccttctctgaaggattgaactacaaacctatagtatcacagtgtcaagttgaattattctcagcagttggataactcttgtctgtggtt

SEQ ID NO: 88230 - DNA, 2556 bp, Homo sapiens
ttactaatgtgcagactgtcttttgacgtggctaataccagatgcaagttggtgcccaggtggttattgggaatatgtgctttgtttgattcattttatgtgtgccttctagcttattaagaataagatctctcacagctaaaatcaagtgcttggtttgagcctggcaaagatattgtttacttttttattcccaaagatcatttctttttaattactcttttaggaagcagggaaaatctcagtgaaaatagcaactgggaattaaactaagatctgaaactgggaaatggcaacgcgggcacaggtgtcacctttccaactgttgttgagatgatgtggacaacggttattcagaaattacagtggggaggagggagatgcacaagtattttttctcatactccatatgaaatatgaagtgcagagtgaggggcccagagtgtagggagggaatttaataggctttgttcttcagggggctatggctgatgtcttaaacaaggtcttttttggtagggaggcacagtaagggaagaaggtgatggatttgtgggaacaagtacatttgagtcactgaggacaattgggaattgtgaagtgggagtggacgaggttagaaagcatccttaggtaaccagatctccatttaaaactaatctgagcatttacaatgtgattatgtgccaaggacatgagtttatcttatttaatcctcacaacactcctgtgaagtggttgcttttaacattcccattttacagatgagcaaagggagtaatttccacaagatcctatagcttataggagatgaagccagaatttaaactcaatacacttcaaagccctcacatatggaaaaagcttggattattttaatagctgcttaatgagtctcttcctctgttctgtgtcctgctatccagctgccaatattaactgactgccttctgagcactttgtgtgtatgatctcattcatttctcctcagcagcttataagttaggagctgtgattatattcactttatacatggaagctgaaactgatggaagttgaataatttgccccaaatcagagccttaataaatgtgtctaggtccttggaagccagagcttgagctctttatcattccgctgtgctgccttctgaagcctgagcctgattacatcattccttccacaaaacctttatgtcttccctgtgcagcggccacaggggaaggacatcaacttcttcctgccctcctggagctgtcttactagtatagtgagagaaatgggcaccaaacaagttgttaaaaaaagagagaaagcaatacatgtgaagaacgccacatacacatattaaaaagttgacaaaaacctaaggtaatagatcattatatagctgtatactggatctcctctcttaaggacgcatgtcaaaattttggatgctctgagaactccagcagtgaaagaaatatgtttacctttattggcccagtatttcccaaacttatgtggccattgaacattgttttcccttcataccactttttagttcagtgggactgactttaacaaattcagaaaggaagagtgcctggtcatccccagagagggcctgtgggctgcagtggttaggcaagacttcacttgaaatgagttctgaaaggctggcaaagcttggttggatgaaagggatattctacaaggagacgaatgggcaagccatgtttggaaatattttgtaaagcgcgtaacataatggctgagacatagtagggacgggatatagttattgactggatgagtgcagaggcctagctgtaaatggaggttctgtgttggcaataaggtttagaaggggctctatcaggtggaacctctagttgttggctccttaggaaccgttggtggctgttggtgggcatgacatgaatcaggtgttggattagaatcttccttgagcagaggtatggtgttaaaactggctgttgtagctgtctgtgcaaggtgatgcctacatactggtagggtcaaactgaaaagctgttacaaagaatcagcaggataaaataatacaaaatgattgacgtgggttgttggaaagaatgagttctaagaggcatagggtacttactgctcttcctagaatctgccacagaggctttaaattaatgaagctaatattaagatatttggttaaatacacatagtacattctttttagatgctgatggggaaagatgacacacaagatagtagttttaggcgagtttattgtatgaggttgtgttctgcagtagagatttgactcacagcataaatccaagtatgtgatgagccatgtaataatagacgtctgctgttaattatggtggatactctcaatgaaatcagattttcttagggccatacccataaaaaaattcttgacctagatcttatataacagtcccaggtatatagtaaattttatgcatatggaatgttgacaggaaagaagagaaaacaaaaatctttaatgtttcaaggaagcataagatcaaatcattacataaatagaat

SEQ ID NO: 88231 - DNA, 1024 bp, Homo sapiens
tctattgcactacctcattcagactgactgaggtagtataatttccattatctttaataaattttttttttttgaggcagagtctcgctgtcaccaggctggagtgcagtggcgcaatctcggctcactgcaacctctgcaacctgggttcaagcgagtctcctgcctcagcctcccaagtatctgggattacaggtgcccgccaccatgcccagctaatttttgtatttttagtagagacggggtttcaccatgttggccagggtggtctcgaattcctgatctcaggtgatccacctgcctcagcctcccaaggtgctgggattacaggcgtgagtcaccacgcccggcaatttccattatctttaaaaatctgagagatctttgggacctcaaatttgatctgtggcatctgacctattaagagaaaactaacgtttatgtgtttataagaatcgttatttatacttgaaaagcctgatgttcttttctctctgatttctaactctggcatctagaatgcagtgtaggcagcagtgtgcctgggagacaagcagagatctcacggattcctttatttttcctgccatagcagcaaattttccttggagcactatttgaaaattaacattactgaaaaaattaagcccacttaaagggactctagtttttatctaaattataaaaggtgagaagacagttctgaaaaaaatgtatcaccttgaaactagaatgctttagttaatggggtaagctagaagtaagctgcctttgataactcatgtaagagcagcatatgaatggatgataactgtctttcttccatttaattcagctacttcctattcaatctcaaatctcagttggaaagcaatttccctcacttgacccatttttcttctgcattatatctttcttctggttcttcaacacaaaaagtttgaaaagacttgtaagcagattcagacacctggtttgggctaagcgtatttcattatttggctttccagttggaaggataaca

SEQ ID NO: 88232 - DNA, 1199 bp, Homo sapiens
tttcgttttgggtttatattaccattgttattcaatgttatgtgtagtcagggtgataatagattagcaacaacagtgctattaacaggtattatgtcttgtttctctgctatgtttccaagaacaaatcttaactcattgagtctgttcaaaattcacagttctgtagagttcaccgaggagaaaacagagacctaaagaggcagtgtgacttgcccaagatcaggtagtcctgggttcaaacccaggttttgcagaaaactaattccatgccttttgccataggtaaatgagcaagggaaaaaacaatttgcaaaacaaatttgtaaacaaacatctttaaaatgtatctttctagtaatcaaagaaagaaataagccagattaaaaaagaaacattcagttgagaaaacttaaatatgatactgaggaggatgagaaaagaaatttctttaagtctcatgtatggggggaaaaaaattcttccatgcatcttttgctggtggccatgaaaacaggtgtaaataccttcaggtggtgaaaataataatgtacatcaaaagaatcaaatacgttattaccttaggaggtttttttttagcatctgtattaaggtttttttctgatatacattaaactgcacatatttaaagtataacattcaataaatgttgatatacatatatatctgtgaaactacagccacagtcaagataatgagcatatccactgaggttgagtgttgaaatgtgctggtgggagggcagatgcagtgtgctggagggagaaagaagccaaattgttaaaactgggcaactggtggaaagatggtggtggagggaatggggagacctcccttataattttgcctataaaggcagctacacatagcagttttaaaaatatttgtcattcatgtaggaaggtaatcatttcttaaatatttaatcaaacatttttcttttttgggtaaaatctggtcttttgaaaatatgaaatagcattgtgattatgaggctttgggacatcatgtaagagtaaaggttcaacaacagaagtggaaactaatttacagttgccatcttttactcttgccacataagacttgaataaaaagtaccatgatatacttttatcattactttataaagtaaaggactttctcatgcaaagaagtggaaaggataccatcttatagga

SEQ ID NO: 88233 - DNA, 1594 bp, Homo sapiens
gtcagaggcgggggtcacaaaaacgggagttcagggatgacagaccctggtaaacatcccaggcttttggttggaaccacccttcttaccccctaaaaaccccaactttttaccctaggtgtatggtgaacctaaaaattttcctgaaatccagccctcacaaaacacaaaaacttagttttgaattggctgaaatagattaaagtgattcacccttgctcttaaatgcttgtcagaagcaaaactaaatcctctctagaggaaggtaacattcacagcctcagcctatctccacagttttgtgcatgcaagattaacattcagtcaaaaactaagcatataaaaagaggcaggcgataaggttacccacaggagatctagatattagggttatcagacatggaccttaaggtaatgttgataaatatgtttagtaaattaagtgacaaatggaggatttcagaaagaactggacactattaaaaaagttaaatggaaattctggaattgaaaagtgcaatatagggtgacaatagtttacaataatcttttgtatattttaaaatagctagaagagaagaatttgaattttttaacataaagacatttaaggtgatggatatcccaattacactgatttgatccttacaaatcatatgaatgtactaaattatcacatgaatcctgaaagtatgtgtatctgttatgcatcaattaaaaattaaaaagaacttttaaaagtgcagcaactcaaattaggaattaaacaggagggtttaatagtattcttagctgaagaaaaaattagtaaactagaagatagatcagaagacaatatccataccaaagcacagagagacaaaaggatggaaaatgaaaagaaaaagaaaaatatgtaagagacaaatgggacactgttaaaagtctaaaatacttataattggaatctcggagaggagaaagaataggtcagaagcaatagtaaaagacataataacttgagaatcttccaaaactaatacagacttgcatatttgagaatcactgtagctctaagcagaatcaataccaaaaaacaaaaataaagggaaaagagaggaaaaattgccaaaacaaagaaaatcttaaaatcagccaaaggaggaaaaagatacattaccttcaaaggagcggcagtaaagacggacagtctactttgcaaagaaatggaaatcaaaatacagtggaacgatatcttcaaagtgttgtaagaaaataactgccaacctagaaatctgtatgaagcaaaaatatctttcaaaaatgaagtgagaatatagacatcttcagacagacaaaaattagaattcatcaccagcagatctacactagaggtactataaagaaagttcttcaggtaaaaggaaaattatcccagctggaagcatggagatgcaggaaggagtaaagagcactggaaaggatagatagacgaatacatctaaaataatgtgaactgtgtaaaacagtaaaaatattgataggtgcagcaaaccaccatggcacacgtttacctgtgtaacctgcacatcctgcgcatgtacctggaacttaa

SEQ ID NO: 88234 - DNA, 1540 bp, Homo sapiens
aagacaaaagccaacagaaccaaaaggacaaaaagatagattcagtgtccctatttcttctattatacacaaattagggagagcaggatatttgttgaatatggcgtaaattcacagaccaactttcatattatacttaatggtaaaaccctgaaagcagtctcttactgttataccttataacccacccctagaatttctgcttcccattctagcaactgagttctgctgggatttggagttcttattttccaatagggaatgttactaccagaggacacagaaaggttccattgaattgaaagatgaggctataacccatttgggactgttgatgccactgaaccaacaggtaggaaaagaggtcactctcctgactagagtgcttaattctgattaccaaggcaaaatggggtaatgctatacaatgggggcagggaggaggatgtttgtaactcaggattctctagagtgtctcttagtacttctttgcaccatattagagacaaaatgaaaaactgcagtactcaagaaaaggcaggtctgttgaggagtcacatgtttcaggaatgaaggtttaggtcaccctgtcatgttgagaaccctgactggctgaggttctaattgaggtcacaagacatgttggatgcatagtgagagaagaaagttagggacaccatccatgcgttcataaccaggtgcagaagcaaggattgtagtaacttagcatattttttcttgtgtctgtatgtttatatgtattaactttgctttttccccccttattttatatataattactggaagttaattaatttgatctttagagaacagaatatttagtgggactgttaactgaattttaaggagtaattaatatagccagtgattaatacaatgtctgttcggactgcagctcctcattttggggagaaggtgagaacatgttcatttataggaaggtagctgcatgttaccttcatgtggaatcagagttgttttgatacttcaaatatagagggtgtgtatggaagccaagtagccaaaggggtggactgtgccaattatttattgttgctcagttcccagtttatgtaaatccacatccatttatgccctgcttttgatacaggagatgggcactgtagacatttccctttggtgagctggcttcactttaggctttgccaatggaagcactggagacacaatgtaaggaggaatagaggagaaaagggtcttcccagccaggcacggtggctcacgcctgtaatcccagcattttgggaaaccgaggcaggattgcttgagcccaggagtttgaggccagactgggcaacatagcaagacctcatcaatacttaaaaaaaaaaaacaaaaaaaaaaacagccacgtgtggtggcgcatgcattagtgtcagctgctccagaggctaaggtgggaggatcgcttgattgaggctgcagtgagctgtggttgcaccactgcaccccagcctaaatgtcagagctagattctatctcaaaaaaaagaagtagg

SEQ ID NO: 88235 - DNA, 1842 bp, Homo sapiens
aatggcatgaaccctggaggcagaggttgcagtgagccgagatcgcgccactgcactccagcctgggcaacagagcgagactccgtctcaaaaaaaaaaaaaaaccagcaactgtgttgaatctgtctcatactttgaacttctgacgtcctctgtctctgacctctaaacccaaatttaaagggttaatcgggcctacttggatggatagtctctctgtcttaaggtcaactgatttgggatttgaattaacgtctgcacagtccctgcaaatagtacctacattcgtgtttgattaactaggggaaggtatgtgtatcccaggggccaggaatcttaggaggaatcttagaattctgactaccaaaacaggaaatagaaattaagccatgaaaaatggttgttatttacagcttgtatacccagaaaacccaagatgataagctaaaaaattatttgatgcagtatagataagtcagtaactggactagatacttaccatcagtaaccattcaggcaatccacaggatatttgatctaatacataaaaatcaattttaaaaaaattataaaatacctagacatgagcttaacatgtacaggaaataaatatgaagaaatgggctgggcacagtggctcacacctgtaatcccagcacttggaaggccgaggtgggcggatcacccgaggtcgggagtttgagaccatcctgaccaacatggagaaacctcgtctctattaaaaatacaaaattagccaggcatggtggcacatgcctgtaatcccagccatttgggaggctgaggcaggagaatcgtttgaacgcgggagacaggttgtggtgagccgagatcgcgccattgcactccagcctggacaacaagagtgaaactccatctcaaaaaaaaaaaaaaagaagaagaagaaatgacaatttcactgaaagagggaaaaaatggagagatgttctcaaataggaaaattaattcttacagagctttcagttaatttgtatgtttaaagcaattctaatttttaaaaaatgtatttttcttttggagcatgacaatatggttgtaaattttatctggaaggataaaagaataaatactttaaaaaaataatgaaaggaacctagtggtagcagataaccaaaattttatgaaactggaataatttaaatagtgtcattgtggcagaagcgtgcagttattaatggagcagaatggtcttcaggcccatctgttatacatgaatttgatgtatgaagagccattgtcacaaatgagcagagacaggaaggatcatttagtcctcgtgcactaaatgactcccaggcactgttagttacagaaaagaaggtagatcctagtgtctaccacataccaaaataaactttaaatgaagtatcatctgtataatagaaaaaattttaagaaatctagagaataaaaagagctaatttgaatagttcctacaaatacaagtaaaatctcatgaaaatttttggtagaatttgattagcgtttaaaacttggtgaatgccaaaaacaaaaggcagacaaaaactgggggaagtgtttacagcaacatgattaaaggttaatgtatttaacatgtataaacttaataagttcattatgaagaagcccactaagaactgaagagacgggccaggatatatagacaggcaatgtacagaaaatgaaattcatgtgggataacaaatatggggaaatatgttcattaatagtcaaagaattgtaaattaaggccactgaaatactttatcagattagcaaggattaaaaattataatactcagtgcttatgagattgtt

SEQ ID NO: 88236 - DNA, 1228 bp, Homo sapiens
acaacatacacctttgccatatttcaatggctagaagcaagtcgctggtctctctcatactccacaggaagggattatacaaaagtgtggaaatcagaagaccatagagtctgtcaagcacaggtcttcttcacaacttctggtcctgttggtcagagccatttggcaatgagtcgccttttccaccccaagtccaggtgtcatgctgagtgacttaagcattcttagaggcagtccatccaatatgctggcttacaggctttggaccttctctataccaatgactttatttcactttagaacccagtccttgtgactctaaatctcaagcatactctctattctgtttctttccatagtctatatagagtattaaatataattaaagttttaccttgtctttccttttagattttatgctcaaggctgagactattttgtcttatccttctcatactgcccacaaaagtctagcaaatacttcctgcacatagcagatagtcaaatacatgttgaataaattaagaccataactatttctatgacaactgcatagcctaccagttccgtccccttctctttttaattttgtctgataacattttaccagcccttcctaacataaacactgaaaggaaattctaattgaattagtcagtttcaaaatagtggcatgtaacacacacactctctgtctctctttctccctccgcccccccccccccacacacacacaaattagtgaatattttgatgacatggcattggagtccaaccagtataacttcagagtatggtctctggtgttctttgtaggtgaaactaaggacgagaaacatttacaatttctgataactaaacctcaaagacaaaaacaggcccctgccctcttttattgaattttcttcttttacaaatataggaagtagtcaactaacaaaaagactggtaatttgtaacatttttcatccagaattgttttgcatgaagtggctggattctcagtctacctacataatttcaccttttgaatcattatttctctttctccatcagaacctctgaaacaaaaataaattattgtttctctgggaaaatctacagtttaactaggaacaccgaaatgatacccacagaggcccatttgtgggaaatcttttcaccctttcctcctcctagctgcctccaaaatatgagtgttgctcctttttctacccagagcctccta

SEQ ID NO: 88237 - DNA, 1023 bp, Homo sapiens
tttgttttactgatttttgtaaatatctttgaaagtatatgtattcttatcttgcttcctgctataatcccagagcacttataaagctattgttcaggctgggtgtggtggcccacacctgtaatcccagcactttgggaggctgaggtgggaggatcacttgaggccaggagttcgagactagcctggacaacatagcacgccatctctgtttacaaaaataaacaaagcttttcttcagaaaatacttattaaatgaatcagtccccacctccctccatccttgtttttgtccctggtgcttactacaataaatagcacatgttagttgtatagttcttcagtgattgaattagtgaacatatgagatggacttgaggtgtagactctctaggaaaagaagtgattaaaatagcttagaagaaaaaggaagagtcaggaaatgggaagattcagtgaggatcaagaacaggtgccatgtaaatagtgataagaataggaagttatggtcagaatgcgggatagtggcatctaaaatttcagcagtggtgcaattctgggtggttagggtctagtagctaatactatagataaagcaccctggtgatcaggtgggggaaactacatgttttggcatttgaggttggactggtaaaacagccagttccctacctaatatccctaaagcaaaacccactgcgaaggaaatccatcccatacatacaaagcccctaattggtatttcagtgcctgaacagacaaccaagggttactacagagttgaggaaaggctttcagatcagagagtatctaagggaagaggcatccagagaaggaaaaaagatatgcagaaaacttagaagattttcagagaaaagaatagagatgattttgcatacctaaaacaagaacagggtgttgtggaaaaggagcattcaagagcacaagaaggttaacaattttaaacatcacaataaaaaactcagtagaaggattagaagatcaagttgaatcaagcaccct

SEQ ID NO: 88238 - DNA, 1042 bp, Homo sapiens
aatagaagcaccaataaaagagtagaaaacataagagaaacaacaagttacaggtgatcaatccaagagattcaatatgttgttatttagaaacagaaggaaggtgttttcaagaaaatagagaactgaaaggtatgagctgaaagcatcagccaaatgccaagcacaaataatgggggagaaaagatacatcaccctgaaatttcagaaccctagagatcaagtggaaaaaataaagcatggccaggcttggtgcgtcacactggtaatcccagcactttgggaggccagggcaggagatcgcttgagcccaggtattcgagaccagactaggggctggactgtaggagctgtatcttactccatatcatacccttatccccagcaatgcctgatgatgggttggtgttcaacaatgtggactgaatgaatgagacagccggctactgaagaagtcagggcaacctgcagtgctgttagggaagtgtccctttctagcaccttctcagagggtcctcctgtataccatatgcgaaattctgacttaagatttggagcagctagtgctttttcattgtttgacttaacatgatcatcaaacttatactagttttctttgtatttaatagggagaaagagcaagaaacacaagaagaggaacgtttgatggaagaaaagaaaaagaaaaagcaggaagaaaagaaaaagaaggaaggtgctcagaaaaaggtttggctgaagttcctgcttcattgtctttgtatcattgtgtgtctcatttgcatcatcatagccattatatgacaaggtttcattctgttactttttaaatcaatatgccaagtctataattagcgaataatagatatcctactggtgaaataaatacaggtgacagccgtaaatgtctaacttggaactggaagtgttagagctgtgttttaaggaagctgtgttttagttgctggtggtgaagtgtgtccatgttgttctacttaaaatgaactgtcctgaacaaccatgtctaataaatgaagaaggg

SEQ ID NO: 88239 - DNA, 2271 bp, Homo sapiens
tctctttttatcctccaagtccagaatttgctggttatcataaaaggtgttggtggaaacacacgcatttctcactgttactcaggaactcctatgatgtgctggagattcagaatgaacaaactgaaagccatactccaagcctcttccttttatacctgtatgtttagttatttcccagtggttaagagcacccactcaggagtcacataaactagctctgtttaatttgggacaagttacttcacttctttaggcttcagtatctcatatttaaaatgagaaaggtagtgaatggttcctacctcataaagctgttacaaagacttaatacgattatttgtcaattcaaaataaaatgtaaaaaaaaaagactaattgagatcatgcaggaaaatgactcagtatctagcatataattggtgctcagtaaaggtttactataactgttattctgaagtttttttccactggaccatcacatgtacacaactgtacatgtagacacatgcactctcacagctaatactatgcttttgtgagacattttataattttcaaagttaaggttatgtgtattatctcatttgaacttcatagctgaacaggaaaggaattcgtttacagataatctcctagtgtgaattaagaggctggttcttggttaagaaccagttaatggtaaaggcaagacttgagggagtccaggtctctgaacctctagactagagtcacatgaagagagggagttaatgctcaatgaatattaaaaagcagcatagcaaaaaggacatttttctctgttatactctcagaagcactgtgaatttacataacacttttccagaagggtccaaaaggtttatggtacatagttgtgtatgaatttatgatcttgaatgaaaaacaatggtttcttactattgtcatttcaaaatacagagttaactgttctggatcatccatttcttcttcttcttcttctttcttcttcttcttcttcttcttcttcttcttcttcttcttcttcttcttcttcttcttcttcttcttccttcttccttcttccttcttcttccttcttccttcttcctccttcttccttcttcttctttcttcttcttccttcttcttgaatttttctgtctggtttagtaccagctatattcttcatcattgtcactgttttctactcaagtagtaacaaattgcttattactgaacagtgattgtgaattacattgtcccaccactttacgcagagctatcattttctattactgttctgatgagaattttcttttatttatttatttatttattttttttttttttgagatggagtcttgctctatcgcccaggctgggtggagtacagtggcatgatctcggctcactgcaacctccacccctcaggttcaagtggttctcctgcctcagcatcaccccacccccaccccataagctggggttacaggcacgcatggccacacccagctaattttttgtatttttagtagagacagggtttcaccatgttggccaggttggtctcgaactcctgacctcaaatgattcccccccacctcggcctgccaaagtgctgggattacaggcgtgagccaccgcacctggcctctgttgagaattttcattgctaactccaaactctactggatttttctcttctccttctatatcctctaaaatactgttcctttgggtacagtttatcagtaactactaactagccttagaatgggttgtagtaataattaatgtctttccaaacaaaaaatgctttttgaattataaataatctaacagtactgctaggtaattcattgatgaatattagcagcatcaaggtttacgtttttctcagactcttcattattactggttcaaaccaaaattcattgcctgagaaatattggttccaactttctgactggacacttttgtcgggtgacacaggttggcctgactgtacctatgatacatgttatagtactagtattagtgttcacacataaaattgatgctttcctaacattctagcattttgacttccctcccctgctccagattgtgtgtctatgagggcaggggccacatttgccacaaggcagcacccagaagtctcaaggccctgagttgtttgaatataggaaagtgtttagcaatttgagagagtccgagagttggatactcttaagagagaagctgcagttataaattagattgcataatatactgaatcaatcaaca

SEQ ID NO: 88240 - DNA, 1044 bp, Homo sapiens
ctctaaaggatgctgacagtctgctgtctaaaaaataatttgtttacccagaccagtttcttttctgtgtttttttaaaaacaactttattgagttattgtggacattatatttaaagagaagaaatagataagtgttggcatatattcacctgttaaaccatcaccatgatcaagatgacacccatcatccctgaaggtgtccttgtgaccttttctgatccatctcctctgtccccaccctacccccatctgtctctaggcaaacactgatctgctttctgccactataaaagagtttttatttctagaacattgtattgagggactcctacactgtgcactttggctcctttcactcagtgtattgcttttgaaattcatccatgctgtagtgtgtatcagtagttcattcctttttattgctgagcagtgttccattgtgtaggtgtatcacagctatttatcctcttcattctcctgttcatggacatctgcgtttttccagttttgagctattgagtaaagcttcttttaacatttatgtacaagtcttatatggctatatactttcatttatcttgagtaaatgtataatagtaaaatggctatggcatatgataggtgtatgtttcatttttcaagaaattgcacacagctctttcccaacgtgtttatactgtttcacagttctgcatcttcaccaatgtgtggtatggtcatcttcataattttagccattctaataggtatgtagtggtatctcattacacttttaattggcattaacctaatgactaatgtggcactttattttaatgtgcttatttgtcatcttggtgaagcgtcttttaaagtcttttgcccatttttcattgttatttattttctttttccagattggtttctgatactaaattggcctctagagttgggcagaaagactcatcgctacaggttgtctacatgcctcagtcattgcccttctatgtgtgtagttacttgtaaatagtaatatcagaaaatatgcactttcaaatagaat

SEQ ID NO: 88241 - DNA, 1031 bp, Homo sapiens
tctggggaactgggagtcttactgctcaggaccacgtggaccttgcagagagtttggattttattctgagagcgttacaagacctcagagttttaaaccagggaggagatctgcatttcagaaggatcacactggctgcagtatagatgatggattagagagagtctcttacagtactccagctaagagatgagggtgcccaggttccaatggtgaccgttggaatgaaaatagatgggtgaaattgagggatatttgagggtggagggcatgtaggagctattaatagaaatgacaaggtttggtgattgattagatgtaggagagattgaaatactcagaagggcgaggcgagaaagctgatgagtatatgggacatgttgattttgaagtgtatcaagtataaaagagtggacaacaaagccataaaagaacaggaaacctgccaagggggatgggaaatagtggcatagagaagaaggcaggagtggccgtcgctgataaagacaacctgaggggtcttttggtccaaagactgaggggtcaaaagataacagggccttggattttagcagcaagaaagaaattatggccttggctagtcagtttccatgaaggtttggcaggaggagaggagagagtgggaggagctggaggagaatgtggagtccaggagaggtgattgttgccatttgtgaagagattaaatatttgaacatgttcaagtgatgatgagaaggagctaattacagtagccagacagtccctgggcccgttagaggttggaaatgcaatgtctttcactctgcacacaaacaccgcaaccctcttcttttttatattcagttccatcatatggaaactctggctagaaaaaaaacagagaaatacttgtaaagcaaggaattgatccaagacccaatcttatgttttgggccttcatatctactttggagagagttgtgagttgaagacccaggacacgcaaagtccctaagataggatccagaggtttggagggtgcccccttg

SEQ ID NO: 88242 - DNA, 1018 bp, Homo sapiens
atcaccttgattttacagatgaggaatccaaggcccaggaatagctggctcagactctcaagattagtttgtgtgtagcaaaactaggtctcaaacttggaactctagactttagtccagttctgtttccaaagcactacattgtcattttttctcagtttttggttatggtttccttggtttgggttgggttttaaaggggtctagctaaagttttgggttcttttgcctttcattcattttagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccaggtaaaaaccacataggatgagacattgttttgatctgaaaactttgctattttcaactttgctgctgagcaatagaaatagacatattttggtccatactcacaacatacacagagacagacaaattcatttcattttaagtgggttttaaaatttaattgtgttttccctctatttatttacattattggtcatgagtttgcagatggcatgagctacttcagctgagcttatttttcatcagaaactaaaggtctgtacattggtccatacgaacccatcaaggcagttactttagaacccagaagtgaaaacttttcagtaaaacccttttctctcaatttcctagtctgtcttatgagtgcacacaagcattttttgcagggaggtacagatccttccactaggcgtttctaactgtaacttagtcatacacattgagccaa

SEQ ID NO: 88243 - DNA, 2875 bp, Homo sapiens
gatgctttcagagatgctgatgtgctaacgtgcattgtgagtattctccagggggaataatagtacagtgtagtggtaagaattgatataattttaaaaacattaacgctctttaaaatgggatctattaagaagacaaatagcttttttctttaagtcatttttttagtgtttgtcattcagatttgaagacttgaaataaagagcttccccaaagactagttaacagttgattcattgacaaatgagtagaaaatctaattttgaattttgtttcatctttttcagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatc

SEQ ID NO: 88244 - DNA, 1039 bp, Homo sapiens
atttcatctctgaactcagatttcactgaaatgtagataattttagagtcaaatatgaaggccattatacagttgatccaagctaaaccagcagcagtggggtagtgacatcttactgtgtcttccaacaatggctagaagtaaaatatcattacatatgccaatcagaaaactggcaggcagtatactgctaatactgatcttagtctagaatttgttgtgtgttcattttgctgcctatttgcagctcttcagagatgtatctcagccatagcagggattccagctgtgctggtggtgaccactgtgggctcctacaagtcggcaaaggctctagccagaggcacactttactttgcatgtgggtacttaatctggtgatatttgctttaaaacttagttttctgaaacaattatcatcttataaaatataaaaccagaggttgtgtgcattaatcatggaagaggcatatctccaattcactaaactaaaacttggaaaaaattagatttaggaagcttctacctaaaaagatgagacgtgtattgtttctataagtctcattagcagcagaagccagagagcagtggccttccttccagactcctgtcctaggaagtttatcattctttagtataaaaactacaccaaaagacagtcacctgcagatggagtgaatcagcaagatcctgttacagctcagctgttttcacataacttcggaaatagatcccattgacctctgcagccagaagtaattctattttaagcactatgcagtagttactaaaagagaaattatctgagtgatctgtgctttttgtggatgtgggatttttcttgggtttggatttggctgggttgtttttgctttcctgtgtttgaggggtttggtaagtggggctggacttcagcaaggactggggagttgggagcctgctacggaagtaggaagagatgcttctcagtgcaagtccgtggcgtgagacgtgtgaaccccacatgcaaaggccttagctttaggtaccttcaattcaa

SEQ ID NO: 88245 - DNA, 1036 bp, Homo sapiens
atttgtaatacctattgccttctcaaagagatggaggtctagagatgataaacaaattctaggtgagttcattatttaattacctacagtaaattagtatttttatagctaattggtctttagcaacacatgagttattttagcttactaaaaccttgataatttttattagctatgttaacgtctctgatttaattttgtcctttcaatttgtaaaactacttctcccaatatatattattgtcttttgtgtaattaaaggtaatattatagttagcaattgctggcgataactggttaggactaactcccctgttattggtaactatttgcataatatattcctcagcatagagcttgtaatttaaaatgatttttaggttgcgtgtccttttgttattaatcattcttactgcattttcttagaataagagtatcaagggaactgattccatgctatttttagtcagaaaattaatacattttgtaattgatattgtaatatccatgttgaggccaaacaatgtaaaattgatggttaactatttgcattttatactgtaagtttttctcttgcacacagtcacatgcttgctacagttatgacttaaaatatttatatttctgtctgagcaaaatgtatctatatgaaaattacaactgatacaagctgtcaacatatcaacagtgtcaggtgagcttatggcagaagcaaaagattagaatttgagtttatttggaaaaataaaattgacctatgcaatataaaatgttttttgtactgaagtgtgaagggcgtggggaaatccttcttattgcctggtttcataacctcttctgtgcctgtagataatgcagttggcccttgaacagtttgggattagggttaccaaaagtataacttaggacttcccaaaaacttaactacttgaccagaagccttattgatagcagtcagttaacacatactttttatgccttcagagttttatacaataagataagctagagaacagaagacattattaagaaaatt

SEQ ID NO: 88246 - DNA, 1031 bp, Homo sapiens
agctgtgattgcactactataatccgggcaacagagcaagaccctgtttcaaaaaaaagaaaaaaacctacaaattttaaaaaccacacaggacaatgaaatgttttaggaatctacatttctgtagccttttcataccatgtagagattgccaccttccctggtggccccaggatttgttcttagcatgtttatgtttcagaatgatgtgtagttggttaaggaagtttagaacagcacagagtacaaatagctgatgtttgaaggaaaaattatatacatatacatgtttatttacatatgtagcaagagaaattcaattctgagatctgggagaaatgaaggcataaaaaggtagattacaatgcatcatttgtcccacgacccctaaattatatgttacagtggaagcattgtctgcgttagggacatgaatttgataagttcatgtttgctctgtttctagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaaggtaagtacaacactcttaacgacggtacaccctgaaaaccaaaggtacttcagacacattcagtatccagttaatcagacaaaaagatagacctgaggttctcaaagtagtcttaggacccttggaggtcccagagaccctttcaggggagtaagcaaggtcacaactattatcatgccagtactaagactgtctttttcatttgaagtctctctccggtatagggtagaggtgtccagagaactttattgtagcagagaatgtgcagaaacaggcatgaaaatccagccatttctcttaagccagacatagagatttgccaaaaggcaaaacagtgccacccttctcatgaaaaattaattactttttattttaaaatgttaggttaatgtgtagtg

SEQ ID NO: 88247 - DNA, 1624 bp, Homo sapiens
caccttaggggctggagtacaaccttgaactcctgggctcgaattgtcctcctgcctcagcctcctgagtagctgggtctacaggtgcatgccactctgcccaactaattttattttttattttttctgtagagacagagtctcactttgtggcatttatacagttttgtattgcagcatttttgtagtaaaaagataacaataatttatgtgtacattgatggagtaacaagttaattatgtcacttctacattatacagaactaaaaggaaattctatctatgtattgatatgaaaagatcactaaagtacattgttaaattaaaagcaaggtgcagaaaaacatgtacagcacacaccctattttgtggggtaggaggaagaaaacgtgtgtgtgtgtatgtgagtgtgtgtatgcatgcatgcacacgtagtgtatcagcttctacagaatgttctaaattctctggaagggcaaataagaaactgctatgagtagtgcctcttcgagagaacaggaactaagcaaatggggtggcatgagatgaaaactttctttataccttgtttatacttttgaatcgtgtgaatgtattcatgttcaaaaaaatatagtttataaaagcattcagttaataatcagcagaaaccagaaactaaaatcagagctctccgctcatgaggagtagaagtgattacagacatcaaaaagaatcctttttacagttgggctggcaaataatccagttaatgatgggaccaaaaatagcaaattggtaaattaaaatcttgactaatctggctctggcagcatagtaatgattgaaatagccccaaaataagctagttccttgaggaaagaaagcctgtttatagagctccatatgctccatgatatagctgtggcaggctcaattgtgaaaaacactatgaagaatatttttggaagggaatttttttcatattgtaataatgcatcattagaacctttgcatttataggctcagagggaagttattgagaagcctcctggctcttctgtggtgccgagccctcccccacccccactgctctttctgtagctgacctttttcctcatcctctccttcactgacattttcctccttattccttttctctaccctatgagctataagtaacaaatagttaataaaattaacaggttgtttcatcctttcttcttgctgcctctttactcattggaataaaccccctcattttatcatttttcagaataaagcttagaaaaggcaaaaagtgtaatttttagtaaacttcacatagggctgtgttcaagggagcgcttaggattattggatagtaaaagtagtctatatttgtgataaactaaattaattatctgggaaagagaaataattatcttgctttaagttcataaattgcacatatataccaacctgcaaatgtaccttgatgctttccgtagcagtagccacgaaatactgttagggagtttctggaatacagcattattcaatgttaatacaaaaagatcctgtgacttttaaatgaccctgaatttaggctgtctcccatttctggtagaaatgcattaaaatgtagctcatggacttccccctt

SEQ ID NO: 88248 - DNA, 1087 bp, Homo sapiens
agactgcaggagccacggaagggtgcctggggccaacccccatccccttgccgtgaatccttggcagccccttgttgggctcagccctagcaaagcaagggctctctctgcccctggcttccctgtgtttgaaggggtggagggtctccatccctccttgaggccttagctggtgcctatcttgtgctcagcactcacttgttttgtttacaacattgcttctgtttgttgtgctccaggcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggtatgaatataggtggtttgttgtttttgcttttttaacaagaggagtttttcatttcaactgtgtccttaatacaagccagattaaaaacttgctggactataatacttaagtgacttttatccatttttttctaacattatgaacatttaactcaaagaagggaatgtcgtatttcataagatgttactgagaatgaaaaagactgggattgaaaactgattttcatatttattgtgtgaacttggctggttatctgcttcaatttgtccaatgggcaagggtcatcaaatttccattttactatctcattttaaaaacacagatcttccctttggaaattacgtgttagatgtttatcctcaggaaaagggattggaagtggtggggcttgggcacccatctctggctggcccttgtcagttggccacatgagtgaccacagctggcatctgtggaaaacgccctgaatgtttagccagtccggtcacagctcagcccccagtgttgtcatgtaatgatgtccccatgccagactggtgtgactgcaaagcggagaaaagcattgcactaaattcaatgcaaatgtcgagccttgaaaataaaattgaagtaaggaaggacacattaaaaaaaaaagatcaacaatggaaggaggctgggtgcggtggctcactcctgtaatcccagcactttgggaggctg

SEQ ID NO: 88249 - DNA, 1471 bp, Homo sapiens
gcctggacgagagagcgatactctgtctcaaaaaaaaaaagaaaaagaaaaaaaaaaaaggaaaggctcacaagcaaagaatatcagagatgggacttgatcttattttgagagtcctccagcacgtgatctgcctcagctgcagctgtggggtagcccagggtgaggctcacgtcttcatcctgcccctcgccagtggggactgagttcaaactcaggatgcccagtgaaattggaattacagataaataatttttgaaatcatactgtttaaactgataaaattactgttatctgaaattccaatgtgaaatcatactgtttaaactgataaaattactgttatctgaaattccaatgtaactcagcatcgcatatgtttatttgctaatctggcaaccctaaattgggaccctgacatttaaaatatggaataatgcacaggctggttgtgatgttagatgacataaatttgcaaaagacctggcacacagcatgacctcagtagatgttaaaaaaaaattaataaggttctgtcttttattagttctataactcaccctcttcttagattacaccctatgaaactgctgtgtttgtaggtcaaaaacaaatgtcatggaattcaacctaatgtacacctagagctttggtaataacttctcaaaaagaatctgtttatttgaaaatggttgtaaagtgcttgttgccatccttcctccgtgctcctacctgaggcagggccaatagttaggagaatagtagcagctaatatatgtgtttgtaaaatacttttaaactgaaaacagcatcttaatcctatttctttttctttttcccctcttccttttgcacatgttctccattcccttatccacacttttttgatctgttaattatttatccatccacgcctcctctgtttccttgggaaactgtttggtgctttgtctgctgatggacactgcacacagctcaccctttctttctccaatcaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacaggtaaggctgtttggagagagcaaaacatggcctttgttttacctgccttctaaaaaatgtgtttgagacataaacttacttatttatagttaatacctctatttttaaatgtgactgaaaaagtagttgaaatactaccaggatttcccttcaggtgacttactggagtcaagagttgaagtaggaaatgctttagttatatttattcttacacttaactaaaacgtgtttgagctctcagcacccttggtgctaacttgggactggctaaagtgatgatgtgttgcacagtggtcttcggctgccggatgcatccagaggtc

SEQ ID NO: 88250 - DNA, 1202 bp, Homo sapiens
tttttttttaattttcaatcagtcttactgattttactataattgccatgtcattgtatacctagatgcttactgaaattatatacactaaaagacccagttaattatttcattctttaatgtgggtatctgatttatttagcaatcttagccagcaacttcatcacctagaaaatgaccaggaatcggccgggcacggtggctcatgcctataatcccagcattttgggaggcccaggcgggtggatcacctgaggtcaggagttcgagattagtctggccaacatggtgaaaccccgtctctactaaaaatacaaaaattagccgggcatgatggcgcatgtctgtaatcccagctattcgggaggctgaggcaggagaatcgcttgaacctggaaggcggaggttgcagtgagcctcgcacctttgcactccagcctgggcgacagagcaagactccgtctcaagaaaaaaaaaaaagaaaatcatgaccaggaatcatgaaggagaaaaaaaaaaaaaaaagaatgggaactccaaaagacagaaccattggcataaaacctttgctaatgagagagtacctcagccctcagtctttcccctttgctgttttttagacacatgtccaacaagtttgaggtctgcttttctgtaagcagcaggggaggatagaaggaaggagggaaggacgtgtcccagagacacatgctatgtgtcctcgctttaatggaaagcacagagctctagacatgaggtcaggaccaaggcttggccctcagagactgttttttctttttctttttcttttttttttttttttgagacggcgtcttgctagtcttgctctgttgcccaggctggagtgcagtggcacgatcatggctcactgcagcctctgccttgtgggttcaagcaattctcctgtctcagcctcccgagtagctgggattacaggcgcccgccaccacgcccagctaatttttgtatttttagtagagacagggtttcaccatgttggtcaggctgctggtctccaactccttacctcaggtgatcctcccgcctcagactcccaaagtgctgggattacaggcgtgagccactgcgcctggccagagactgtttttccatctgtcagaagggaggtggtgctgtagtgaggaatcgctgtggggaggcagtgcacatgtgcagtccta

SEQ ID NO: 88251 - DNA, 1006 bp, Homo sapiens
gagatcacgccattacactccagcctggatgacagagcgagactccatctaaaaaaaaaaaaaaaaaaaaaaaaaaaaaaaacagtatgtgtcagccacagtatgggccaagaagagtggctaggttctctttttttattttttaactaatgtcagaaagttgaaccattagttcaacttacacttaattatcatactattttaactcttcgttctgtcaacaggcataccaacgtttacaaatccagcagcagatgttacaggcccagcgtaatgtgtccggatccatgagacaacaggagcagcaagtaggtgctacccagattgatttttgtcatgagctataattttccctgatagaagagacgctaattgatgaactattagatgatcattgatttttctctagccaagccttcctttgaaaattcctgggttcagctaggtttgggaggaggttggcctagccagtagtggcctcagcataaagacaatgaagaatgcatttggtccctagacaagccatgagtgtcccttcccacctagttaacgcacctatgtctctgcctgccaggttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcggtgagtgtcccatggtcttcaacagccacatcaggtagagagggtacctggagtccgtatgtggtagccagggcagcatttcagtggttaggaggactggccagcgctgaaaccatagcctgttggaaatgcagccccagacaaaatcggagagcaggtatctcaaggctttttaattttaaaaaaatttt

SEQ ID NO: 88252 - DNA, 1061 bp, Homo sapiens
caggagttttgccgctgccaataatactctcagtataaaacctttaaaggtagtaccagtcagagcccccaaaatctcatttccattgtcaaatctccaaagtttgttctgttcctagtctactctgaactgtactttaccagccactgtcctccagcctaaaccacagagaagactttataatggtttggtcagtaaaagtattcagatttacattaaaagcacttcttaaaaagcagtggttgttgatacaactcattttgtatgaaatgtgatttgtataatcgaccaaatcaacatatatatgttgaaatctaacttgtagaagcacactcagcacttgaaacccgcaggtcagtagaagacatggtgccaggcctcgaggtcaggccagtcaggagagacacagctcacatacctgaagacaccagagggtataaattagtaaattgattctgcatggactaatttgccgtaagaattcagaagttagtgaaagcactttaggcttgtctgttgattgctattagagtctgtagatacaggacaaagggttatcggtaacttggaaaatacatctgtaaaggggcaaaggccagttgagtggtagtgaatttgctgccagcagataatattcatttatctaattctattcaatgtctctgaaaagagcggtatattgtaatcatatgaatcctttttacttgacatattataaatgtggtatatctttaatatgagattgataaatactagactagatgatctcgttccttaattattgtctcatccattagagccctttgtgtcgaagtaggtaagacctgacttaggaattagactccctaggtttgagtcccaactcaccaccaagaggctcactactaacttgggcaacttgcctagctgctgtttgcttcaatttctttatttttctttcttttttttttggtagagacagggtctttctatgttgcccaggcaagtctcaaaactcctggcctcaagtgatcctccctaagtgttaggattacaggcctgagacaccatactgagccatg

SEQ ID NO: 88253 - DNA, 1075 bp, Homo sapiens
gcttctttgtttcctattgtccccataggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccaggtaagaccatgcaacacttctgtgcaacagcagcaggtcagaatgtgctccaagcctgcagagagtgattaggctgagaggacccagaatctgagctaaggatctggaagcgttaagcccagagctttggcattttccttggaaatccatttgtcagatcaattttgggtatggttagcatcaggcatttttctgtaaacccttagttcagcatgaggagtggaaggggtggcagggaggaagcacactgcacactatccggtaaaactattccaaccctgtgtgaaaactagcttaatatgatagctgtgatacctggttctagtttgttccaaaggattgattgctttaatgaaagagagtataaggtgtacctctaatttaattagcagattataaaaatttctacaaacaggacaaaacatcttttaaaatttcgtgaatcaatgtgccggtgttctgatctgtggcttctcattttggtttcttaaacagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtgagggtgctgctcttcctgcctctgcatggacggtctctctagacccatttggagatgtcaggggtgacaggttgggctgtgaggcagggatgatacaaggcacagttggcgggcaccttttctagtcacctgaagcagcatgaaaagacagcaggtagtgcttatggagaaatggaaatcaatttgagtttctgctggattttttattattat

SEQ ID NO: 88254 - DNA, 2153 bp, Homo sapiens
cttccgccctgggtgggcctggtgttccttgccctcattccggtacacccacaaccttccagcatgggcgtcatggccatcatgaacatgtcacagtgctgcagagagttttttttatggccagttttggggccagtttaatggccagattttggggtgggggtgggaatcacgggagttacaattcaagatgagatttggatggggacacagccaaaccgtatcagatagttggaaagtaatggtttctgccttttagcggcagccttcagggatttgctctgttgtattaaccagaagaacctgggagcactgattccacaccgggtctggggacaggcagaggtggagagcagagcttccctggagattctcgggcctcatcacccccgtctctcctggcacagatgggaaaacacaggcctcccgggctggtgggaagatccaaaaagtcagagtcaccacggggaagtgggaagggggtctgcagggactgtgaggttttggtttaccaaagatagcatgggcctcccaggctgagaaaggctttcctaaagcacgcagtgacggcctgtgctgtcccacacttcagcacaataagaagtggggagggccgcactatccactggcacggggccttgtcaaccaggttctcccctcttgttgcaggttctgcctggagcaccgacacctcaggaagaaccagcagctggctcgttcttcgaaacctcactccccaggtgcaatatggtgcccctgcatcactgagcatgatccagggagggttcccgcttggcccccaatgcagatgaggctgtctggtggggcaggatagttgggggttcttggtcagggtccataagtgacgctgcatgggaggagatgagcaagtgccaggattggctccagcagcggcagcagatggggcccaggggcctcttttaaccatgttcctggtgaattgtttgtttccccaccagaggctggaaaagtgtgctctgtaaatagaattgtttattttacaactagccattcaagagtggttgggcctggctgggcgcagtagctcatgcctgtaatcccagcactttgggaggccgaggccagggatcacctgagcccaagagttggagaccagcctgggcaacatagcaagaccccatgtgtgtatttttataacattttttaaaagagtcgtttggccacatcagactgtggggctagccagtcccttcccgggacccaggccacacccacctgcacgtctcccaagtctgttgtcagcagctggacccaggtgccttttgcaaaccagaggctctgtgcgacgtgctctggtgaaaggagagcagaattcaaaatggggtttttctccttcctctgattagcctaacttataaaatgtaactgaagcatccaagtttttagttacacgtttggccacagagatataaaacgttaatgttgtaaaaccacatattattaggccttttaaagaaaaacattcctagtgtttagtgtatccaatttcatacgttttttctttggaaggctgtagtgaaagaaatcagaagaaagctcattcatgtccctgtgcttcctctatcagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtatgttttctcacagccacctcagcgctccaagtagctccccatcccccagagcattaggttaggggtgttgcaggggtgtcctgagccaccatagcagaatcccacaggctggccaccctcccacttctggaggctggaagtctgatacccaagatgaaggtgtgggcagggctggtttctcctgaggcctctctccttggctgtagacagctgccttctccctctgttcttatatggtcgtctctttgtgcatgtctgtgccgtaatctctccttataaggacaccagtcctgttggactagggcctacccatgtgacctcatctaactaacttaattcccgccttaaagaccccatctccaaacgtagtcacatggggaggtactgggtgttaggacttc

SEQ ID NO: 88255 - DNA, 3207 bp, Homo sapiens
gttcacgcacttgaagatgtactctgtgtaccagtacgatgttgccactagaagtctgaactgagcaaaacattcacagtctgggtttggaaatagcagtggcaaaacagaagccacaggatggcttccatgtggggccgttcccaatacagagaaagccagtgccacgaactcagcaggacttggggtggccctgttcacgtgccccatcttgctgttgcaggtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatgcgttctatatattcgatggacatacacctgcgtatgtatatccaatatgtgtgcgtgtgagcatgcgtgtgcgtatgtgcgtccgacataccacttcccgtgctgccggcgagcattgagttgtagaaaaactgttgttttaaaattggggatggaagtcaagaatatgtttgtttgtttttgggttttgttgggtttgaggggttttttgtttgtttgttttttgttttttttaccttttattttgaacttaatatgtctgtaactctgagattaaacaacaagttcgtggctcttaatgttttcctcatagaatgtgactgttgaagaacatgcatcgaaagttgctttcgaaagtacaacgctttattgaatcttaataaattgcaatttttttcttggctgttcaaagtaat

SEQ ID NO: 88256 - DNA, 1045 bp, Homo sapiens
ctcctgagatgtattttaggtccctgtcaaaatggccaggctccggaggccagagaaggctctagagagagtgaaggtgggcgccgggggggagatttttgtaggtcaaaagcggtcaagtgtcagcaatgtcgtggtgtagccccagtggcagccctactgtccagccctggcccctctcccctccaggctcagagtgtccccaatccctccacggaccctcacctgctcctctcctccctctccttcctctcgtagatggagtgaagcttgttgattaagaagattttgtcctcaccctcctagaaaggccagaacacaaaggggaggagaaatcatccatcagcccatccagagccatcctgttccaaactgcatttgagggaaaactcacgaggtgtattcaacatcgcaagcagcaaaaacataaaagaaaaggtgaaagggccaccaaacaaggacaaggaaaaaccaagagccaggaagtgggcgtatgtgtggatctaagcttcctagtggccaaagtgaaaagggaaatgtaatcagcagcccagagccagcctgactcaatttaaaaccagccctgccacgtactggctctgccttgggttactaactctgtgacctcagtggcagcatctgtaaagggggataataacacaaggcacagggtttacattagtttcctgctgctgtcgtaacgaactgtcatcaacttcgtggcttaaaacaccaccggtttctcaactttcagttctggaagtgagaagtccaaaatgagtctcactgggctccagtcaagcatgatcagggctacattcctcccggaggcttcgggggagaatcctcttcctcgccttttccaacttctagaggcccctggctctcagccctttcctccacttcaaagccagcagtggctgctcaagtcctgctcacgtggcaccactctgaccctgacactccggcctctgtttttcacctctaaggaccctgagatcacgctgggccaccacgataatctagggccatctcctatccaaag

SEQ ID NO: 88257 - DNA, 1045 bp, Homo sapiens
ccgctgtcttcctctgctacgccgtctggcagtgagtggggcgggtggagggagacccttctgtgtcatctgggggttgggtggtggtgcctggggggcccaaggcttaggggtgcagaggacgggctgggagggagccgggtgaactgttgctcggggtgagggttcctggtcggcatcttccccagggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctgtgagtcccgcaggtgggggcggccctggggagatggccctcgctgggcctgcaccgtgtggggactggccgctcccgggctgtggccctgggccctgcccgacagcccctctcccgcagggccgtgatctacctcaacatccaggtggtgcggggccagcgcaaggtcatctgcctgctcaaggagcagatcagcaatgtgagtgcccctcctgggctgctctcagcccccaccctctcaggtcacctgagggtgacgctcccctccactcccctgtacatctcctgtgggccttggctggtgaaagggtttgtttgccaaacaagtgaccctgatcaatacgtgcacttcagatcaagtgacgaagtagccgtgagacagagccaggctcctgatccccaaggacccgcagggccccactgggaccagggctctggggggtggggtgtgatttcagcccccgggtgtggccccgctgagggtttagacagtctctgtgaggatttttgggtccctatggactcttcactcattttacaaacaggtggattaaggttgagagttaggacttaaaacttttttttttggagacggagtctcgctctgtcacccaggctggagtgcagtggcacagtctcagctgactgcaacctctgcctcctgggttcaagcaactgtc

SEQ ID NO: 88258 - DNA, 1044 bp, Homo sapiens
ctcctggtgaaggagctccagagcctggcagtggcacagcgggaccacatgcttcgcgggatgcccttaagcctggctgagaaacgcagcctgcggtgagcagccccgaccctgaccatgccgccgctgctgcgcccccagacccacttcctcagctgggctaggtggtgggggagaaggggctgagcccgtgggtggccggtctccaggaaggagagagtcaggcccctcattggtccaggcacctatggctgcctctgtccccagagagaagagcaggaccccgagggggaagtggaggggccagccgggcagcggcggggtctgctcctgctgtggccggctcagatatgcctgcgtgctggtatgggcccctggtctgccctggggctggggcggctgggcagggctggggtggcctcagtgcctcctccggcctcaccctcagggcctctctgcctgtgcccgcaggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcggtgaggaagccctaggactgggggacggggggtgcctgtcttctgctaccctggtaccgtgttcccttcttgtcccagctcccctggggcccccaacccttgccccgctgtgactccaggtggccacagccagctccccgcctccccctcaatgaccctggatgctcatcgtgctggggttcccatggggctggaggcccaagattgctgtggccaaggcccctccctgtttccctcactgcccctgcctggcctcctcctgctctgcccctgtggctgtcaggcctgagggtcgggtggggcgtggggaaagtc

SEQ ID NO: 88259 - DNA, 1053 bp, Homo sapiens
ctcttgctagataaacaatgaaccccgcccaggtgtcaggagtgggagataaccaggctccccccgccggggtcggggagagtcagcaggaggcttgcgggggcggcgggggggggggcgctgcccaatctggagtgagatactctgtgtccctggggctttcggcggcatcttacttggacgatccctaaccatgggaagcagatgagtctggaaatattgcccctttttggaacttggggaaactgagcgtcagaaaaattggggacttcaaccaggggctggaatgaatccagcccagctcagacctcaggaggaggggtcggaagttggcaggggaggaaggcatagtcgccgcggggcgcccggaggagggcgggggcgccgcgggccgggccgggtcacgtgatagccgaggcccgccccccccccccccgcccacgtgggccgggaggtgcggctactcccccggccccggcagacctgcgactggcccagtcgcccctggggccctttgccactcccttggcaaggagagccgagacctcagttcccggcggctcttgcggggcacaggtgagccctggctgcgcgcgcggcccctcctccccggcgcctcccaggtgagcggccgcgatcccggtcccgggtcccgccagccccagctgcttctcctatgcggggacagcggcaatcccccctgaattcctttcggcctctggggccatttggcagccgagttccctccccgggtgctcctggagctcccagggcttgaccctccggctcggacagagctgggagcggcaggggcggggaggacagtgcggggagcaaaatccgcagcccccacccaggtcccccagccgagcgccagggcacggggaggggaggggagggggtgtggccgggatgggaaggggcgggggacagggaggccggctggacgggttcggtggccccagagttgcagccgctctgggctctggggccaggttgcggttctccctgggtagcggctgctcccgggaagctcgctgccggctggggtgg

SEQ ID NO: 88260 - DNA, 1083 bp, Homo sapiens
gcaacaagagcaaaactccgtctcaaaaaaggaaaaaaggataacatggctgagtgcagtggctcacgccgaggcgtgaagagtgcttgagttcaggagtttgagaccaggctgagcaacatagcaagacctcgtctctactaaaaatcaaataaatgagctgggcgtggtggcgcgtgcctgtggtcacagctattccggaggctgaggtgggaagatcgcttgagcctgagaggtccaggctgcagtgggctgtggtcttgctactgcaatcctgcctgggcaacagggagacacccagtttccacaaaaaaaaaaaaaaattacgactttaggcttggggccaggggcttaatggagctgagggaggaacagtgacctggctaaggcgtggcctcagggtggggcctctaccgggggcgtggccttgggctgcttggggacggactcttagcgggcgtggtctagatctgcatggggtgggaccctagtggggcgtggtctcagggtgcgttgggggcggggcccttggaggtcgtggtctcgggcggggacgtggaaggagtggcatctggctgcgttgtggacgggactcctgagggcgtggtctagggctgcatcggggcgggaccctggtggggcgtggccctgggagggtgtggcctcgagcggggcgtggcctcgggcggggcgtggcctctggctactttgggtgcgggctggcccatgggccgcagagttgctgccgctgctgtcctcacacccgctcgtgggaagcagcgcctgtcgcaactcgccacttgttctcctcacagcaggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcg

SEQ ID NO: 88261 - DNA, 1036 bp, Homo sapiens
taatagcggctcccacggcctgacccgggccggggggaagctgaggcacttgtcagtagcacatgggcacctgctggcttctagccactgcaggcggggctgaggtcattaaaagcgaggaaaaacactagctaaaaaccctttcctaaaagtgccctggaggagtgagcggctgactgaagccctctgggcacaggcacttggggtgtggctctgccagcccccgccaggctatgaggctccttagctgtgtgtcagctgcacaggatggaacaggtgaaagagaggggctggcagttccaggaggctcatgggaaagtccagggcagaggggagggccctctctgtcccccttcccacgctaaccgccgctcagtacacagggggcggctggtagccctcggtggtctccgcgttctgggtgaagggtggctgttggtagttgtccacagatgcacctgggtaggaggcgtaggcagtgttggggtccggagtggggtcaacgtaattctggatgaagtcgtccacgccagccttgtagcgctggtaggccagggaggccagcacaccctgcagggggagcacagcagggtacaggtgggtgggggaccccaccctccaccacccttgacccaagaaccggcccctggccatcctacccaggagaagatggaaaagaagctgaaggtgatggctgccctcacagagtcggcccccaccagcacgtccttcgggttggtgactgcccactggttggtgaggaagcagaaaccaacaaaccacaggaaggtccagagagctgggggaggacgggtgaagcgtcagttccatggaaagggaggggctttccaggactctgggaggggacgcgggcaggtagggcagggacctcccgggggagcctccacactatggaggggaggacttggaagccgggccgggagccacctccaaagtcccccacactcgggccttggcagggtgggccacagcagacagcctaggggacaaaaggggcagaggcaaagcccatctg

SEQ ID NO: 88262 - DNA, 1777 bp, Homo sapiens
gtgtggaggctcccccgggaggtccctgccctacctgcccgcgtcccctcccagagtcctggaaagcccctccctttccatggaactgacgcttcacccgtcctcccccagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctgggtaggatggccaggggccggttcttgggtcaagggtggtggagggtggggtcccccacccacctgtaccctgctgtgctccccctgcagggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccgcacaagcctttcatcaacatcttaaaatagtaactgtgctcagcttgtaaacaagatgatttttctggcctgcagtgccagggtcctgctgctcccttcctagagtgggggtgggggtacctgggagttgtcggtgaatgcccctttcttgcactgaataggggtaccataggtaagaccaggtttctaccttcctccagggtcagcacctctggagccttcctgggacacggccttggccgtccagcccacccctcggagataaggcccatctctggaagaggt

SEQ ID NO: 88263 - DNA, 1027 bp, Homo sapiens
ctctgcttccccagttgaagtgattctcccccgtcagcctcccaagtagccgatattacaggcgtgtaccaccacacctggctaatttttgtatttttagtagagacgagttttcaccatgttggccaggctggtctcgaactcctggcctcaagtgatccacctgcctcggcctcccaaagtgctgggattacaggcgtgaggcactgcacctggcccccagatctttctgtagtaatactgatctcttaaccacaacccttgaactgagaaatgatcatggggtgtgtcctaagcagaacatcatctgccttcctgtctgggccagtgtcaggacaaaaatgggtgtacagaggagcccggggcccagttggaaggaagaggcactgtcctgcccgctgggcctgtgaggtcaggttttgtttgtgaaacaaactcttggtaattcaggagtcaagacatctctcagctgtgcctcagagatgggctgttggcagctcacttgggggcaagcatcgctggggtaaggtgtgtcctgtgcaggcagggtcaccactcccagggcctccccagcctccctctccccttcgctagtgatgtgtcccaagccaaagccatcgggtgaggctgggagcagtgccctgttagttcgtactggggatttttaaacaatcgggacttgccgatgacagctccctctgtcattgctcaaaagaagaagccagaagttgctttagggccttgacctcttccagagatgggccttatctccgaggggtgggctggacggccaaggccgtgtcccaggaaggctccagaggtgctgaccctggaggaaggtagaaacctggtcttacctatggtacccctattcagtgcaagaaaggggcattcaccgacaactcccaggtacccccacccccactctaggaagggagcagcaggaccctggcactgcaggccagaaaaatcatcttgtttacaagctgagcacagttactattttaagatgttgatgaaaggcttg

SEQ ID NO: 88264 - DNA, 1440 bp, Homo sapiens
gcgcccggccgctgacctggcgggagatttggccgcagcccgccccctcgtgggaggaatccgggacgtgcgcccagggactgggagggcctggaaatcagggcgatggacgtggctgatcggggtggggcctggtctgagccccgcctcggtccgcccaccaagtttaaaggggcggagcgaggcggggctctggccatataaacagagggacgcacgcccatgcggctgtagacgccatgatggatgtgtctggtgtgggtttcccaagcaaggttccttggaagaagatgtctgcagaggtaggtggattgcagggagggactaaggggctggggcggagttagctcatttattagattggaattccaagaaggaagcttagaagccgtctagagcactcctgtgggcatgcagagcgcctagtgcgtgccaggtccccagtgcttgagcaccatggtgtattttaccttctcctaaggatttttgttaacctggttttcaggataaagaaaattgaagtcctgactatgctaataatatccgtagaccctgccaggcgtggcggctcacacctgtaatcctagcacttttggcggatcacgaggtcaggagttcgagaccagcctggccaacatggtgaaaccccgtttctactaaaaatacaaaaattagccgggcgtggtgatgtacctctgtaatcccagctactggggaggctgagacaggagaatcgcttgaacccaggaggtggaggttgcagtgagccgagatcatgccatttgtactccagcctggaaggctgggcgatagaccaagacttagtctcaaaaaaaaaaaaaaaaaaaaaaaaaaaaatccatagacccgcaggaggttaggggacaaagttctggaccttgatctgaggttacacaatgtttttgggtctgtgcttatgtggcacaggctgaaggattcagaacagctggtatttacattggggttgtgaaggttagaaacatacaggccgggtgcggtggctcaaaaaaaaaaagaaagaaagaaaagaaacccattgtataatcatgatcataaataatagcaacaaagatggtggtagtgatcacagagtgtgccaggtgtggctgtaaggatcctacaggtaataacctttccaggtacagattggacagatccaaggacctctgacaaagagctccttcactgggaggaagaagcaacccacactgactggcttgctttattttactcgcatgctttatctcttttaaccttgtgatttggatacatgccttctttttttgagacacagtctcgctcagtcacccaggctggagtgcagtggcatgatctcggctcactgcaacctctacctcccgggttcaagtgattctcctgcctcagcctcccgagtggctgggattacaggcacactgt

SEQ ID NO: 88265 - DNA, 1027 bp, Homo sapiens
ggtcgtaactgctgtgggagtggtgcccatgatggcattaactgaattcgtttgggggacctcatctccccttaaggctgccagctggctaaaggcacagcggtcgctggtatacctctagaccatggatctgagggcatcttggagaccctgggatactggggcgagggcttctaaggcagagaggagcagccgggcatgggcgagggggaggggcacactctgttgagaaggaaagtcttacggagcctcatgtttgtgccctgcaggagctggagaatcagtactgtcccagccgatgggttgtccgactgggagcagaggaagccttgaggacctactcacagataggaattgaaggtactagtgtgacctctccgtggccgcattgggtgtccttaagcatgtggcagtgattcagaatgctgggggttgggggggctgtgctgcaccacctgggcctcgaggggcatttcccaaacaccaggcactttataaacctccctgctcaggggcaggtgcccaggaccccttgctgcagggactactggaggcaggagaggtccgggggaggtccacggctcagtcgaccatgcctggcctttcttgctcagccatccatacccaggcccgtaaggctgcgggctgtggttggcatagggaggtgaagtgaacagaggaacgttccccatccgctgctgaatgtggaatgcggtcactattcctaaaaagcaatactttgggaggccgaggcaggtatatcacttgaggccaggagttcaagaccagcctggccaacatggcaaaaccctatctctacaaaaaaatacaaaaattagctggacacctgtaattccagctactcgggaacctgaggcatgagaattgcttcaacctgggaggcagaggttgcagtgagctgagattacatcattgcatgccagcctgggtaacagtgagaccctgtctcaaaaaaaaaaaaaagcaatgaagcctcttttttttttgagactgagtcttgctctgt

SEQ ID NO: 88266 - DNA, 1042 bp, Homo sapiens
ccctctgcctcccgggttcaagcgattctcctgcctcagcctcccgagtagttgggattacaggcatgcaccaccacgcccagctaatttttgtatttttagtagagacaaggtttcaccgtgatggccaggctggtcttgaactccaggactcaagtgatgctcctgcctaggcctctcaaagtgttgggattacaggcgtgagccactgcacccggcctgcacgcgttctttgaaagcagtcgagggggcgctaggtgtgggcagggacgagctggcgcggcgtcgctgggtgcaccgcgaccacgggcagagccacgcggcgggaggactacaactcccggcacaccccgcgccgccccgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcgggtgagactgcccggcctcctggggtcccccacgcccgccttgccctgtccctagcgaggccactgtgactgggcctcgggggtacaagccgccctcccctccccgtcctgtccccagcgaggccactgtggctgggccccttgggtccaggccggcctcccctccctgctttgtccccatcgaggcctttgtggctgggcctcggggttccgggctgccacgtccactcacgagctgtgctgtcccttgcagatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttgaactgagttgtcaaaagatttgagttgcaaagacactt

SEQ ID NO: 88267 - DNA, 1005 bp, Homo sapiens
ggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaaggtaaccggccaccgcgccggccctcctccctccgcgacctcgtccctccgacacccccttaaccccgccctgctcgtgttgccccgccagacccccttccaggacccctctcttgcatcccgctctgccccagggtgtctctccgctccctccccatcaccctccgtcttcccccaaaactgacagcccaagggctacaggagggagggagcccagttcggggcccctcacagccggaggagggggctgtggggcgacagtgggggagggaagcctagaggtgtgtagttggggggcctcatccaagtcaccaggggttgtttcttgatcacgctccccggggtttgggcctggcagccccttgtccccgtccctgtcaggcactgtcagagctgttcaccccacacctcctgatgccgcgggggcaggggttccaaatgtgtacagaggcttcagagtccggggagagagaaggggatcccagcaggctggagggtccacagggccccctccg

SEQ ID NO: 88268 - DNA, 1003 bp, Homo sapiens
aggagtttggggccactccttgcctgcctcaaagggggcctggctgagggtgcttcttgaccacaggggccagggctgcctagggtggcgcagggctgggcctggagtttgggatgcaggcttgttaaacacagggcagaaccccaggttgggaggggctcagtttgcaggcccaggcccgcaggcccactgctggtcccagggtgagacaggtgagaagagggatggccagcacacacttgagtccccttgggccacaaaggctggggcacgcccaccgttatgcagatggacagttgaggtggctgcaggagaagggttcccagggcctgtacaacacgtggaagcactaaacggccccgtttggggtttgggggcccttcccgagtcttgagaggtcttgagaggtgtgctggggaaggtggcagcctcttgtagcttgatcttcctccaccctgccccacccctaggtctctttattgattcaaaggttaaggaagctcctgggggcttgagggggtggcacagttttggtggggcccagtgaggacaaatctggggggtgagcagggcctcctcttcctcctggtgtttgaacgtttaccattccatgtgggaccattgtgccaatttgtccttaagtaaatcacttgtgctgtgtgcagtataagccttttatttttcttagaacttttcaaaataggtaacacatgcctgtctgtcataaacagtacaaacgtgagcaaacactgtcaccagctgtgcgcgtgtctgtctgtccatccagaggtgttctgagagcgtgtgtgcacgtgtgtgtgtgtccactgtgaagtcatctgtagacatacaagcctacttcttattcccagatcagcacagggagtggggaggggggcctgggtctccgttttggaaacgggggctggcttcgtgggcatgtcctctcagcttgggaggaaaggtgtggcggactcttcctctcctcctcctggcccccaac

SEQ ID NO: 88269 - DNA, 1031 bp, Homo sapiens
ttcacattctcacacacacatgcacactcacatgcacacacgcacacgcactcttgaaccacctgaacagttttacaccccatgcttcttcctctcaggcttgcgaagtgctacttcctatatcttaaatcccctccagggacctgcaattatgacttggggtcaccattagctcacccaaggctccttccagagcagaacccccaccccacccttcagatcagttatacttccctgctcccaagaactgacatatactttagaatatatatagctgagcttaaaaaaaaaaaagaaaaaagaaaaaaccctattactgtcggatattggttaatgattggtgagggagttggagggggagaaatccccgcccacaaggctcagtttcactgggaaagggactttccttagaaggaaccaagacgtcttgtatcatcagctcttaacgatttgggaagggaagctaaatagctctttcctgtaattcgaacaactaaattattcatcgagagctgcagacagagattggacagtgacccgagaggcaggagaccccagcccagccccatgacccaggcacagggccacctccccggctcctgaggggccagtgcccgaattagaggggtctggaaagtgagcggccccaggggtcccagagggtggtgggagagcctggattctagctgggagatgggggaggagggagacaggagagagtcaaagggccctggcactcagggacttgtccagatgggaaggggcctgagtggcttccccttgctgtaccccctgcggcctggagcccctcccctgaccttgggctgttggggtgaagcaggcacgcccagaatcctccctcaagatatggcctggcctccttctgccacaggaggcttggaatggggaggcagggaacaagggacaaccaagcttgtccctcaaattcaaaacagcccgcagttcactccccttgatgcccggttctgggcaggggagacatggctgggtgagaaacaccgccccgaagc

SEQ ID NO: 88270 - DNA, 1120 bp, Homo sapiens
cgtctttagcagagcataaagtggcatttcacttgtccctctacccaacagcaaggaagtggacctctcttaggcttttcttggaagacgaaaggaaagaaagaacgttctcaatgtgagatcctacaggaccactgtactgggtcgaatggcgtccccccccaccaaattcatgtctgcatggaacctacaaatgtgactttgtttggaaagagggtctttgcagatgtaattaagatgtactccacaggcctggggagatcaaggctaacagcatgttgtatgaggatggccccagtccaatgactgatgcccttatatgagggaaatctggacacagacacacagagaaggccacgcggtggtggaggcagagatgggagagatgtgtctacaagccaaggagcgagcaggaccgccggccaccaccaggagctggcaggggcaaggaagtcattcttccctgggggcttcagagggagcacggtcccagtacaccttgagtgttggccttctggcctccagagctgtgagagaatccattttggttgtttgaagctgctgagtttgtggcgttttgttacggctgtcccaggaaaggaatacaatcaccaaatgtcaaacacagggcagctgggaaaaacaagagggaaatgcatgaggcacgtaaagaaaagacttggaagagaccaaggagggacaggaaggaatgcttcctcaacttcctcctcgcacccggacaggaagccggagacctagtggctgagccttggaagaagcggctacctattcccccccacaagagcgggtgagcttggatgtcggatgaatgagaagggtctgaatcttgctgggtcccagggagaccctgttaataataacaaactcaagatatggtctcgtctcatcctcaccacagtgcctaaagcaggttttattgaaatccccgtgtatagattaggaacaaggcagggcggttgggtgcctgcccagggtcataggcagcagcagtgatctggaactggagcccagctttcccacaccctgcccttaccacttgtcctctcctgatccagggctccagtgcccatgtccagtgccttggtggggctgggccaag

SEQ ID NO: 88271 - DNA, 1077 bp, Homo sapiens
gcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctg

SEQ ID NO: 88272 - DNA, 1743 bp, Homo sapiens
agagagatgattgtttctctgggacaacagttcaaccagcaactcagtttcttgggcattaagacagaagtttttgctttgtaatcctcggaaataatgcctatggtaggactgaggataaatgctttgaccggtattgagtggtagtgtaggtttctgagcctttctttgccttattcggtttgcagttcttttctgattcgttgtggccttggtgttcgagttattcatgtttgttgtggctgcttaccctttattagctgctgactttgctttcttctccattattcagttgcacctcccaatttctcattccccgaatgatgtggtttcttgtaactcgctgatcattgattcattgataatagttctgtgcagtcatgagcttgaattattttaggttttagcttgtcgatctgagtcagctgttggagggccagtgaaccctcgtgaggggacgttccttttactgccgcggtttcctttcaggcatagagacagccagagagacagagaactctacttaaaattacttctgttaatgatttagaagcactgtcatttcctcttaagctagcatctgactcattatcattaggaactgctggatccgttaatttattcatcatgtgtgtattgagcactgctgtgctgtgctaggtactcaggaagcaaagataaagacacagccccacctccaagacgctcagacccataaacaattacaagaagtaggtagaaggtcatggcagtaccttggagaggtcatggaaggcttcctggtgcagtggctcatagctgttttgaaggaggggtcggagtagttaggctcggtgaagaagagggggagtggatgttcaagaagtgatagtgacatggactgcagcgaaaggcaattctgaggtcccaccaatactgaaaccatttccaggagctgactaggggtaccgagtaggggatggagggagggaagaagaggagctaggagcaagccagtctgggccagagacccaggaagacaagttctgagattccatgtatgatttcttttgattctggttcagcctgagatggtgggggcttttatatgaagtcggggcagtgggagcagaaaagagggctgagtgagaatcagtcttgatggggcacatggatgttggtacatttcacgaaaacggagtaaagaagaggctcaggttttggggatgatggtaaagtgcatttgggttatgttaatcagtatccaggttcctctaggtgatgtgttcagtgtccagttgactgtggcagaactggagctcaggagagggagacagatgcttcagatagggtttttttgagtcatccggctacacagaatggttttttttttttttttttttttttgagatggagtcccactctgtcgcccaggctggagtgcaatggcacgatctcggctcactgcaagctccgcctcccgggttcaagcgattctcctgcctcagcctccggagtagctgggaatacaggtgcccgccaccacccccggctaatttttttttgtaattttagtagagacggggtttcaccatgttagctaggatggtctcgatctcctgacctcgtgatccccccgcctcggcctcccaaagtgctgggattataggcgtgagccaccgtgcccggcccacagaatggccttgttacttggagtagatgagaccaagtgggaaatgtatcatgaaggcattagttcctaat

SEQ ID NO: 88273 - DNA, 1213 bp, Homo sapiens
gcaggaagtacggtaccttcttgtagtttctggagcctttctcaggaagtgttatgactgttgctttttctcatcagttcacttttttacatttaaatatctgtgactgagagggtagggtgagttgttctcaaaaagtagtttctgaaaatattgcaatccagagagctcagtttcttttaaaaacttcttttttcatggttttgtacagatttggatgggctccaggccacagagtctgtaccgtgaatgtaccttacggttaaagaagggcccctggaccttcagaccacgcctctgagggacactgaattaccgacctgtgtttggtatggagagcgcaacttctgccctgttcagtgaggacagccctccagctttaccgtactctttcatcaaagtcctacataccctgttttgaaaaaaccccaagaagttggcctgttacatgtgtcccattggtagtgggtgacagtcagtactgcagctctagggggaaacacgtgttctctgacaccgggagaagatgtggaagggacgtctaaaggtgcagtgtagaccgcggtgtaattccctggtgtttgcttgtcttcagtggcatcccttctctgagaagcgggcgcccggtagggcctccaggcgctgttgacacgcgctgaggagaaaggcgaggggtgccagtgttttccatgaagcagagcacgcgcagctgcagaacggtgaagtggaaaaccgtctcctccaaaagggagaaatgccttctgttttccccaggtttctttctttctttctttttctgagatggagtcttgctctgtcgcccaggctggagtgcagtggcgcaatctcggctcactgcaacctctgcctcctgggttcaagccattttcgtgcctcaacctcccaagtagctgggattgcaggtgcctgctaccatgcccggctaatttttgtatttttttttttttgagatggagtctcgtactttcgcccaggtcagagtgcagtggcatgatcttgcctcactacaagctctgcctgccgagttcatgccattctcctgcctcagcctcccgagtagctgggactgcaggtgcctgccaccaggcccggctaattttttgtaatttttagtagagatggggtttcaccatgttagccaggatggtctcgatctcctgacgtcgtgatccgcctgcttcggcctcccaaa

SEQ ID NO: 88274 - DNA, 1041 bp, Homo sapiens
gtgctcggcccctttttttttgagacgaagtctcactctgtcactcaggctggcatgcagtggtgcaatcttggctcactgcaacctccgcctcctgggttcaagcgattctcctgcttcagccttccaagtagctgggattacaggcatgtaccaccacacccaactaatttttttgtgtttttagtagagacggggtttcaccatattggccaggctggttttgaactcctgacctcaagttttcttcccgccttggcctcccaaagtgctaagattataggcatgagccactgtgctgggctgcggctctcagcttctttgaaggccgcgtgtggactgaccacatgacctggagcagtacagcggcacctgatttttggatggtctgagagatggcagaaatgctgtgaggcaggggagacattgattttatgctgctgttgcctgttcccccgcccccgaccatgtttcattagtgaatatgagactctaggccccttggggcctcgggttgatgggttgctgtgcacctttcccattgtccggtggtttctgctgcactgaagggtccttcgctctcctctcttgagctttgcaggagggtggcccaggatttgggaaacccaggcagcgagccctgcgttacacatctaggcccttcatctgcaagctgatgcctgtgagtgtcatcaccccctctagagacgggggtgggggaggaacagctgtttcccacctctgcactgggtggccacggccagtcgcagacttccaggatccacagaggcagcaccttctgctgttgactaaggttttcttggcagtgaatcggcagtgacagaccggtgggctttctgggaagtgcagctgtgggccatctgttgtctgtgcagggacatttacgaagcctgggaagattgagggctttatcatgaagcaagtgagtgaaatcatcttcctggaatttgtggccattcaggccttgggatgtttgagcatcctctcccccacgtccctcttgaggtcacacactgaaga

SEQ ID NO: 88275 - DNA, 1044 bp, Homo sapiens
tgttaggactgatttggggtatcatcttggggcactgatgtgttctgctcatgtgtctatatacctgtccatctatgtttcaagagtgattcgtgcccagtatggacattggaaactgcagatgggtagaaggtaaagagggcaggtttgagacagaatcttgctctgttgcccaggctggagtgcagtggtgtgatcacagctcattgcaacctctgcctcctgggttcaagtgactcttctgcctcagcctcccaggtagctgggattacaggcacgcgccaccatggcgtggctaatctttatgtttttagtagagacagggtttcgccatgttggccaggctggtctcaaactcctggcttcaagtgatctgcctgcctcggcctccgaaagtgctgggattataggcgtgagccactacacccagcctgccttcattcttcttaatggccgtgttgcattttatagttggcctagactgagctttacttttcaggctgagtattttcatttaggattgtgggaccttatttgggaggttaccatacacgtttcgagcttgctttaaatattaattggtgaagacataggatagttcagcttggagtgggatttgcctcccaggtcaaagggttctgttttcttagtgaaccatgaaaatgatgaatttgaattttgaatttttctcctctctcaggggcagataagagtagccaagaggcgggtcgtgatggcatccctctacctggggacaggtcctttggaacaggagctggtaaggtttatggggagatggttgtggcagcaatagtgaatgggccccaacatgccacagctttttgtgccatgcagttggtgtggagctgcctttccttggcctccatgtcagagccagctcttgtttttgttgccccagatatgggcatgtcaggagggcctggtgaggagagcatgggggagggcctggtgaggagagcttgaagaggtctggtctgggccttctaggcctcactggcagtgtcctcctacccacacagggcc

SEQ ID NO: 88276 - DNA, 1045 bp, Homo sapiens
agctttgccttttggcccagaaagcctaaaatatttaccatctgacccttaaagaaaatgtgtgtggatccctggtctaatgtaacgggccaggcatggatatgagagaaaacaggccatgcttaggccaggatgagagccagcacgctccgagcaggagcggggagactcgagcccagctgtgcttgggagaatgagtccacagagaggctcagggtgtgcgcagggccccccggtgctcctccctccggcagccctgtccagcatgtggcagtgtgactcctttctcccctggagggtgttggcatcaacaggctagactcctgcatgggatggtccttctctttgttctgtagcccagccctgaaaggcactgagtgtctgttcctgcccccagctcagaccatgcaagccagcaaggatgacctgggacagccctccttccctgtttcacttccctgatcagccttgccaaagccttgttgttttatcaatcgtttatcagacaatcaactttggacagttgatattctccatttttgtatcattttcattctagtaatttctattcatatatatatatatatatatatatatatatacacacacacacacacatatgtatgtatatatttttgagatggagtttttgctctcgtcacccaggctggagtgtggtggcacgatctcagctcactgcaacctctgcctccgaggttcaagtgattctccagcctcagctgcccgagtagctggggttacaggcacacaacaccacacctggctaatgtttgtactcttggtagagacagggtttcaccatgttggtcaggctggtctcaaactcctggcctcaggtgatctgcccgctcctgcctccgtaagtgctgtgctgggattataggcgtgagccactgtgcccggcctgttcttatttttattttttgcttccctatactgtattcttggttttattctgttgtttctttcccctgtcttcctgagttggatgcttaactcattaattttcagctttgtcttgtct

SEQ ID NO: 88277 - DNA, 1400 bp, Homo sapiens
atcatgaggtcaggagatccagaccattctggctaacacggtgaaaccctgtttctactaaaaaaatacaaaaaattagcggggcgtggtggcgggcgcctgtagtcccagccacttgggaggctgaggcaggagaatggcgtgaacccgggaggtggagcttgcagtgagctgagatcgtgccactgcattccagcctgggcaacagagcgagactctgtctcaaaaaaagaaaaaaaaaactgaagcccaggttcccctagactttcatccacctctgtggggattgaacccaccatggtgtttaaaaaacgcccctaggagattctgatgcctagcctagccttaagaaccactgtcccagcttggaatgggaagcttctggcatgtccagggcatcccacgtgctgctttgaggcccacaggcctgtctaggcaggtggcattgtttggtgtgggaagtgactgccacactgtcctgcaggacccatcctggcatgtgttgtggctgaaccaggctggtggtcagtgtctcagggcaggtggccccagcccgtggcgggtgtggaaagtatttttggattggcgttacttctgggaataacagcagtacccagggatggggtattgaaagagttggccagtggggcagctttgacctttggggaggcctcagacccacactgtcgtgtgctggagaggtgcagaggagtggctaggcgtcgctctcctcaactgcactgtgctggaacgatgaggaggccccttaactcagcctggagggtgggaggctcctggcctgtggcttctgactctgccacgggttatttccctgaagtggctttgataaacgtgagctgactccccagttaccgctgaaacagaaacacccaacctgcttttctggggcgtcttgccttttcccggactgatgtgcttctgccactccctctctcctgccctggtgtgggtggtgttgggtcggggcggggggtgccctgcaacccaggagtgctggatgagtgggaaattggggatgatcttacagctggatcccagggcacgtgcccatgtgggggatgggattgggggagagttggcagaggtgggtgagggatggatggtgtgtggagggggctgctgctgagcagaggggcttcaccctaaagccaggaaccagaggtcagaggtcacttgatgctgaagtgagaggcgagggtccttccctgctcagtggttgtgtccccagtgggatcttaagtcagcacctcttcaggcccatcttttgatggtcacttcctccagggcagcgtgtgtcaggtgagagatgagtgggcagccgcagggtgcttgtggatttcgatggctggcccagtggaccattcatttcctgactgtct

SEQ ID NO: 88278 - DNA, 2625 bp, Homo sapiens
attcctgccggtggctatgcactgatacctccactcccttactcaggtcctgtaggacaggcctgggctgatctcagctcctcctgctcccagaagcccttgggcagagacaggtagccaggactctgtggattctagatccttgcccctcagacagcactctgctgtcagcacagcactctctgggagccaggcaacaagaggcttcacggagtgactgtgttgaacttgctggtggccccatgagtgtggtgatgcaaggaagagcagcgtggggggaagaggcaccttctcatgtaaaatgaccccgtggctcagcagctgccagtggatttcagtgcagtctggtgacagaaaattcagagggctggcctttattcttaagggttttctgtgttgtcaagtattgccaggactgtctggcagttgcttagatgccttgttggaaagattcttgtgtgataaccatttgccgatcgttcaacagcctgatacacctcttttgcatactatgctgatttcttaacatattttatctatcaatcagtcaatcagtctatcatgtatctctatcacatttcaataaattgagctgtttcaaagaaccagaggaacactcaactatttaaaggcatgcactagagacttcttttgcaatatggtttatctatttcattcttatttggatttttgtaaagggtgcctattcagaatactcaggagaagccatgcaagtgtgatttggcatagggattactagacttgaagtctagaagcctggttctgagtccacatttacctgtggccacagctgaggggcctggcttaacctctttcctgtgcagtcggggggatggctctagattgtcaggaggacacggggaacagggctgatatttgactttctataaaataaccgtatggttcctaggccaggtgaggcaccttggtggggcgcgtggaggttgaaatcacactgggggccgagggctgctgcgcgtccctgagcgaatagattggcagaagggagtggggtgggggccttggatcccttggtgccgtgtctctggccttgctccctgtagttctgttgcgctgattcggtcgtgaaggaaggtgctgccaggccgcttcacctgcatcgccttggctttgggaggtggggctgagtgggcatctgggttggatctcaggcaggtggcagttcctctgattcatggttgtcagtttcctgttgcctggccctcgctcctcgcccagtaggtgtggtgggacaaggttctgggagctggggtagaatttggactcttaacgggaagtgcctcgtgctgccgcagacacatctggatgggtgctgagctttccttcccaagcctggtcctgatcgggggtggggtacaggcaggagcagcccggccttgtcagccgttgaaagtgtggtatctgctgggttgccagtaagctcgcttcgaggtcttgagaggcagtgcaggggaggctgagtatgaaccgtgtcaagccagttcttatgtctctcttcatctttctgctccatggaggtgagggacagagtgagtggtgcccatcccattatcacattcaggcaggaaccatgctgtgctgagccaggctgtgtccatctgctgggacatgggctctgccctccggcgtgcatttcatgaggaagatcagaaagtgagttttagcatgttgacttccatttcttctggacgcagtattctagcactaacaacacaatgtgggtggctagggcggagcaggtgttggattaagagatttctggctcatgctgacagggaaatctgttaatggttgtgagaatgtcactatttttattgccttcctgataggccaattggcgttctgcccaaaggtgaactgatggtgagaggcgggcagccccaccctgtttgcctaggccacacgtgaggcggctctcccctgggcacccagtgggtgtggtaggggtgctgtgcccgtgcaaattgcttgcttcaggctgagcacacacaccagcctgtgggcccttacagtttctcagagctgtactaatgtcagagcaggtgagtgcttatcctgtaaggataagcctgtgatgtcttctgtcccctccgtgtttttactggagtctgagaaccctgtaagatttattgcagaatactgtgggagtgcttgagggaggagtatgtgttcatgcatgtactcttaaaatgttcatacacttctgccttagaactgcaaaggcctggcgtggtggctcacacctataatcccagcactttgggaggccaaggtaggcggatcacctgaggccagaagtttgagaccaatctggccaacatagtgaaactgtgtctctactaaaaatacaaaaattagccgggtgtggtggtgcatgtctgtaatcccggctactcgggaggttgaggcatgagaatcacttgaacctgggagacggaggttgcagtgagctgagctcgtgccactgtaccccagtgtgggtgagactccgtctcaaaaacaaaacaaaacaaaacaaaacagaaaaacaaaataggccaggtgcagttgtgacttacgcctgtaatcccagcactttgggag

SEQ ID NO: 88279 - DNA, 1814 bp, Homo sapiens
tccagcctgggtgacaagacgaaactctgtctcaaaataaaataaaacaaaaccaaaacttcagagctttttttttttttttttttttttttttttgggacggagtcttgctctgtcacccaggctggaatgcagtggcgtggtcttggctcactgcaacctccgcctcctgggtttaagccattcttctgcttcagcctccccagtagctgggattacaggcacgcaccagaatgcccagctagtttttgtatttttagtagagatggggtttcaccatgatggccaggctggttttgaactcctgaccttgtgatctgcccgccttggccccccaaagtcctgggattacggggttgagccactgcgcctggccgtcagagctttttttacacttaatttgaccttttttgggagagacattattactctcagtttgtttatttcattcaaacagatatctaacaaataccagctgtgtcccaggcatcattcgggacattgggaatgggtcactgggtaccagacagactaactccctgccctcctaaggcttatactttgatggaaagcagataataagcagatgcgtctctacaaatatcggaacgagctacgaagagcagagcaagagaaggctccaggctgctgcaggatctgttacaagggggctcagggagggcctcgctgaggagtagacactcgggcagttggcctgagtgaagagggagcatccatgccaccgtctggggccggagtttcctggcagaggggagagaaatgaggagcctcctcgaccacatggggcttgcagaacagcaggggcactgggagtggtgggcactgagattggagggtgggcagggcctattggaaagggcccagaagccatggcacgctgccatggaggccaggagtgccgaggcctggatcagccttccgcagggcagtatgactgtgcagaagagcaggggcaggcgtcctttctgaagaggaggcccagagctgggaggcagcagcagtcccaactccaggtcctcctctggtgtccccgcgacacttgatttatagtgagtgagtgtggagtagcagccgcctctgcttcccctgcaccctgccctctctggcacccagggctgcagtatttatctctgccccatgaactgccagcagtcagtcccttcccaaaagcacttggtccgcagagggctgcttcctccctccccaggctatcgttcctgctgcacgtctccctcatctgatggttcctggaatagtaaagatgtcaggcccaaaggtcaggccctgggatgaagagtcgggcgtgataaccagtttacagccttggactgggaaacagatttcccgacagcgagtcccaggcctgatagtcttagccctgtgtatacacagcctgacatcctgactggtggtgcgggtctgaccggagctccagaccgctcaggcctagagcgagggagatgaaacagaactaaagggctcctgcttttttttttttttttttttttttttttgagatagggtttctctctgttgcccaggctggagtgcagtgggggtaatcttagctcactgcaggcttgacctctgtaagggcttttagattccccttctcccgttggaaacttcccagttgtcctcagggcacagaccaatggctaaaactgacttgtgagctgaaatcttgaaaaaccattgttcccagctgccctggcctgtggggcatgctggggtgtgggcatctcacagcagcaccccgtggcatctctggacctggcaggtgcttgactcat

SEQ ID NO: 88280 - DNA, 1008 bp, Homo sapiens
atgccgaacctttaacagttgaccctttgtcttaaaaggaaaaggtcccagggagaaaatggtggtctcccctagtgcagagaaagaaaaagtccccaggacgtggggtgcaacgcgtctgggaagtcacaggcatgatcttccaaggctcagccacccatcactgcactcttggagacccagagtctttcttgctctgctctgagtctcactcgttgcctcaggaaacagctctcagggcagccccacagcacgggtgagcctgggcccccagccacaccctcagcgccctgggaaatcccacttgctgcgaccaacctggtgaagctgctgctgcagggcctggttctccgtcacgatcgcaatctgggcctccaggtcccggtgaactgacctgtacccaaaattaggagagccaatcagcgtgagacagggcaggctgctccctgccaggtacagccagaggcctgcggggaaaaggaaacgtgcagacaggaaatgagcacagcatctaccaaagtcctctccacacgctgctgcaatctaagagaaaggcggcctgccctgggtgcctggacacgaggggctgctgcagagcggcggacaggccacaccaggactcactcttccacccccaccccggcgcggcaggaagcagggacccaggatcagggcgcagcctcagctcaactgctggtctttgctttcaccattcacactgtggccttgtgtcccaagcaggacgagaagcaggctttcccagagggaacatggtgacgccacctgccgacctgctctcatacacccctgcccagctgcccactgagcctctccccagagagctcagggcctcgaaccccactctgaactgcctctgcacatccagacctgctgaccctgcctgctaagctcagagcctgcactggccatcccttcctgtgagcactgagaatcagctcacgcgtgcttctcagaagcagccacctcagcgcgcaacacggcagatgg

SEQ ID NO: 88281 - DNA, 1093 bp, Homo sapiens
ggcaggggtgtatgagagcaggtcggcaggtggcgtcaccatgttccctctgggaaagcctgcttctcgtcctgcttgggacacaaggccacagtgtgaatggtgaaagcaaagaccagcagttgagctgaggctgcgccctgatcctgggtccctgcttcctgccgcgccggggtgggggtggaagagtgagtcctggtgtggcctgtccgccgctctgcagcagcccctcgtgtccaggcacccagggcaggccgcctttctcttagattgcagcagcgtgtggagaggactttggtagatgctgtgctcatttcctgtctgcacgtttccttttccccgcaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggttggtcgcagcaagtgggatttcccagggcgctgagggtgtggctgggggcccaggctcacccgtgctgtggggctgccctgagagctgtttcctgaggcaacgagtgagactcagagcagagcaagaaagactctgggtctccaagagtgcagtgatgggtggctgagccttggaagatcatgcctgtgacttcccagacgcgttgcaccccacgtcctggggactttttctttctctgcactaggggagaccaccattttctccctgggaccttttccttttaagacaaagggtcaactgttaaaggttcggcattggggctgggtgtggtggctcatgcctgtaatcccagcactttgggaggtcgaggcaggtgggtcgcctgaggtcaggagttcaagaccagcctggccaacatggtgaaaccccacctttactaaaaatgcaagaaagtagccgggcatggtggcgggtgcctgtaatcccagctactcgggaggctgaggcaggagaatcgcttgaacctaggaagcagaggttgcagtgagccaagatcgtgccattgcactccagcctgggcaacaagagcgaaactc

SEQ ID NO: 88282 - DNA, 1034 bp, Homo sapiens
gcgaaaccccatctctaaaaatacaaaaataagctgggcatggtggcctgcacctgtaatcccagctactctggaagctgaggcaggagaattgcttgaacccgggaggcggaggttgcgttgagccaagattgcaccactgcactccagcctgggtgacagagcgatacttcatctcaaaaaaaaaaaaaaaaaaaaaaaaaaagcagacaccaaagttgcgtcatggtaggtggctgggctccatggcccctactctgtccagcacttctagctcgctgagtggcccgtggaaggttctggcgtgacccctgctcagaacggccaaggcccggtcgttcccatgtcattctatgtcctctcctcctagcggctcgtgtgtccttgcaggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggtaaggagggctcttgtctgtctgcagaagcttccagagccagtgctacttgccaagacaagataaaactagctcttggcaaagacaggctgttcaagagctgtggggacaggcaggagagaggtgctctcagggggcatcagcctgcaggtcagagccacgctgaccctagagagggttgagaggattcagggaatgtgcagggtctggaggagaccaaaaacaccccagtcacctggcctctgctttaatgaaaacagcagagcttgtgagagagcagctccgacgtgatgaaaagcgctgaaaagcccaggctttccctgccacggagcagtcagcccagggcagaagtgcgttttgtggctgcactgagactccaggtcatgctggctggcccagtctcacccactccccagct

SEQ ID NO: 88283 - DNA, 1049 bp, Homo sapiens
gaagtatcgctctgtcacccaggctggagtgcagtggtgcaatcttggctcaacgcaacctccgcctcccgggttcaagcaattctcctgcctcagcttccagagtagctgggattacaggtgcaggccaccatgcccagcttatttttgtatttttagagatggggtttcgccatgttggccaggctggtctcgaactcctggcttcaagtgatctgcctgccttggtctcccaaagtgctgggattacaggtgtgaaccaccgtgtccagctgctgtttgctccattttaaacaagggaacaggtagagaagggtcaggaagaaaatggcttcctgtttgtggataatttaggagcccaaagaggctcttgccttcattgcctcgctccttatagaggacggcttaccctttgagggtcgcttgaggaggagctgatggaagctgctctgcggcctggcttgttttcctcctttgggaggaaatggctgcactgtcagggtgtgggaggggcatgggctaggcccttctggccctgatctgacagaggacaggcccccaggagcctcctggccatgctcctgcaggctctagggtgtggggtgtgccgagctctgggcactcggtccccgagtcttaggaagcctctcagagaaaacggcacttaccctgatgcggagcagcaggtctgcgtaccaggccgccaggcccatcatggaggggtaggcccgggccacccacgtatcaggcacggtgtcatagaagagagccgtggacagatcttccacgtcggtcgtgatggtcagttctccctaggagacacacagatgggtgtggggagccctgagctggggcctgggagagcaccagccccagtgcgtgtcatgagttgtcaacacagtgtggctttgtgctgcgcctctggagacgccctgcatcagggccacgcaagcgcttcctgctaaggaacggtctagatgagctcccggggcttgttctggaactgccagagctctggagagggagcagtaccatgctgatccggggcc

SEQ ID NO: 88284 - DNA, 1074 bp, Homo sapiens
gatctcagccatgttgaaagtctccggaatcttctccaggatgtcgtccagcacggccttcacctggaagccagtccccggacagcccctgtcactgcaaagagcccaccccacccactgcagggtcagggagcctgcccaaaatgttcccagccccaagtcctggagaggagggaagaggcaagtagagttgccagaaatgcagggtcatgggtgcagccacacatttgatgaggagagggagccttggccagcggctccgagcattctgatctcactacaagtccctgcagccgcggccatgagcgcatcaggccacctggctcggtgcctcatttgttcattcccacgcaccagcctctggtcaaatgtagccagcggttgagggattgcgactttgtcctttacgtgggctttctgtagggaccatgctggtcacaccctgttaaggagtggcccacacagtgcagtggtcacctgcaccaccgtctgtcagccaattcctgatttcagtcattagactaagagaaagtcctggacctaataggaataagggtctcacatcaagaattcagtctttaccgggaagtcctgtacttagctagtacgtaatagagcctttccacattctattaagaagtacaggccaggtacagtggctcacgcctgtaaccccagcactttaggaggccgaggcgggatggtcacctgagatcaggagttcaaaaccagcctggccaacatggtgaaactgtctctaccacaaatacaaaattagccaggtgtggtggcaggcgcctgtaatcccagcctgggaggctgagccaggagaatcgcttgaacctgggaggcggaggttgcagtgagccgagatcgtgccattgcactccagcctgggcaacgagagcaaaactccgtctcaaaaaaaaaaaaaaaaaaaaaagtggaggtacccaggaggcagcacagagccacccagacaagcgagaatttgttcagaacactggcatcccctgaactcttctaatcctttgagcagtaacaggacctgccattgtggccactgagcggctc

SEQ ID NO: 88285 - DNA, 1049 bp, Homo sapiens
aggaggctcatgtggggagtcttttcttcctatcatgtatcgcagggcacccctcctcagtcaggttagcgggggacaaggggttcccctaatgatactctgagacattaaggattaacaagaactcaggactggagtccgcagcctggggtggaatcctgcctctgtcctcgaagaactttgtgtgaaatgatttacccctctaagccctgtttcgtttctgtgtaaaatggggagaagaaaaaagttcaggggatcaactcaagtccacagagagtctagcacagccgctcggtcaagcttccatcaggcctgggcctcgggggcggggcccccggcgcggcgggacactcacttgatagcgtaggtcatgcgatctggccgcaggcagcgcaccatgcacagcttctgcagggccgtcttgttcttccactccttggggaagatctccttctcgggggcttccgactccaccagctttttccagcgcttggcagatccttcgatgtcactgtccagatttttgaactcatccatctccgagagggcctaggggcagaggcagcgggccctgtgactcttcccacttacccgggtcccgagagccttcctgtacagttcattcaaggaggagaggccattaccctccgaggaaaccggggctctgggataaggaagcccgagaggctggccaccaaagcaggagctgtccatgcccagctcaggcatcccaggacagcgccgggagcctcctcggcagggtctaacctgcggacatgaggcctgggatgggctaggggctgcttctctaggggtctctgcaaatggggccattctagctcaggggacgaccttcttcaggtctttttgaacagaccttgagactcgagggtccctgactgtgtccaggaatctgaagaacaaacttttcacttgccacttcccttacgctgggaggaggggaggctggggggaggaggggaggctggggggaggaggagaggttgagggagggatggtaagaggccctgaggcctcttctggccccc

SEQ ID NO: 88286 - DNA, 1026 bp, Homo sapiens
tgaccgaagctgcttttctcctttctcatggtagggaggcgccgatcgcccgtggcccagcctcccaagccctggctgccagggcacgtcaccgaggcagctctgaccttctcctcgatctcgctggctgtgtgcttggtggtctccagattctccaccaaggccgtgtctcccagaaagttccccgacgcagccgacagacgggccaggagcgaatcttccagctctttcagaacaatcttaaattcgttttgagacttggtgaggtttgcctgcaaggggaggtgcaggagtcactgcattgcctggctctgtccaccgggcacccgggcctccctcaggtggccatgtagctgagccaaggcccaggctttgagcgggaggaacgagctcaggtcctggaaggggctgcagaagcagagcccctggaacctcagagaggccctggccctgctcccagccttgaggcttcctgtcacggagactgtagggggcagaacggggacaggcgggcctgggcctcctgagcccatgcaagtggctataacagccagaaatgtggcaggtgcaagggctggcagccaggccattcttgcagggcagcgctttggagcttagagcccccgaggaccgctgtgactcatgttctttaagcaaagaggtcatgtgacttagaattaaatttgggagcaggaagaggggacagctggggaaggaaatgagccatcctgtcgtatgagaagctgtgatgccgtgggacacactgaggcaccttcagagagaagcaacgacacacactggactggcagccctggtcggggaccctcacagtgacctggccccctctgtgtgggacggcacctcctcccgtgtgaccaaacttcaggccattaccttcagctgttccagatctgggcgctctttggccaccacagcggccaagagttggtcctcgagtccatccctggtgaccaggaagttgatgagggtgcactgagcctgcatctctggcttgtagtgtgggtt

SEQ ID NO: 88287 - DNA, 1050 bp, Homo sapiens
aagccccggctacgaggcccagccccgactcacttgaaggccttcaggcaggcctcagggatgtgctccttgtcgaacttcttcagggagtctaggaaggtgtccaccttgcccatcatgatcttggccgccttccagctcttgtccttggggatcttgcccccaggtgcggtcagaatcatgacggcggcggtgacgttgaccacagcatccggcggggacccaaaggacttcagctctgtcaggttgttctgcaaatgacagacgggatgggtccgatgggagtttggaccgggtcctcggtgatgccccgaagaagccgccatgagtgtgtcaccacccacgccaacagcgaaggcagcttcctctccaaccaggccaggggtcccctttctttccctccccctttaccttattcagagtgtccagagcctcctgggctgccagcagggccggttctgctttggccaggtctgtttcacaggccttttgcttctcagtgacgttctggaaggaagatggacaggagaggttactgcaggcctgtccatgtgcctgtgggggcgtgtacgtgcatgtgtgtgcatgtgtgtgcatgtgtgtgcatgtatgcacgtgcatgagtgtatgtgtgcatatatgtgcatgagtgtatgtgtgtgcatgtatgtgtatgtgcatccatgtgcatatgtgcatgtgtaggcagcagtggtgaggggcggcccaggccccagcaggtctgagctccataagagaggctgcccctccggccaccactcatttgctgtatttgctgaatgtgctcctttgccgacatccctgtgtgtgtgcttggcccctgtctggagcccaccttcctccctgacgcctctactctgccccacaacgctcaggtcagaatgagcaatgcctcgacagttgggtgggattctggaatgggaactgttccttctatcggcttgagcttccaagactggaggggaaatccgggggccactgagaccgccttgactttgcagtcttattgtttctggggctgtttcataa

SEQ ID NO: 88288 - DNA, 1032 bp, Homo sapiens
cccctcccccggggcgaggggacctgttcagctgttggcacagcattcacttggggccagggaagccactcatcacggaggtcccaaaaatcccggatgccagtgtgtgtgtgtgtcctgagagatgtggagttttcctcataggacagggttggggcctcatcctccagaagagtgaatggtggaggagggacaagggaggctaattgcaaaggaaagcaggtgaccgatgccatagggcaggtcacaagcttgggtaccacagcaagcctatctggtccagtcctggcttggccatttactaagcaagtgactctaggcaagctcgacaagagcttattgagggcctggaatttcccaggcacagcgatgatgcaacagaacctgacgctgtggagttgacatgctagcgggggaggtggccaggtacacaaagaaataaggtaattgcacactatggtgtatgctctgaatgacaaacccagggcagtaagacagagtgtgagggctgaggagtggcctctgtgagagcatggcatttgggctgatactttatttttttttttattgatactttttgatatgtagtctcactctgttgcccaggctggagtgcagtggcacgatctcagcttactgcaacctctgcctcctgggttcaagtgattctcacatcagcctcccgagtagctgggactacagaggcacactccaccatgcccagctaatttttgtatttttagtagacacagggtttcaccatgttggccaggctggtctcgaactcctgacctcgtgatctgcccgccttggcctcccaaagtgctgggattacaggcatgaaccactgcacccggctgggctgatactttacgtgggaggaggtgggcataacttagcctccctcagccacaaactcctgctcagtaaaatggggatataagcaccaaacttatgtgttgttggagaaggagaaaatgggaatgtaaggggccaaacccaatctctgactcagagtaagcagtcagtaaa

SEQ ID NO: 88289 - DNA, 1025 bp, Homo sapiens
tggtgatgtgggtgatgtgatggtgataatggtggtggtggtgatgtgattgtggtgatggtggtggagatgataatggtgatggtggtggagatgataatggtgatggtggtgatgatggtggtgatggtgatgtggtgatgatggtggtggtggtgatatgatggtgataatggtgatgatggtgatgttatggtggtaatggtgatgatggtgatgtgatgatgccacgtggtggtgatggtggagatgatgatgatggtggtggtgatggtgatgatggtggtggtgatggtggagatgataatggtaatgatggtggtgtgatggtggtggtgatggtgatgatggtgatgatggtggtggtgatggtggtgatgatgatggtggtggtgatggtggagatgataatggtgatggtggtgatgatggtggtgatggtgatgtggtaatgatgatggtggtgatgatagcgatggtggtggtgatggtaataatatttcctctcatttactgactgcttactctgagtcagagattgggtttggccccttacattcccattttctccttctccaacaacacataagtttggtgcttatatccccattttactgagcaggagtttgtggctgagggaggctaagttatgcccacctcctcccacgtaaagtatcagcccagccgggtgcagtggttcatgcctgtaatcccagcactttgggaggccaaggcgggcagatcacgaggtcaggagttcgagaccagcctggccaacatggtgaaaccctgtgtctactaaaaatacaaaaattagctgggcatggtggagtgtgcctctgtagtcccagctactcgggaggctgatgtgagaatcacttgaacccaggaggcagaggttgcagtaagctgagatcgtgccactgcactccagcctgggcaacagagtgagactacatatcaaaaagtatcaataaaaaaaaaaataaagtatcagcccaaatgccatgctctcacagaggcca

SEQ ID NO: 88290 - DNA, 1065 bp, Homo sapiens
tttaagagacaactatggctgggcacggtggctcacacctctaatcccagcactttgtgaggccaaggcgggcggatcacctgaggtcaggagttcgagaacagcctggccaacatggcgaaaccccttctctactaaaagtacaaaaattagccggcgtggtggtgggcacctgtattaccagctactcaggaggctgaggaaggagaattccttgaacccaggaggcggaggttgcagtaagccaagatcgagccattgcactccagcctgagagacagagcgagatttctcctcaaaaaaaaaaaaaaaaaaaaaaaaaaaaaagacaactgaactgaatgttctcatctttccaaactgcaaacctaaacgtgccacctttggtttctcggtgccgttaggagaaaatctgcactctgtcccgaggccctgggattctggctgcagctgccctgggcaccctctgcctctggctctcacatccttgccacaccggccttcctgggcttcttcacgtgtggcagggcatttacacgtggcaatctctccacccagaatgctctccctctaaggtcccacagccagcaggacactgctgccagcttccagctgtgcaccatctccccaggggcatctctctgctggggctcccagctgggaggctcctctgtgactgcactgggggttttcctcagggctcttcctttaccgggtaatgtgcttcttcctctcccggcgggacagacacctcggtggaaggggggaaggaggatccccccctccgcgggggctctaggccactgctgcatgtttgtgaaatgggtgatggacgaaactgatagaacctctcccctaccctggccctacctcaatgccttgtggccccacaaacttgggggcccagctacgacccgtgtctccctacccacgttgcagcaccccccccaccgccccacaccagtcctgccctactgccctggggctccgcctcttcctgcgccccgccctggccccgccctcaccgccccggggccacgccttcccctccggccccgccccgtc

SEQ ID NO: 88291 - DNA, 1008 bp, Homo sapiens
caggggagggaaggggagggagctgtgattctcagacacttctgcctctcgtgggtgtgcaggccatgttctaccgaacaggtcctaatgttgaaaatcggttgtgtttggacattccgtgcaggcgtgtggagggtactgcaccgattcctgcctctaaatcaccagtcggtggccctgctttggggacagttacctgcagtgggacatcgggatccagctcaaaggagggcactttatctgtccagggcaggaacttttttgtgtcaggatcaatgtagtagtcaaaaatcgttccctgcgaggggaacttgatagtcttgaattcgttgatccaccatttactgaactccactcgataatccacaagctgttgagacacagaagtaaaaatcagggcccagctaagcaggatgctgagagaccctgtgtgggtggccgggccccccaggtgcatcacctggtcctggaacatggcgccaccgaaggcccagaagcaggtgaacacgaagtacagctcgtacagctccctgggggagtcggggggcacggtcttctccgtgagcaggcactccagcaggtacagaatcgtttggatcaccgtgatctccggcactggcgtgatcttcttgaacccaaagcgcaacttgtccaggcacgtgggcaggtacttgtcaaagaggatcatcaggttggccttctccgactgcaccttgcgcctctcgatccagctgctcaccaccctgggggtgacaggaggcgccgatgacacagccgctgctctgggtctgccagtgtccctgccttggtaaacgcccctccctacctccacccaattctgctggggctgccctcagggtcaccatgcctgcatggcaatgggtccaaacgagggtgccagaggggccagttgcaggccctgaaagggtcggaggaggatgccagggtcgtgggggctgtgccctctctggggttgctagctatgggggtgctgtaggtctagaacag

SEQ ID NO: 88292 - DNA, 1865 bp, Homo sapiens
ggctgtatttgccagctgtttctgttataagctccaggtgagaagcccagaacggaaaaggctcctgaggccacctctcagtacgagttgattcttccttgatagaggaattctgctttgattctcacccaggacccgggagattttgttttcaggacactagcacataaggttaagagccagtgtagaagctcactgtaatcatgaaggtgaagaagagagtagaaccatggggatttacttcgtgttccagggaaagtgtggatttgaaggctcccagcatctcccctcctgcttcctccttccttcacttccagtgaaacactccttatgtgccgggctgcttgtcagtagcagagtagcctgcactaggtgctgacccttccctctttttctgttctttggcaatttctaccacataggctttttgctgactctggcaaatttgcattgtatgtcattattgccccgggttttctcgccacaaacccatgctcatcctgccgtcccgattccatctccgggtgtcacctagatgcgcttgctctgcttgtacccacaggctttcactttgtgaaagacgcttctgtttcagctctgtgtcttgttactgatgtcaatgttgtgggctccacgttctcctgatgcctctcccccaaccctctctgagaagagagggtgtcgtgtgtgtcgtggagcctgcacttgtctggttgtctcttgtcgaacgtgcatctctttttgctctgcaggtggcagggtaaagacttggaagagacgctggttcattctgactgacaactgcctttactactttgagtataccacggtgagcacctgctagtcggcctccagactagggatgggcaaggcctccggttccaagtgtctctaatcagacatggttgaggagaccgttggatttgcccttcagtatctgtgggggatgggggagagtttaagcaaagtgcaagaactgaagtaaatctcagaatggggaacccctgagaagaggtgcgtgccttaaagggcacgggctcagagcaggcacccggttctggtgggacaggagatacctggcctggaggagggggagcactagaaatgggttttggaactgggctagaaagaatgaatttgcattggttgccgagaaagagtatgtggccctaattgaaagggagatgaaaagaaaaaggaaataatcgtgatttagaaaattcacctattctgggttagcagaaatgtgatttcagaagaaacagcccaaggggtaaaatatatagtgggggaaaaggaagtgaagtgaaatgggaaaagtcaatttgagattatctggagttttaagaagttttgttggtttttattcagtgggagagacttatagctgcaaatttgtgttttatatacgtatatctcttttgtaataatagccaaagaaagtaaaaatcataaattagctcttttcagagctccctctaagcaaggtacccagaaccctggcaagttagcacttggtgtggagaccgtggctcaccggactggtgatggggtgctttttcatttctgccacctttcttggtcattgtaagggcaaagcgggcatactcccatggcatcgaacttttgtcttaaagtaaatcaaggccgttgagttgagaatgctttgcttttgttctccaagtgtatcttcatggagcaaaagtcattgatcccactgagaaaattaagactcagaagtatcttttaaaatcagtttagagcaaaatggggcttaagtaaaacattgaaatcctgaccatattcaccagtcacttatttaggaccaagaaacaggtacacgccttggcattttctgctgtgag

SEQ ID NO: 88293 - DNA, 1142 bp, Homo sapiens
cctagagcccttggctgcagctcaatccacagcactcttactcattcttgggcagtggttttttttttttcttttttttttcccctccttttcaatctgaatcagccacattaattattttgttcatttagaaaagctgaaaatgcatttctcttccctttgccagaagtgatgagcttgtattgctgagatttgtggtcatgccttgccgtgaaggtgacagggtaatcaataggaaagactttagtagggttttcatacacattcatgtccacatgtgtttactttattaatggtttcagaacatagagctctagactctctggacataatgatgtcctttttttttttttttttttggacactagcagggtactttcctctgttgccttctgctttagcctttgatgagttgggttctcacattagcaggggctgttccgtcctataccagcccaactgcttgccccagtgattagaagtcagtactctcttggtcattactgacacatctgggaaggctaaaatggaatcctttatttctgactaggtcagatagcagtagactttatatttccttttaaagtcatatcccaagtccttgtgcttatacataatgacttaattcataaattccccttacagcaccacttcaccgatcagttttaaatatctcttgaattggccatcattttatatatctttaagcccccagaatctttgaagttaaggctctaaaattactaaccccataggcagccttcccttccacattcctattgccaagtggatggagttgaaaggaaacctactggaaacgtttaaagtgtgttcaagtttggatttacttccccctacagcgagatttgtttaaatgctaatactaagtgttagctttgacagcccagatactaaaattagaacagtacaaagattatcttggttcttagaccaggatgacatgcaaattcatgaggcatctcgtattttaaaaaagagaaaatttaaccaagtgtgggactcagttttagctcattgcattactttttctaaacctccatcaaatccttctagactctgaatattgtgttttcattgtagcacacttagtatcactctttgtgtttatgtgctgcagaagg

SEQ ID NO: 88294 - DNA, 1093 bp, Homo sapiens
ctgccctttcttcttaatgaaggtgaatagaaacaagggcttggattctgcccctctgaagaaagctgacccttatccattatctgagtctttgtgtagcctcccaagttttctcttcattatggaatatgaaagcacaggactggctgtgggggatcaagacccaaagtctgattagacaggagggatgtggaaggcaacaggtggaattttctaagatgtcagtatcggtggagagaaaaggcaggtatcttaggtcttggtaggcacaggtctgggcattaagagcctttatcagcctgcagcgtggtcagccgaagggaggacaaagtcagggactgtagatgcagataggaggtagagttggagcaggagtggccctaggaaacagcagagattcccgttttcatccacccctccctgtgcttcaggagggttcgcaggaacctgtgtgtggctgcaggctgacagaacctgcatgcagtttactgctggttaaatcagagatgctgggctagacctcctggaaatttttagtagtatccatctctcatttttcccttggattttgataatcctgcaaaggcaactttactggatttatagtgttcttgtctctgcctttctttctgttttcagcctagctgagatttcctttttatttgtttttttttgttttttttttttttttgagacggagtctcgctgtcgcccaggctggagtgcagtggcactatctcagctcactgcaagcttcgcctcccgggttcacgccattctcctgcctcagcctcccaagtagctgggactacaggcgcccgccaccactcccggctattttttgtatttttagtagagacggggtttcaccgtgttagctaggatggtctcgatctcctgacctcgtgatctgcccacctcggcctcccaaagtgctgggattacaggcgtgaaccaccgcgcccgacgagatttcctttttagaaaaggactcttaaaactgccaccatcttctcctgtttaccttcagaagaactttaacttgtggggaattcatatgggttttgtgttacggctggagccattaagtaat

SEQ ID NO: 88295 - DNA, 1677 bp, Homo sapiens
tggctaatttttatatttttagtggagacggggtttcgccatgttgaccaggctggtcttgaactcctgaccacaggtgatctgcctgccttcgcctcccaaagtgctggctggtctcagacttttgggctcaagtgatcctcccaccttggcctcccaaagtgctgggattacaggtctgagccactatgcctggcctagtttgtttttaaatcaataacaggtatcaagaagtttggactggctgaccttggtggtcttactgctgccacctttgctctgcctcacacagtatgtgggtgtgttgggcccttctcgcaagctcctctgtcatgtgatggttccgtcttcagggctgtggcaggaccgcgctggttcagtttgctctgtgtcagctgagtaaaggatgggtggagtacaccaattttgtaacttgtaacatttggtcttgtggttttgcaaggaaggggtgatatataattagtaaggcaggagagcaaaggaaacaggaaggggatctgcagtgctcctgtatcaaagtagatctccaaagcaacaagggacaaaagcaagcacactcctcccgcccacccgtttttacttactcttatttgatcagagaactttgctttcataaacatccttgaattaaggctggaattttttggtaaaaattcctaactgaatttggtttagaagtatacagaaaacccaatgaattaattgaataatctcccttacccccttcttcagacaattctcctgtattctctcaagtaataaaagtactagaaagatcaattgtatttatcattaaatggctggtgcttataatttattccttgaatccagttaaacagtgagctttcctgataacctaggcattgttgtcccctacagtaacctgggcctgttggatgtgtaaacattttcctttgacccaggactgtgttgaaactatttgttaatcacacagcaggatgatcaatacttacaccagctgacgggacacctggcatgactactcagtgatccagtaaaaccacgccaagctggttccatagagttttcatttttgatgataggactcgtagctctcagaatcagagaatgtttagaggtgaaacttaccacaaatgtgggtcagcatctttagtttgtttccggtgtgtggggtgcagtggcggacagtgagagagccatgtgatgggaggaggctgcagagctggactttgaataatgggtagggttcagaaaagtagaaaatattgtgaaatttattttattttgtttttttgaatgaagcaacaaaaacagagatttattgaaaatgaaagtacactccacagtgtgagagtggacccgagcataggggctcaagggccaaaaatactgtgaaatttattttaatcaaagtggaacatagatatagttttaaagatcctatacaacacaaaattttacgtgcttatagcagcagttttcataagaaccccaaagtggaaacaaccagatgccatcagctcatgagtgggtaaagaagatgaagtctgtccctacaagggaagattctttagtcataaaaaggaatgaagttctgacacatgctgcaacatggctgaacatagaaaacattgtgccaggtgaaagaaaccagtcacacaaggccatgtatta

SEQ ID NO: 88296 - DNA, 1001 bp, Homo sapiens
ataagaaaagagagtagtttcttctgtgttttcatggaaaggagttttctcacaggcataatcttgagtgtctactcaagatttgggaacatttcacatgtatgtattacggtttgtgaccaaagactctggataaaaggaggatttatatcagaattataggaagagctgtcatgctgtaccatggagacctgtgtgtgggtggtgagaagattcaacaagaaaaataaggtctgggcactggcatgtctgggtgctgctgcgggctggggagaggagcctgttgcatttaagaaagatttgccttttcatcaccatgtctccagaataggcatggtgcctggggccctacagaggcagctcagcaactgtggagggaataatggattgaaccaagttccatcttgtaaaaagttaatatgtggtgagtttgagtttttttcctcaactctccatttcaaacagaaaccagaacacttctgtgcatgtttgaccccatgcagaacccgttttctttgtttttctatgatatggatgacttccattattctcaaacttagttactaacttactgatttgcctttattgaaaagaacacaattatttacagtgaacaccttcttagaaaatctggaacataaggttgccataattatacacactttgtggtctttaagatatattctcagggtgacatgaacatgtcagagtataaacatttttagaattcttgatgtctggtgccaactttttccaaaagggctgcaccaatttactcttttcttagcaatgtatcagtacacgtacctgtaatagtgcaaatgtgccctcagtgaggatcaacattttaaaagtttttttttaaaacaaacaagcaaacaaactgaatttggtggttacaaaatggtgacttattaaatctactgatcactagctggattgaaaaaaatttttattttgcatatttgtgtattatgaactggctacatcataagaaatga

SEQ ID NO: 88297 - DNA, 1025 bp, Homo sapiens
tgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgagttctgtgtctttgttggtttcatttgattttttttttttaaagtacatcccaaccacagtctcgctgattccacctgtcctggaagttgaggctgggctaggaggggcaggtaggtccctgcagggagctcagtgaccaggaggttatgagagcagccctagtgaataggtgaccaagaggctgaatgaaccccggggcgcaggcgggttgccgtgcagcggctcctgttgagaatgctgctctgcagctgttacctgatgtgtgtggctccccgcatctccctttagcaacttggaagtaagctttctccaccccacggtatccaccaaacacagggcatcatgtcttcgcttctctttaggggtttggctggacaccccaaaatgaggacagccaagt

SEQ ID NO: 88298 - DNA, 2474 bp, Homo sapiens
ctcggctttgagaatgggaagaggaatctcaacactggctggagtcctctttaaaccctcagccgtggcacgaaggtggcttctgtccgtggcaggatccagaacagctgcttctgagggttggggcagggtgaggagccccacacatgctgtgtcttgggtagggaaggggcagagtgacgaagctcttccaacctgggtaatgtcacttcttgctcagagcatgtttttattcagacttcgagaccaaacatgacatctttgttcctcagacgagggcatgggtttagaaagaactgaactctttggctgtggtttagggtttagctaagagggcatcgctgggggttccatgctgaccgaccacacatgggcgtcgagccgtcctcctcttgtccttctcttcaccacaaggtggcactcaaaattgttgactaattatgagtagactagttggtaaatgacactcttgaagtgaagccacaggggacctgggaacctgcactcgtgctgacccccgtgtctgcctggtagttctgacctgggatggcaagatgtcggcggtcagtcaggatgctattgaagacagcagacaggcccggactgagaccgtggttgatgactgggacgaagagtttgaccgagggaaggtatgatgtgtgatgctgaccacaggcttgagggagcagggcggcgtggctcagctcagagccggggcagttggaggtggcggcagtggcatgaagcggccgagcatgagaagagccaggctgcccaggcctgtccgggcgtgtggccatggacagggcatgcatcctcgcagcttccgcccctttgtcaatagggggactgcaggtcgccgtgcacaggggtcattgtgaagagtgggtctccagagagctcatgagagcccggcctgtgtgcaggacctgcatgcagcatggagccccgtgggccaggaaagagccgtttttgggaactgtgatgcctgtgattcttggtctaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggtcggttccgagggggtgggtgtaagggtgaggtgggggtgtgtgtgccgtgtatgtgtgtaggggtgtggtggggtgtggcgtgtgtgtatgatgtatgtgggctgtgtatctggcacatgtgtgttgggtggtgtgtgtggtgtgggcgcgtctgtggtgtgtgtcctagtcacttggagaagggtgtgtgtgggatgcgtgtgtataagggggtgtgtgtgggatgcgtgtgtataagggggtgtgtgtagtgtgtgttgggtgtggggtgtgtacacctggcatctgtggcatgtgttctggtcacttggagaagggcatgtgtggggtgtgtgtgggatgtgggttgtgtgtatatctggcatgtgtcccagtcacttgcagaagggtgacttcttgccagccgcatcgagatgccatgcattgggttcctaggttggactcatacccgagggtggcagtgggaagattcgggtctcgtttctctctgtcaggactaccgtggtttgttctgcagcctcctggagacaaggcgtcccttcccgggagctgtcggtctggatctgagggagctctctgtgtgggctctgctgcgctgggagcctgtcacggtaggagctctcccggtaccagtgtccacagaccgcccaacacagaggctttgaggcttctctagatcggaacctctttggtgacattcccgaccagccctgcaagagaaacgacagtgtgtgtgtgagcagaggtggccgcacacctgctggacatctttgccaggctgtgccttctcatgtttcatagacagtggtctgtgctggcagaggctgctgcccctggttggggctatcaggagagtgggggatggtggccacatgtcccccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaa

SEQ ID NO: 88299 - DNA, 1568 bp, Homo sapiens
acccaccacctaggtaactttgtttttttttttttgtttttgtttttgtttttttggttttttttttttttgagacggagtcttgctttgtcgcccaggctggagtgcagtggcgcgattcggctcactgcaacctccacctcccaggttcaagcgattctcctgcctcagtctcctgactagctgagattacaggcgtgtgccaccacgcccggctaattttgtatttttagtagagatggggtttcaccatgttggctaggctggtctcaaacttctgacctcaggtgatccagccaccttggcttcccaaagtgctggaattataggcatgagccactgtacctggccaactttgcatttaaatagatgttgaattaattgttagctttctttcaaacatacatgtaacttaatgtgtatctgaaaactacagggtaaaagccttttcagatttttaggtgaaagggaggggagtgagggtagacagaaggaacagctctgctgggtctttcagaacatcctctccctgtttcctggctgtccccacagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtctcttccacaccagttgccagaggccagtgagcccccccagagcccctctgagaagaggaaaaagacctttgtgggagagccgcagaggctgggctcagagacgcgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacaggtaagggcaggagcaaagtggcatctgtctacctctgacgagaaacaaagcaaaaccacagaatctacccccaagtaggtatggtctggaaacgtagtctgcttgcgtggttttctaaaatgtggatttgtgatcagatgtctcctctggctgggtgtggtggctcacacctgtaatcctagcactttgggaggctgaggcgggtggatcacttcaacccaggagtttgagaccagcctaggcaatatggaaaagccctttctctaccaaaaacaaaaattggttgggcatggtggcatgcacctatagtcccagctactcaggaggctgaggtgggaggatggtttgagcccaggaggtggaggttgcagtgagctgagatcgcgtcactgcactacagcctgggtgacagctaaaccctg

SEQ ID NO: 88300 - DNA, 1050 bp, Homo sapiens
ctcctgcacagcgttgctgcacacccattcgccccaaattgtctttttcttgtttgtggcggggcagttttgagacagtctcgctctgtcgcccaggctgagtgcagtggctcgatctcggctcactgcaacctctgcctcgcgggttcaagtgattcttgttcctcagcctcctgagtagctgggattacaggcagtgcaccaccatgcccagctaattttttgtatttttattagaagtggggtttcgctatattggtcaggctgatctcgaactcctcgaggtgatccccctgcctcagcctcccaaagtgctgggattacaggcgtgagccactgtgcccggcccccaaattgttaaagaccagacaagctgggcattttgtgtggttgtggatggaaagggcaaattgatctttactctcaaagtgaattttatttgtcttttccttgatttttcaaacaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggtgagaggcttgtgtcagtgcagctgcctcctgggacaggtttcagcacccatgcacatccagatgcggcctctgtagagcacttactttgtgaaaagtgtgatgttttgtggttgtattcaagtcctcgttgttgcctctctgcgtggagtgaaaagatgccctttacagaagtgttgcaccagaatctagtgttctcagacttgcagggagacacggaagaggcagccgcttctggtgccatccttagaaccctggcaaaatcggccatggtgatgacactgcctgaatgtcctttagaagggacagttcctatctgttggggcactaggaaggaactgggacgcagagcacactttggggtcacattccgagttatgaaaatattacacgttttaatagaagttgttacctgttgattattaatagtgtttggaaatgta

SEQ ID NO: 88301 - DNA, 1304 bp, Homo sapiens
ccgccgtcccccgggctccgggccggtgatgggggtcgccggggcccgctgtctgtgcaggattcaggtcaacttcggagaggttgaagtcggaatcagggcgagggcgtcgcgtgcggccgcagagctcagcggggcgggtgcggccccggggcgggcaccttcctcgtggttgcggaggaggccatggagcccggggcggggtgcggttccgatgctgctgcttctggcgggtggcgtgggggtcctgggcctggggctggagtggcggccgccaaacccagacacacgagaggggagactccgcgcgcccccgtttacgtaacgctcgccacggagccatgctcggggagaggtgctcgggtcgctgtgtccgcggccgggctcggggcaggcgctgcggagtcgcccgggaggcccctggagcgcggcgctgggccccgggaggccgctgcttccgtgggctcctctccccagcacgtggttgaccctgcgagcgtccgttgcagttcatcctggaaaagtgactttagaaggaggagggagcgggaatgagcctaaatggtgctggctggggttcgcgcaggtggaaatgtggatgaggcctgtgctgtccttggacaagagagagcatccttcctgagttgggtagagtgtggatggtgtgtgcgtcggagggattgctagtgattacaggaacacttgtctcgggctcctacacgtcagagagcgagcgagcgttgtttaggttattgcttaatgttttaggtggaattggtgaagtagagattgacctgtcccacttgaaaaattgtgttcaaaatctctgcatctacattaaggagtgggttaagttcaaagttacttatctcgagtgaaactgggttacatctcccaaggttcgtttatcccctccctaagtggttctcaagcgttggttgtgcatgacagagttctcaccttccagggtagatgtgagtcctaaccgaaagcagtgatattgtggggagtttttaatacgactggatgtcttcactttgtagatggcttttattctgagatcatttccttacacatttttcgggagttggtatgcttttatttatggatgaagtcataggtctgagatttgctgtagaattacctggggatgggaagtgactcaggatgggtcagatgtagttactgaggctgaataaggggggctcatgtgctccctgtgcggttctccatctgtgtgtttgaatgttttcactgtaaactgtttttacgaaccttaattttatgtaatcatagtgatcgta

SEQ ID NO: 88302 - DNA, 1293 bp, Homo sapiens
tgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaacgtgggctctctccgtgtggctgtatccgatgttcagaacggccacttcctagctcaagaatgggaatcagcctctgcaaggagcctctcctgtccggcgggagggggcgccctgtgtcctccagagaaacaaggccagtgagctctgagtcaaatatgggatgcagacc

SEQ ID NO: 88303 - DNA, 1087 bp, Homo sapiens
atctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgg

SEQ ID NO: 88304 - DNA, 1019 bp, Homo sapiens
tttctgcacttcctccaaggcctggccctccacctcctgcccctcacacccctcacacccctcacacccagcttccagcatctctcttcccaccacctctcttccggacacaagtgcacagggcctgccccctgccttgcgagcctaaatcctccccgaagtgccaggcacctcatagggctatgttggcgggctcaggggtgccccctggactcacaccccagcccttgcccagccttcatttgactgtaaaacaagggatggagccacccggaagggtgtggggctcctgaggtttccagagagcactgccatgccagcagcggtgaggatcccagatgtggtggccgtgttcaccttcatcctaaggcacttccaggtaccccgcacggttctcctgctccgaacactttgcaccttctagagctctgctctggtttggtgcttctgcccccacccttgggggacagattccgtgttcgcgcctcactctgcatttgctggaaccttcgtcctccggccccatctttgctccctgccttgtgggtccttctccccaaaccacagggacccaggaaggcctccgtggctgagcagtggtgcgtgggtcgccctgttggtccgtgaggcttggacggggagcagcagcgttgcttgtgctttctgccgaggtcagctgtccatgggctgaggggggccagcagggtctggcaggtgctacctgttcacctcctggcctgctcccccccaacctgctggccagttgggctttggatgtgaccccaccctgagagctgccctggggcgtccatcttctctccgcacaaatctcccttccccttcaagccctgtgtgaccaggatctccgacacataagacaaaaggaaatagggtttttagagtggacgggtgggtagagcaccctccctgacctgtggtcattcttccagttcgtgcaaatggcaagggggttatatcgagatctccaagaagacacggggcggagggctggggtgcag

SEQ ID NO: 88305 - DNA, 1412 bp, Homo sapiens
gggccccagacgctgtctcctcttccttgcagcctcaaggcagcctccccgccgatgcctccccacatccaatgggggtttgttccctttccttgggttcctctggatcagccccgaggaggctccgatgagcccaaatccctgatgcagctcacaggcagctctcggtggaacgggaggaggcttcaagggagcgggtgctgcaggttccctgcatgggataaccgagaacacagaaccttccagaatcctggagagcagggaggggcgggttgctgtgagctggtgggccctggtggtcgcagccccttgcctgctactgcgcacggcctgatggtgtggggctgggcacaccaggccgcatgcgtgtctgacccgcggtcacccggttcccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctccct

SEQ ID NO: 88306 - DNA, 1015 bp, Homo sapiens
agttcatggccggccaggccctccccacacccggtgataaaatcttcagtgtttgcccagggctgggcaggggacggacctcacctgaggtatcaactgaggcgttggtcgcctacttcctgcctcgcacttgtcagggttttaggcaaccctagtgtagttctgtccttcccttggatagggaggaaagcggggtacagggagctctggggttgggctgtactcaggtcatccgggagggatggaagaccctggcatggagaatgtctcatcgcacaagcagaccaggagaccgcaggtccctccagggccctgcagagaagctactacagtctcgggcagttcagagggcacagctccagctctcaggggcaagaagctggcaaaatttggggaaagcaaacagaagttagaacaccagggtgtagggatgataagaatacacggtagaacacaggctcccacacagcctgaactgtggcagccttcaaagttaggcttattttaaataaatcagtttaaaaaaagcaaaaacagcttctgaacaaatccattgaaaggaagactgggagccccagcaccaagcccctctccggccactggagttagagtgatgctcggtgagacctcaggtgtggccgagggcagcacccgcactcccctgggacacacgtgccccttcagagtgctgtcacttttcagcttttctagcctttaaggataatcctaaggttggggttacagcttgaggagcggggagttggggatcagaggagacttgagagtggtcactgaaccttcaggagctgaggggagggcagccggccggccctgggcgggagccaggtgcgggccggaggggaggcaggtgtggagccgggcgggagtcaggtgcggggtctaaggacaggtgcggggccgggtgggagccaggtgcaggggtgcggcgggagctgggtgcggggcctaaggacactctgcttggccaggcttcaaggccgaatggctggcagtg

SEQ ID NO: 88307 - DNA, 1067 bp, Homo sapiens
aaggcgttgaagtctggcttaagacttaagacagtgcgtgatgccaccatgtgggagtggggcagaggtgagactgggaccccccagaatggctctgagggtgttgccgggttgagtgaaagtcctggcgattcggcctttgtgtcccgggagccgagcctggaggaaagcgtgaggagagaaggtggcagtaagcaggtgggctcgtgcaggtgccaccgcggtgtggaaggcagccctgatccaggtccatggggcgatgatcccatcccgttattttcacacactctggaaaaggacaccttcccagatgtgtggtgccatttggaatgtgcctttcaactgagaaggtcgccttttggctaaaattcctccaggtgtaacatcgatgatacaaattaagcagacacagcctctttacaaggcagtaactgcaaaccgtagagggttctgaagctgtgcgcccacaccatagacagtgactggtcctggcccttggaaaaacctggaggctctttcccctcttcctcctgtgattggtggaggaacagctccccgagatgtccacgtcctaccttctgagcctgtgaatatgttacattacatggcaaaggggaattaaggttgctgatcagccggccttaaagtagtgagatgatcctggattttcccagggagcccagtgtaatcacagggtccttaagaacagaagagggaagcagaagagccggagggagatgatggccaagagccttggggaagtgcagtgggcgggctttggagggggaggaggggccaccaggcagggaatgtgggtgcctccagaagctggaagaggcatgagaatggagccatggcccgtgtgaggcttctgtcccacaggacggtgcctgctgcctgccgtgtgctggatactaggggcggggacaggtgcagaagtcagtcagatcctgagcttgacctttaaggagcgtgctgtctgtggaggcaggatggcctaaccagactccctgtgaccttcttcctttctggtttccttgtactgcccacccccgaggagatttgcc

SEQ ID NO: 88308 - DNA, 1951 bp, Homo sapiens
ctccttggactgataagggaattttctccctctgactggcacttggtcaaacctgtaacaggccaaccttccccaccccatcccagtccttgctctccctgccctcatccaatttggagccttcctccaggcacacagctcactctcatcttcctgcatgcaaatgattcgccctccccaccatacctgtctcacacccctactgccatccggtctggattctctcatccttggagactggtacctccttgccagtccatgttgcctggtgcctttgcttctccctccgaatggtctttcccttgccctctgtgtaccctaggcttggcacagagcacctgtgaccactcttccatcagcagacacatctctctcccaaacacctttcccccttagtgacccctggaaaagccgtctcttagtgtcccagctccatttcttattttattcttgaggttgtatgccctatggcctttcctaccacattttcaacaaagcagaggtttggaaatgtgaggctcttggtgtcaagtgaatccggctagctctccagtgtaagggcccaaacttgaaacaagtgtcaggtcgtagaaggctcctaaaaggaagcgggtgccgcagcccttcaggatccgctatctcccagctcttcctccctctccctctgaggagctttgctgagaaaggtccctccaggcctggaccacagaccctccctgcagccccaccgcaggcctctcagcaggacagtctggctggagcctgtggaacggcagtggggctcctcccaggtgctcctccctgctggcctcaatgagccctctatcctagcacacgcccctgctgaaaggcacactgaaggagccaaccctctcccctctggacgtggcaagggtttcctgtcggggcagccccaggcatcttcacggccaggactcaggtgaagcatggatttgtccaggcactgtcatgaggccaccgcagcagtgtggggaccaacttctagtgtcactttttcatgtccaaattaacgtgatcacaaaagagaatgacatgtcacaaggtggtagagggaaccctccactcgcagcgggataggacccctggaccctgggacacctcgctggaggggcacatctgaggcttgacgcttctgattgccagaggtctcctttcttccccttaggctataaccatattttcctagcccatggcagcttagtaaatgtgttggtgtaaaagctcttggtactccagaacgttttcactcacccgtcactgtgcacctggtctgcaggacccccctgagctgcagagtacgtgaggagacccagggtgtggtagcagcagttctcctggccctgtgggtgtttttaccctgccacctggatgtggctttcgaggtgtgtgtgcctgtgcaggctcccccaagtacatatggcccgtcctcggagtctcggtactttctggcaaccgtataggtagataggtagatgtataaatgctgtagtgttttctctttcaaaaacagaagatctgagacttggaactattgtccaggtcctgaaatgggtcagtactatcacaaggaggtcatttttctattgtttgttgaatggtaccagggatgccaaggacacacagcattcattcttttcactcagtgcactctgaactatcgagatttcctggaaagctcttatgaaatgccaatatcaagggaattagaaacttttatattaattcttaagaatgttcatgttgattttccttttactttaatcaagatggttaattaggaaaaaatcatcctggcagtagagaagtctgtttggggagacgttctgttttttgttttggaccctgctcgtctttgtcatgcgtgcagtggtcatgtggagcgcctggttcccaggcaggacgctgctccccgcgttcctctgggatggtt

SEQ ID NO: 88309 - DNA, 1061 bp, Homo sapiens
ggtggaatgtcatcttttgtggttcttcagttgcttcaggccatctggatgtatatgtgcaggtcacaggggatatgatggcttagcttgggctcagaggcctgacaataatgagtattatgtgagacatggttgggactcagtttagcatgacaagaaacattaatgaattcaagaaaggtttgtctcctctccaaaatcaaaaaccaaaagtgcataacagtgtttagcacatttctatttagttaaaggtaatttaagatacgtgtttatgacttgtttggataccatataacatctagtgatcgcctctgggcagggaatacagaacggcaatgggaggcttatttttcattgcgtaccatttatataatttgaattcctcctcttgtgtatcttttactgaacggaaggttttgagagagctgggggaagtagctggtatcaagcaggaaagctgaaggtgcagatgggcagggggctggtgcacccttctgccaagctctcctgccagaggctccacggccaccaggcctttctcagaactttgggatggaggagggcggggccggggaagccttttaacagagtgccctaaaatatctcgggggctagggctacggaggggaaaggagaaatcagagacccttgtttggcaggtttgtcaactgcagattttttgcagggaaacaccccaccgtccccaccccaggacactacagccttagacctccctgatcctggctttggcaactggtcagcagcactctggaggcggctgttttgaagggccaaggagaggggctgcctgagaatgaggatggcagaaaggggcccacggttttccgcctcccaagactacgagggtcgggaggcccatgtaagggggccctcgctcggagaatgagaacttccctccctagtagccttcacccccctcaatgcctcccaccccaaaagatctgctgggcccacgttccagcgcaacgcggtggaagacggccctcatgtgccagtgcggaccctcgcgcccctccagcctgcagccagccggccgctcc

SEQ ID NO: 88310 - DNA, 1097 bp, Homo sapiens
aggcagtgggcattgtgcttgcaccctcttcttcctctcctttttgattcttttcatctgtccagttgttggtgcggcggatgggaggacactccaggcagggaaaggtgaggcctcttagttttgctctgaatgtcccaaccagcatccccattttcgcatctcctgtttgtccagagacagaccctcacaggagggataacaaaacaaaaaaatccagctgcaacatcgaggtgaggggcagctcggagagaacagggcagaggggggaaaaaagaagcaaaaaaagggggaatgctgttatcatcagagctggcttctgcttctctggccaaatccttcccctgctagtgatatggtaagtttccagagcaagctgggctgacgcagagtctagggatggagactgggtcccaaccagggccggctctggagcagcctggatcagggatcaggatgggagggcagcctacgggccttgttcagaaaaaatatttgtgtatgactgagaaaatgtcaggttttcatatcaaggaatgagaggcctgatagagactgaggagtgcttccagccatcctgggctcaccactgtactcgtgctgttctctagaaaatggaaatcttcccggcaggggctccttcctaacctttagatcacagagctctcaagactctgaacaaaacagtggaccatcaccttccaaaggtgatgcgcgcgcgcgcacacacacacacacacacacacacacacacacagtttggcattttgttatagggggttcacagattcccccaaacctgtctgagtccccgataatgcacagggcgtctcaggtctgccactgtttggagacctgacccctcagggttggccacagcggatcccggaggccttggggctcatccctctgctaccaagtgactaggagcgctcagccttgctgggcacccccatcctgcggggggcattctcgtccggggctcgcagcccctccgcctctggacggacctccagactcacggaatctgccccacccccactctcagcctggcgggctccccagggggccgggaggaggcggccgctggatttccc

SEQ ID NO: 88311 - DNA, 1115 bp, Homo sapiens
ctgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagcatcctgcctcgtcagtttgctcattaaactgaatccttttcgtcttctcctctccacccaaggcccactcctgcctgggaggccctcagcttcatacctggggacattggtacccagcaggtgcatgctggaccctgagttgcctcgctcctccagggggtgcagcctcccatgggtggggcagcgacagcgtgtctcagctgcagctgaacgtgtgcctgagtcgggcgcctggggcctgggtgggtctggggacttgtgagaggtgggtgggaggcaggggcttgatctcctgagcaggaccgcactgtcccccgggagggagagaaactgtggaggtagcagcttggccatggctctgcagcctggacactattcctttcctagggctgccgtggaaactggggttggggcgtgggtggcataagcctctagcggagggtccttcctgccccttccagctattggtagccccaggcactccttggct

SEQ ID NO: 88312 - DNA, 1100 bp, Homo sapiens
aggaggtggggctgcggggcccgcgtgaaccccgatccgcggggctgagagtccgtggccccggggcccgaggtttcccggcacgggcgcgccgaggggcggggggccggcgcctgtgtccgctccgtgcacagtaagggacagagggtggcagcgcccctccgccccggtccgccccgccgtcctcgcgccactgccgggcagcggcctccggcccccgtgcgtgacccctgcctatctcagaaatacgggtgcaaacccgagtggccgcggggcccagcgggaatcccgacgccccggccagacccctgcttcccacgtcgctggtctatgcggaagatcccggcggcggtgctcatgcctggctcagtggatgccggctggtggaaggggtggccttctgtaggggtgacactagaactgagtctttggggaggaggaagccttcagtaggtggagaatagggagtagggtatccaactggcggggaacagaaagggccaaagcacagagacagaaagggacgaacatgcccctctgggctgggcttccttcctttggggggcacttgcccacccggtaaactccccctcagtaggttgcagggggagaagttaggagcacagacatggcttccggaaacagcagccgtagctttgtttctaaacccaaagcagtgagactgctgagcatttcagacctcatgaagatgggatgaaggctggctgctgggaaagatatttttggacaggaggaatgtggagatggctctttccctcctagtggaggaatgacaggtgacaaaggtgacctggtgtgggattgttctgagaaggtctgggagggggtggctgaagtataataaggacatcaacgaggaagggggctttggaaaaggaaggtggagaggaacaactgcggcatctctgcttgaatccgtccccgacccctgcagttctcagggtctcccaatgtcattctggaggccctgggtcagtgtttggtgatggcagatgctacagaggactctttgcaacaggcctctgaatggcagtggagtgatggcagatgacaactcagtgaacaaagaagtggccttg

SEQ ID NO: 88313 - DNA, 1117 bp, Homo sapiens
ttctttccccaggttcattcagggctcggtggtgcagactccctatgctttctaccactggcagtgcatcgacgtctttgtgtacttcagccaccacaccgtcaccattcccccagtgggctggaccaacactgcccacaggcatggggtctgcgtgctgggtaagagccaaggactcacctctgtgtcagccagactcctcagctcaccagccaggggaccccgtgattaggaggcacgggctttgcctgcttctcagtgcccagagcccctcgctgggggccgccttggtcggctaggacaggcagctgcaggctttttctggaaaggaccagatagtattttcatgatttcagaccactgggtcactgtggtgattattggagtgatggcaggtacacaaataggcagggccgtgttccagtaaaattgcattttacaaacacaggtagtagtgggcatcggcccaagggccacggtttgccgattcctgggtcagaacaatgcttctcagctttagcctcaatcccgatcgttgatgggcttccgtcaccaggactgctggtctgcactggcagagtgtctgattcacgggatatatggggatttgaatgtctaccaagtggtcaggtgatactgaagctgctggttcgagaacctcgctttgaaaactgtgggtggagggaaagtgattcccgtggctgaccttgtttctctcctatcctcacagggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtgtgagtgcccagccctcacccacctccccgccccttgctgtgttgccgcccacctccacctctttcctgccttggcctcacctcgccccacgcctgggctgcaggttgcagcagtaagagccacttctcgcctcccaggcagtgccaactctgaaatcttagttacacgcagtgagacagaatctcctccgactgtttccagcaagcgtgcttggccggctcccacgtt

SEQ ID NO: 88314 - DNA, 1037 bp, Homo sapiens
cctgagcgacagagcgagactctgtctcaaaaaggcagagttctcttaacatcctgagcctcagcagacaccatggatgctgggcgagggtttcaggtcaccatctgggctgctcgctgcccctggggaacaggccatatcctaggtcctggaggcagctcccagcctgtgagttgcaggtgcctctgagatctaggaggggaaaggctgagattgtgcaggtggagggggtggccctgtccctctgggctctaggaggggaaaggctgaggctgtgtggggtggggtggggtggggtggggtggggtggggtgggcccatccctctgagtactaggaggggaaaggctgagactgcagggttggtgggggtggccccatccttctgggcctgggcctcacagcaggtccttgttgcttctcagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaaggtgggtggtggctttcgtccaagggccagcggcccagtgcctcccctgggacctcatttcctcatggaccttccattcccgtctgcacctcaaaggaatgacagcagctgttcttcccagagtggggatcccgtggcactgagaaacaggtgtcctgccccggccaagctatgtccccactgaaacccctttcccggctatttctacaatcagataatgtatttttgtgtgggtgttaccagacagaggcgcgtcgttcccccgctgtccggtcctcggcgggcctgggcctcctgtcccagctgcgttccttgatcttccccgtgagggaagcctgcggggacgcacaggggcctgcagcgcctctcactgcggctcaggggcgaggacgggggaggtgcccagggtttggggatcggtaggtgtcatgacgagggagcattttct

SEQ ID NO: 88315 - DNA, 1079 bp, Homo sapiens
ggggtgatgcccagcagcctccaggtgcatctaggagggaggggttggacagcttccccctcccgtttctgagctgccctgagagccccaacccacgtcactggcgtccaggagcctgtctggactctggtcctgatgtgcccagcgtctccctctgtctcttcagtcgttggagctgatccgaaagcatggcttctccgtggctttgtttgcccccggctgggtgtatgagtgtctggagaagaaggatttcttccagaaccaggacaagtgagtcctgctgtcctgggtgcttagtgcaggctgatgggagggaggggtttctggtgtctctgataggacacgtttgtgctctttagtgacccttcctatgggggggtggttaagggaggatgacaggggaggaagccagcaccctggctgcttccgggcagggaccaaacccagcggccgcttcctgcagactcgtgtttgcagcgtatctgtagacggggaggctgcagtcctcctggaagtcctgtcttggagggtgcaggagagcctcgagtttccaccagcaagtttgagggacactgagaggctccctcccttcctccggaccgagctgttgcccccatgtctctggcaggttctggggccgactggagcgttatctgcccacacatagcatctgctccttgcctttcgtcacgtccttctgcctgggcatgggtgcacggagggtctgctatggccaggtgggtgggtgtcttccctccgtgtctgtcctctggcctcagctgggacaggtgggaggagcctgggacttgccagcaggcacggtggtggtcttacccttccctgccgctccgggcacccctgctctgttggcctctgctgagtgcccctgttctgcccttttcttcaggaagaggcggtagggccctggtaccacctgagcgcccaggagatccagcccttgtttggagaacacaggctgggaggggatggccggggctgggtgaggacgcactgctgcctggaggatgcctggcacggaggcagctccctgctcgtccggggtgtgatcccaccggagg

SEQ ID NO: 88316 - DNA, 1050 bp, Homo sapiens
gggtctcaaagcagacctttaccctttagtgtgaattaggggtggggcagtcatgccttgggtaccctatccccactgtaaccctttccaagtggccatgtcctagcagggtgaggaggggacactggtgatgtgcctacccccatgcccagctggcagctggagttagtgtcctggcagtaaaagctccccaaggcagaagggagacacgggcctccaggagaggctgggagagctgtccctgtccccacaccacaccaaggaccctcttggtgatgccttgggcaccctatccccaccatcgccttctccaagtggccaagtcccagctgctccatggccaggggtgggagggggtccccggtctcctttcccaagctgggggccgagggcagagcacaggcatgagcgtctcaggagtggagcgggcagctgggccagcagtcttaacccgcactttcctgtctgccccactccctctttgtctctgtctctgcagcaattcggaaaaattttagacgtggagatcatttttaacgagcggggctccaaggtgggtgccgcacggagctgccgccttacagcgccggctgtaggtcccgccaggctaacgtgtgaaatgtgcgtttccttcctggagagcttcgcgcccgaggacccctgagcgacacgggtgcttgtattccccgctcttccgcccccacccgccccgcccccaccccagctgtctgtgttgttgctgccgctgccgctttttctttctgagccaccaggacctcttgcctgcaccccagagccctgggccccaggtccgggccccacccccactgaacacttaccccaggggaccactggccttgaagcttgagggaggggctacagagagggcaggctggggagggtgtccggcggagacaagccctactccccttccaggaaggcacgaccctctaccctgggctccgagggtggagatgggtgggctgcccctgcaggtcctgaagcccagcctgggccccctaccccaaggtggggttcagggggcaggcc

SEQ ID NO: 88317 - DNA, 1017 bp, Homo sapiens
tagttccatccatgttgttgaaaatgacaggccctcattttttttttatggctcaatagtactccattgtgtatctgtaccacattttctttacccattcatctgttgatggacacttaggttgcttccaaatcttagctattgtaaacagtgctgcaataaacagcaatgcagatatctcctccatatactgatttcctttcttttgggaacatactcagaggtgggattgctggatcctacggcagctgttttcagttttttgagaaacctccaaactgttctccgtagtggttgttctaatttatattcccgccagcagtgtatgagggttcccttttctccacatcctcgccagtatttgttattgcctgtctttcggatttaagccattttaactggggtgagatgatatctcagtgtagttttgatttgcatttctctgatgatcaatgatggtgagcacctttttatacacctgtgtgccaaattccttaggtggcagctagacgttcaaggaacagcggagacatttgtggctggagtagacaagcaagaggagagaagcaggagcaggggtcgtgcaggaccctggtgggggaggggccgtctcaggactttgggttctactgtgcagaggacagagtgtaggagccagggaggaagtaggaggaccagacaggagatgatggcggcccgaccaaggtgggagcagtgggcggttcagggcggctggaggcggagccagtggggtttgctactggactgtttgtggggtttgctactggactgtttgtggtgtgtgggccaaaagagccaagtcaagggtgacccccagattaggactatgtgctggactggggggcaggtgtttcctgagatggggaagacctcagagatgggtttgatgggggcaatgcggaggaggtcagaggtccctttgggggcacgtcaaacccccaaagtgtatcagatgtccaagtggagactgcaaggggcagctgggattctggggag

SEQ ID NO: 88318 - DNA, 1022 bp, Homo sapiens
agtgccatcctttccccccaatcattcccagggagtgagggcgcaggaccgctgcgtgggttcattcagaataaacatcacccgacctcaactacttgtctggttaaattctccagtgaacaggacaatttttcggatgtggctgcagccagcagaccagacctgggcagcaatggatgctgccgcgggtgcacgagctgctgttcagtgccctcctccctccgctggccagtggtgggatactctctagccacccatgctgacccgcgagccagcgtgtctcagacggggttcctggaatcccaccaagtcaacaggggaagcatcaacagcccagggaacagagactaaacgcaaggtgcaaggggtggtgctacgtctgccacagtaattaatcctgattaaaaatgcctgtgattagcagcctcgctaccttagagggaagagagaatgattattaataagaacagtgcctcctaatgaatctcagaacagaccctagaatccccctgcccctcggcggagcctttgggttccacaaccagagggaacgtgctctgccatcaacaactccaagaagcaattgctgggcaccgtgaagccgctcggaaacgccgcatcctccacggaagcttccggtgcctggtgatgtttacctcagcaagggagactatctgtgatttcaccttgattgagcacacacggagagcaaaagcaacggaattcacgacgcgtcccccaggaagaccctgggtcctctcagggccagtccctctcccccggccagccccctcccctccccttacaatacttgaaggcactcacagccctctcccccggagccatttactggcttgcaataggatggaataagattctcttttataggagactgcagtttaataataaagtaattaccgtgacaaaatcccatttttcgagcttggggttttttcctcctatcctctcaaacttggtccactggatcccaggccagggcctcccagagagtcctgctgatg

SEQ ID NO: 88319 - DNA, 1051 bp, Homo sapiens
tggagaaaccctgtctctactaaaaatgcaaaattagccaggcgtggtggtgcatgcctgtaatcccagctactcaggaggctgaggcaggagaattacttgaaccccggaggcggaggttgcagtgagccgagattgcacccttgcactccagcctgggcaacaagagtgaaactccatctcaaaaaaaaaaaaaaaaaaaaaaaagtcatttctctttatggttcacaagtctgtgtcgttgggagttggctgaccctggctggtctcccttatgggtctgtgggttgattcagttgccctgctcctggcttggtctagctggggcagctgtgctctatggatctttcatccccgtcctgggaccagggagccaaccatggcaatgacagaacaagtggaaacatacaaggcttcttctcgcctaggcttggaaatggctcaccatctcttccacctcattctgaacaagtcccacggcaggcccagattcatagagggtagggaaggaggctccacctcttttgcaggaaaaactgcaaaatcgcatggcaaagggcatgaagtaggaaagaatagagagccccattaatgcatactcttttgttggtgtggagggtggccaattctgatgatgatgcggataatggccaccactgtatatcaaatgctaactatgtacctgccaccagagcaagcattctggatacacggtctcatctgtttcttatggtaacccaatgagaaagttattattgccccattttataggtgattaaactgaagttgagaaaggttaagtaacttgcccgaagatagtgacaagggagccaggattttgatccaggattatctgatacccaagcccagacttgtaggtacctcacatttcaggctttgtagtactgacctccaaaccctgcccctgttgtgggccttctcaccccctctcattggggtttctttgtggatgaatgaatggatggtggatgggtgagtgggtagatggatggatggatgaatatatagatggatggaaggttggatgcat

SEQ ID NO: 88320 - DNA, 1146 bp, Homo sapiens
cacccatggtgccagcagggtgcctgctgggtgcccaggcccccagccagcacccacccaggagctgagcctccaggtcttggacttgcagagtgtcaagaatggcatgcccggggtgggtctccttgcccgccacgccaccgccaccaagggtgtcccggccaccaacccagcccctgggaagggcactgggagtggcctcattggggccagcggggccaccatgcccaccgacacaagcaaaagtgagaagctggcttccagagcagtggcgccacccacccctgccagcaagagggactgtgtcaagggcagtgctacccccagtgggcaggagagccgcacagcccccggagaagcccgcaaggcggccacactgccagagatgagcgcaggtgaggagagtagcagctcggactccgaccccgactccgcctcgccgcccagcactggacagaacccgtcagtgtccgttcagaccagccaggactggaagcccacccgcagcctcatcgagcacgtatttgtcaccgacgtcactgccaacctcatcaccgtcacagtgaaggagtctcccaccagcgtgggcttcttcaacctgaggcattactgaagccccggcgccaccagctgcgcggtcttactccccttccctgcctatggtgtcgcttggctaagtgactcccagcccaagccccctcaagagtctgggtcgggggaggaggagtgggtggcctccttgatgggcaggcttggaagggacttctcccgcaccccactctgtcccaggacatagggcagggggcctcactgccttgttggtctccaccttgttcctacctctgcaggcctctttgctctcccctcttgcctcaggaaacccggtggcacctgtggctccaggtgactgtcttgaacagagcgggcttcttcatggctgcgttgttgctgagtttgaactgctcctccctggcctgcgtgactgaatcacagctttggtccctgtcttgcaggggctgaggtgtcaggaggggacttctggcccaccttgccttcagccctggagtgggcagagagtattgtggggaggcatggccagtgggactagtgttccctccatctggccacagcttttgggagatgggg

SEQ ID NO: 88321 - DNA, 1037 bp, Homo sapiens
gcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccgaagacaggactcggacctggtgcagtgtggtgtgaccagccctagctcagctgaggccacgggcaaactggctgtggacaccttcccggccagggtgataaagcacagggctgccttcctggaggccaaaggccagggtgccctagatcccaatggcacccgggtccgacatggctcaggcccccccagctctggggggggcctgtaccgggacatgggggcccaggggggaaggccctccctcatcgccaggatccctgtggccagaatcctgggggacccggaggaagagtcctggagcccctccctgactaacctggagaaggtggtggtcacggacgtgacctcaaactttttgaccgtcaccattaaggaaagtaacacggaccaaggcttttttaaagagaaaagatgaatgctgggtgggtgtgtccaggaggagagcaggggagagagtgagcgtgagcttggcatagtgatttttatttctgggtgggatgtggccttttggctggtcccgtccctgatgtcacccccaccccaccagcccctttcatccctccttcctccccctcagtttttgttggaaagattatctctagagttatattttctattagatgtaaatatgttatttaagaaaaatatctaaatatatatatttcaactcgaagttgttttatttaaaggagagagactctcattgtgc

SEQ ID NO: 88322 - DNA, 1049 bp, Homo sapiens
cccacacctttggggccggctgggcaaaccttgaacccccaatttctgcgtggcctttggctgccctccttctccaaggcgtgactcttactccagagactcaggcgagcacgtgtcccttaccttattttctctcaatcaaactgaaacccattgtgatcccccatagtccagtgcggtctctgttattattacgggtgtctcccttcctccccgtgcccaggacaggccatgagccagagatacaaggggccccaggcaagatgcagggctctctgctcctggctctttatcgtcgtcgggacaccctttgtccaaactcaaggaatcccgggaggtctggctttgccgctttggctgggactcaggtacctgggcatacctgcatctgtgccccctcttcgtcccagtgagacggaccctcagtatcccccccaacatagaacaggaaggtctcaagccagccccctcctccagttcaatcaccctccctcacatccacccagagaagtccagacctgtggccacttccatgccctctccagaccaggagacacctgctgctgacctcgtggaaaacttagattttgacattctgatgcttcggaagtggtggctcctcctccttcacccctccgccacctgtgggcctcctctctgcatctcaagagaacaaccagatctttgggctcctggggtgtgtgccatgcaatttagacgaagtgctttgaaaatatgccattcagtctctgactaggaaaataagtctgacctgataggtccgatgtcatcagctcttcaacatgagacaaaagaggggattttatgttttgagtcattagaatgatataataattttctgaattgacatctggatgttgaaattaggatggtgcaaaaggggtccagggcctcaggctgggcgcagcagccagctcccaatgacgcagaagctgcttcaaaaccccctcaacaaagaggggcacatgcaagtcaccaaagtgggaagccttcaccaaggccacacccaaagtctactgattgtctgt

SEQ ID NO: 88323 - DNA, 1070 bp, Homo sapiens
ggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggagtgcattggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaacagatgcacgctgtacagtgcctctggaaggtgcggtgggacttgctgggtcaaagcacggcaggctctgtgct

SEQ ID NO: 88324 - DNA, 1118 bp, Homo sapiens
acccagggccccgtggtgccggtgatggtgggagatgcaggcagagccctcagtccaggactcggtgagcccccgaggtgcaggccgttgttgctgctgttgctgtctttggccactcccatggggaccctaggctgccaggctgtcccccggcccctcctcaccccccgtcctctgtctgcaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctg

SEQ ID NO: 88325 - DNA, 1047 bp, Homo sapiens
gacagggtttcaccatgttggccaggctagtgtcgaactcctgacctcaggtgatctgcccacctcagcctcccaaagtgctgggattgtaggcgtgggccaccgcgcccggccaggccattaccttttgcaaagcaagggtctgtgtgtctggaagctaagcttgggctctgagatggtggcacagctgccttccactgaggtgaaggcaagcgagggaaggcagggtccacggcccagggttctgcaggctgggcagtgtgccgcggtgagggtcatccccacccactgctgtctccaccgcctcccaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactggtgaggctcagggggatgggtgcgtccaagggcatgtgagggcccgtgttgcctctcccgttgtagccggggttgccgtggtgatgcgtggcttggctgctgtaggtcagtgggcagtgggaacgccaggataggacttgcccgtgggatatgggcggcttagcctatctcggcctccggggatggccctctgactccctgcaggtccagaggccgcgttgtgtgggccgctctggtggccttccacccctgcacgtgacaacctggcccaagctccctggctggcaaggaagacgtggcaccatcacacccagccccctctgagccttagaaaatgggtcctcaggtgtgtctaagctgctccctgcaggagtcaacacagccagggcttctgagtgcagacaggaagaggaggggctcctgaaaccccctgaggtctctggggcagtcctcacaccccacccctcccctggggtgccctgctgacacctctcccgtcaaggcctcctcaaaaggaccagccctatgtagaccaggaagcactgaatg

SEQ ID NO: 88326 - DNA, 1058 bp, Homo sapiens
gctggggctgggagcagggcctggaggggtgaaggcatccggagactgtgtcccacttgggatctgctaacccgggactgggctcagctctctctccaggaggctgggactgggtgaagcccctgggctgtgctcagctcccctccagaacgctgggccagggccaaggcctcattacccactgggctgcaacttgctctccttcctgggacgctggagactgtgaggctgagttaatatcaaggagagccttggatacacgccacccatccgccgcatccggggagggtctgcagccggcagcagccgcccagctcccgtccagggaacgggggttgggaggaagggtggcttcctgcagtgtgtgcgccacacgatgcctctgggtgccacccgctgaccccggctgggtgctcggctccacacaggctctccatgactcccgaggagcacagagcgttctggcgtaatgtgcagttcactgtggacaaagacgtggtccggacagatcggaacaaccagttcttccggggggaagacaatcccaatgtggagagcatgaggtactccctccccagccagctcctttcccatctgcaagtctgcaagcctcacctgaccgctctgggaagtggatgagcccccagcgagtttctgcaggggctctcttccaggttcatacatcaaagccccagaagtgaaggatacgctactcatgagctacgtcagttggcatctcagagccatggcatcccagggaagccacccaggtccctgcccacagagcccctctatcccctgggcaccaccaagcctgtccttgcttggctcacactaaccatggaccagcttccccatgcaccccctccatctccccgtgggtggtcccgtagtcatacagccacacagagccagaggctggcatctgtgacattctgctacagcctagcaaataattgcacaaaattagcagcccacagaaatgtccctgccagcccaccccttgtcacaggcagtccacccttcagaaaatcagagccatgttcccccttaacccc

SEQ ID NO: 88327 - DNA, 1055 bp, Homo sapiens
cagtggaaatactgcaccgagatgcagctcaaagaccaggtagcccagcagacggccccagaatgcccagcggttgacactccccaccccccacgggccccatctccctcctgggtcctgtgtctggggtccccgggccccgggggcttacggggtgtgacccacggtagtttttggccgtcagagcagcaactttgggtttgaaacctttgcccagggctttcggtaaagtcagtgccctgcacttgaaaaatcatgttttgacaagacttcctgccatattttgctcaatctacgtacaaatgtaataagagctctttaattatctgtttaaggtactgtatgtgcttattagaaatggggccgattttaaaattcccttccttcccgcagagcctcctgctggcttcccttattacagtagcatggctttttttccccctacattgaacaacctttgatttttgaattaaatgtcagctgcagttttgccctggattcgtgactgctcgcggaggcaatctgacaggctggctccctgctcgcagaacagcgatccctttgtatgtggccaatcacatgtaattcattgcaggccctcccggcagagggaagttaggccgaacgaggcattcattccgtttttgcggctggggttggagagagtggggggcggcggcacagtgggccggggaggagagagccgcagagggaaaccgattttaagatgaaggtattttcattttaattgcgcctaattacactcgccatttaggggtttgtatgcaggggacggcccttgccctcctttcagaagagagagaggcttttattcctgggaaaagcactgctggcctctgaagccgcgcggctgagatcctgacctttgcccagttttcctcccgtccagcaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtgg

SEQ ID NO: 88328 - DNA, 1034 bp, Homo sapiens
ggtgcctcacacctgtaatgccagcactttgggaggccgaagtgggtggatcacctgaggccaggagtttgagaccagcctggccaacatggtgaaaccccatctctactaaaaatacacaaattagccgggcttggtggtgcacgcctgtaatcccagctactcaggaggctgaggcaggagaatgccttgaacccgagaggtggaggttgcagtgagccgagatagcgccactgcactccagcctgggcaatggagacagactccatctcaaaaaaaaataaaaaataaaaatacagggagtgtatattaatgtaaaattatttacaatatgagatcacttccattcccacactgggaggaacgtaaaactcaacaatgcaagagcaaactgcatctctgtttccagagggtggcgctgtttttgcaccgggctgactctccgtttccagggtggcgctgtttttgcactgggactcgtacaaggactggtgctttctctgatgtgcttagcttatttcaggcatgcatttcccctgggctctctgctagctcttcacctttctgcaggcttcactgaggacccccaggtccacctctctagagtggccgtgcccagcccctccacctcccaccctgtgctcattcccttagagcaccccatgacccgtttaccgtttgctgcctgacttcccaccacaatgaagctctacacaggtggcaaccttgtctcgttgtctgcaggttgagagggtgggggacacccagaactttttattgcagaacaaatattttctgaggccatgctttgtacaagaccctttggtgggagatgtacaagataaatcagacgggagagagcgggtgcatagtgaccttttattcacatagcataaaagtcacccttttaaagtgtacaatgcagtggcagttagtacattcatgaagctgtgtaatcacaacctgattccagaacattttcatccccccaaaaagaaacctcatactctagcagtcacagcccagcccttcct

SEQ ID NO: 88329 - DNA, 1045 bp, Homo sapiens
gacaccagccgttctgaagagcggagggccgcgccccttatgccgcctggcagaagagtttcgttgggaaaaatggtttttcataacctttctgctttcttatttaaattaagctttgccgggagagtttggtagtagcagagggcccctgatttggtcccctttgacctccacagccttgattggcagtttgttgtgggcattgaagttgtggctgcgaggtgggagccagcagaacaaatactctaggacagctgggcatccccgaggacccagccgaggggggagtgtgcgcaattagagaggtcttcacacagaaagttaattagctactaaatggcatttagcacagtttatgagaattgcatgtttgaaaagcaaatggagatcaatgcggaatggctgccaccggatggggacccttggacccagcaccagtctcagggcctgggatgccccccaccccgagcgtgagtgccaggccagtgcccgctgagactggactgggagatgctcctcgaggacctgcctggccttggggggcagtcctgcttcgcacccacagccgagcttccctgtccaaaaaaagtgagtaaacacgtcttcagtttcggggaactgtgtctgccgtggcctggatagtgactcccttccccgcaaattcatggccactcagaacctcagaatgtgactttatttggaaatagggtctttgctgatgggatcaagggaaggatccagttgaggtcttcctggattagggtggccctaaatccaacggatgtctttaaaagacacggacggacacacagacacaggaggggcagggagatggaggcagagatgggagtgatgctgctgcaggcttgggggcttccaggatccaggacgagcacctccagctggaagaggcaggaaagactcttgcctggagccttcagagggggcgcggcccgactagcaccttgactttgacctccagaactgccagacaatacatttctgttgttttcaagcttctggtctgtggtccttcattacagca

SEQ ID NO: 88330 - DNA, 1055 bp, Homo sapiens
ttttgctctgtgactttggagagtgcatcaaaggctcggcggacgcccacttgccgaggagccacggccctggctggtggccaggcaagcacctcccaggtaggcgtcaggggaagcatccaaactagtaaataaaacggcttctggcaggacgtgctatcatccccctctcccttctaaacacacacacgctttcacagagaagaacttagaagtatttcgtttgaatcagaaggaaatattgaatatcgtctcattctcccccacctaattttttttttaaaccacattcagaattgctgggcaacctcatttccccacatttaggattcttccctcgaaatctcatgcaggcgtaaaatccgagagcctcggagggtttttctgagcctctgcatctcccagcaccccgcccccacccagcactcatgtgtttgtctgctttaaaagcttcaggatgggaaattcctcaccagcccgtaagccgctgtttgtaggagcccctaaactctgtggaacccaaatctcccagtactgacttaattcccttttccctgagaaccagctccctgcagcacccagggttctgcccgcagagggaggctgtggctgggagtggaaaatgcccagccaggggctaccttcatggggacattccctacccccatccccaccttcattcggaaagagtcatgactcctggtcaccaggcaaacttctgtacctgcttattctggtttaaaaataggtcaggcatgatgactcatgcctgtaatcctagcactttgggaggccgaggcaggaggagcgcttgagcccaggagttcaagatcagcctggacaacatagcgagaccccatctctataaaaaataaaaaatttagctgggcgtgatggcgtgcacctgtggtcccagctactcgggaggctgaagtgggaggatcgcttgagcccaagaggtggaagcggaggttgcagtgagctgtgatgtcaccacagcactccagcctgggtgacagagcaagacccagtctgaaaaaaaagtaaaaaaaaaa

SEQ ID NO: 88331 - DNA, 1011 bp, Homo sapiens
ttacattttgttcactggttcccaaaatgaggtgcaggctctgcagagaaagcaggctttccccgaggggctctggagcagaaagagctgtctcaaggtaggtgctggggctggggtgatgtgagagcagagttggaagtgggaatgttctggaaggagggagagggctagtggcagatatgtggtcaccggaggaggagccctgcgatatatatcaggcagggacagggagaggagaggcgacctgggaccccgaaaaccgggtgggtggtcgctgtggcctctcctgggagcctcggactggcggttagggcagactccagtagattgtaaaggcatcaggatctgtcttgcttctgtaaatatttaaacactgggaggattatttttggtagctacggtctctctccgagcctggcgggctgccgggacgggtgtcaagtgacatcgggtgcaaggataccccaccccctggccccaccggccccaggctccgtgtgttcacctttccaacggccacagtttgatgtgggtcacggtttccccttctaggagacgcagagagatggtctcgggcgcgaccagcagggattcctcgtccacacagtttcctgacagcggttgaaagggacgggtctacgcaggccaagaacagcagcggagtgtggggtcaggggcccagcggggggcaccccggggaggggccgcctccgccagacccaccccgggtgaaaggacgcattgtgtgcccgcagcatgaggggagcctgcagagaggcgtctttgtagggtccacgagggggaaagcgcttcccggcaggcggagcacacaagccagccggtggccacggccgggacaggcttgtacgcaggacattgaggtccggcgaggatgggggggccaccaggcccccggccctttgcagagtgttgctcgttttctcccaccccagaattgggcttggccaacacggcccccccaaccatccccccacccccgccagctgcccg

SEQ ID NO: 88332 - DNA, 1084 bp, Homo sapiens
gacaggttgctggggccccggcaaagacactatagaaatgggcttccaaagagacaaaagagattgtgttcattttagaaattcgagggtggccaggcctggtggctcaggtctgtaatcccagcactttgagagcccaaggcgggcggatcacctgaggtcaggagttcgagaccagcctggccaacatagtgaaaccccgtctctactaaaaagtactaaaattagccaggcgtggtggtggatgcctgtaattccagctactcgggaggctgaggcaggagaatcacttgaacccaggaagcggaggttgcagtgagccgagatcacgccactgcactccagcctgggcaacagagtgagactccatctcaaaaaaaaaaaaaaaaaaaaaaaaaaagaaatttgggggaaaggcagaagggaaatatttgtgatctttgatccctctggtgttgccgttatcattttggttggttttcttcctggactttcaaagttgggaattgtaattgtctattccaggggttggcaggtgggccagacagcaagtattttctgctttgggggccagatggttttggctgcagcttttcaattctgcccttgtagcatggaagccaccacacaatgtatgttaattggcatggctgtgttccattaattttttttttttttgagacagtgtctcactctctcgcccaggctggagtgcagtggtgtgatcttggctcactgcaacctccacctcctgagttaaagcaattctcctgcctcagcctcccgagtagctgggactacaggtgcccaccaccacacacggctaatttttgtatttttactagagatggggtttcgccgtgttggccgggctggtctcaaattcctgacctcaggtaatccccccgcctcggcctcccagagtgctggggttacaggcgtgagccaccgcgcccagccccattcacgttttattaaggatactgaaagtggaatttcatataattttcatgtgttgtgaaatattctcctctggatttttttcaacatttaaaaatgttcaaaaccatccttcacatgaaac

SEQ ID NO: 88333 - DNA, 1045 bp, Homo sapiens
ggaacccccgcccacccctccgggcccagcgcagcctggcagccgggaagccagcagctcctgaaggtctgttgtttgggtttgtttgtgcttctgtaaccgggagctgagatttatttctttaaaacatcccattgcccgacaccctgcaatctgttctgtgtgtcgttcagactaatctcgtcttgtttctgtagcacttggcaggctctgtgtggcgttcctccctcccccagactcccccctgcccaagccaaggtggccaccaccagctgctccgcctgcacccagagagtggccgatgccaggggtctgagggaagctgttacgggaagggcagctggctggtcagagccccatgaactggcatgtggccatagtcagtctagaaatggccacaggacatagcctcgccccagcagtctcactgtcaggcggagaagccaagcaggcgcccagccgagcactggtcccctccctggctgcccctcagctctgggagcttggaggggctgccaaagaattcgactgggatgccaccgtgcccagccctctggtgtgcaactgtggcatggctgtttggctcacacatgatgtctaggcagagaaggggctggcgggcttggttgggtgaggcctgtaagtgagctttggtcagagacccagctgtgaatccaagctccactcaagacccgcagggggtggccttggacggtgttgaaccactctgtacctcagtttactcctctgtgaagtgggggcattgtgggggttcaggaaggccgtgcgtgtaaagctctgcacagagggctcagtacagggcagatagacagtcatcatcactgtgtacctgactgagttgccagccccgttggacgtgctcgtatcagtgtcctggggctgctgtgacaaaggaccacaaaccgggtgcttgaaacaagagaaatgtattctctcacagtcctggagccagaggtccaaaatcaaggtgtctgcagagccacgctccctctggaaggtctaggggagggtccttcctggtctc

SEQ ID NO: 88334 - DNA, 1833 bp, Homo sapiens
gcatagctggaattcatttcaagctccacagtttccctctagtgtttttgctcagggccaggctgtatctgaggccggactggcactttactaaagggcagtggcctctccgagcagctcgccaaaggtaccacaagggcctcatccacagcctcctggcctctaacgtgccatccccctggctcctcacaggttacctgtgcttgtacatggagaaggatgagatgctgggagccaccctcatcctggcatgggtccccaactctcgcatccagaggcaggacgaggaggccctgcgctacatcacacccgagagctcccccgttcgcaaggcaccccgccctcggggccggcgcacccggagctcaggagcctcccaccagccctccccgacggagctgcggcctaccctgacccccaaagatgaggacatcctggtggtggcccagagtgttccagaccgcatgctcgccagccctgcgccagaggatgaggagaagctggcgcagggcttgggggtggatggtgcccagccagcctcgcagcctgcttgcagcccctccgggatcttgtcgacggtcagtccgcaggatgtcaccgaggaggggcgggagccgcggcccgaggccggggaggaggatggctctttggaactgtcagccgagggcgtgagcagagacagctcctttgactcagactcagacaccttctcctcgcccttctgcctctcgcccatcagcgcggcgctggccgagagccgcggctccgtgtttctggaaagtgacagcaggtgagttcctggttctgggcgtgggctctcgggaggcccccaaggcctgacctgggcaggaagcactcacctgcgtcacctgtgatgccaggtgagcgctggaggcatctgcccgacctgcccgcggctgtggccgtggctgtggcaggagcccctccctgaggcaagggcttcagcagggagtccccactttacaccccactgagaggactgtgaagggtgcgtcggggtgtccacattcttctctctccttgagactcactaggactaaacaggccctaccaggtctgatgggcccatgaccaaggctaagcccccgggagtcctggtcccttctgttcccatcaccggaggggcaggagattttcagtccccaagcgagtgcccaagaggcccgggtggcatcattaggctcacgcacagggctggcccaagcccagatgtgctggtctccagctccccgctctgccctgcagcccactgggcacgtgacctggccccctgtggtccccggaggcttcagcctccctctttctcatagctgtggaggatggatgtagtcccggggcagtgttgaccatattcacccgacttggcagccgctatgcaccctggggagtccagccagagtatctggactccttgctggccacacttgcaggagctagagttgggcccgtgccctgcggtgggttccctgggccttggaacccaaagagaccttcctgagtggggagggttgcatggtgccacgagggccctcatggccttggggtgagtgcccgtgtggtcgcataagcccggagccccagagccagcacagggggcctgcatccgacttccacagccccttcctatgccccggctgtggtccttacgctcattagatttctgggcaaataatggtggtgaccacagacaacagtaagagccgacatcagtcagcgagcaggtcattaactgttgagctcgtggtgtgagccgggcgcatgctggacgtgggtggtctgggtctcgcctgggcgctggacaccgtgggctat

SEQ ID NO: 88335 - DNA, 1055 bp, Homo sapiens
tggtgaccagaggttgggaactaggttggatttcgatgaaatagcctcttgcgaaacagcaaatgcactttacaaataaggagaattgtttttagagagcaaacagtcctgtctaatgtttaatagacatgctccatttctccaaaaagagcccagtctctccagaacaatctgggaggggcgggggggggttgtcctggtgtcccaggtggcgggtgatggaggagccggagttctgcacgtgggggacgaaggtctcacgctgcagggtttcccgctcacgaaatgaccctgagtggtcagaacctgtcttctcctccgtaaagctgcactgttgggacgcacctcgcagagccacagtgaggttctgcctgtcatggtatgggagaaaatgctgtattttgaacacttgtatttcggaatctcctttaaagcttccagcacattcttttgattatcctcagtgctggcaaaacattttcacttaaagagggttttgatttggggaagcagctgagagctgtgtgcagccagctctggcaactggagcgatcacactgagtagagccatttgaaacacagaaggaggtgggctccagccccgctgcggccttgtccagtgtggacaccgcgcaggctacagagcacccaaaacgtggctgagcagaactttgacgtgcttaagtgcaaaatgcacagcagactttggagactttaaggacataaaataggccaggtgcggtggctcccgcctgtaatcctaacactttggaaggctgaggcaggaggatcacttgaggccagaagttcaagaccagcctgggcaaaaaagtgaaacctcatctctacaaaaaataaaaaaattagcgggacctggtggcatgtgcctttagtccaggctatttgggagactgggcaggaggattccttgagcccaggagtttcagaatacagtgagctgtgatcacaccactgcactctagcctgggtgacaacctgtctctaaaaaaaaaaaaagaatgtaaaagatttcattaataattttttcaggctgg

SEQ ID NO: 88336 - DNA, 1093 bp, Homo sapiens
tatcctcctgatgagactgaaggagctaccttccccaagcctgctgcccggggactgggtcctgatcctggctgcctacaagattccatatcgccctttgacccgcaaagccaggggttcccaggaagatgggtagggcccctgcctggctctgggcaggtggaggaagctggggcctcatccaaggcatgccagcagcagacgttctgcagcgggggcaacgcgatccttgtttgcgtgtgtctggctcgtgtttaataaggtgtcgctgtttccctgttctttgttgcttgggctttgagggcaaagcagatgaaccagtttctgccggccatgtgccaggtgaccgggctcagtgcgtgttgctcctgagcagtctggcagtgacatggccatgggaataatcggtggtgggctgcgtcccgtggcccccacaccctgcctgcctctgcctctgcccctgcctgtcactagtgggcatgggctgcgtccctctggtgagtgggaactgccagctccatgggtttccaggaccaggtctgtcctgctgactgctgcatcctggcccctaacccaaggtggccctgaggccggtgcacggcacagagtgagcaagagaagaggctggggtgatacctctctcctagtggctccaggctacctccaggagggttctggaagagacttttgcacctctgttctttttgttttcctgtttgggaactgatgaagccctttaggccaggacaggaaactaagaccttaggtggaggcagcctccacgggcaggtcctggtcatgaacctgtagcccacctgtgtccattctcgctgccctcacagggacgtcggggcccaggcgtgctcctctcctgggttctaggcctcggtcctcatcctactgctaaaagagtagtcactctgcgtggggggttcaccgtcagtgggtgagcaggtcagaggccgccctgcgagttggaaatcagctccttacagtgtcctcggtttggtgtggttggcagaagaatggcccccaaagatgcccatgtcctaatccagggaatttgtaaatatggtatgttacgtggccacgg

SEQ ID NO: 88337 - DNA, 1025 bp, Homo sapiens
ttcagcatttgctgctttgtcctgacaggtgccatttaacatatttataaccgggtgcagtgtctcatgcctgtaatcccagcattttgggaggccgaggcaggcgaatcacctgaggtcaggagttcgagaccagcctggccaacatggtgaaaccccgtctctactaaaaatacaaaaaatagccaggcatggtggcaggtgcctgtaataccagctacttgggaggctcagccaggagactggcttgatcccggaagggggaggttgcagtgagccaagatcgcgccattgcactccagcctgggtgacagagtgagactccatctcaaaaaaacaacaacaaaaagacatttgatttatgtgccttcccctcctaaaaagggtgggaacccctccaggatgcacacacatcttacttttctagatgcctggccatggtacatggagacacccctgggaaaccctccaggaccggatggcgtgtggggctgccgggttgccttacactttttgcgctcctcgttggcggctgcgcaggtcttggtgtagagagcgcgggcggcctgcagctcctcctccttctgcctgcgctcgctcgaggccattgcgtggcggtcgtgactcttctccagcagcttctgcaggtgtaccaggtgctgctgcacctcatagagattcacccccagctcctgccgctgggctcggctctgcttggtagccacaacctggaccaaagagagaaacagggtcaccaggacgcaggcatccgaccagggtgggagactggacggatacacaccagctcttggaggtccagcttcaacttttcgatctgtcggttcaggtagttcttcagggcagcctggaatcttaccatcaggggctagaacaatggaaaaccacaggtggttacctttctggttaccctcctgcccgacccagggctcagcccaggtggccacaggtctccctccggtgggccagagacgacttccgtgtggagtgctccctgcttctgcttg

SEQ ID NO: 88338 - DNA, 1008 bp, Homo sapiens
catctttatgaaaaggtgggtcaggtagagtagggctgccagaggttgcgaatgaaaacaggatgcccagtaaacccgaattgcagataccccaggcatgactttgtttttttgtgtaaggatgcaaaatttgggatgtatttatactagaaaagctgcttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggcgtgcgggttgttctctggagagtaaggtggctgtggggaacatcaataaacccccatctcttctagatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgtgagttctgggctctgtgccagcatgatggggagggcgacgcgcatttctcacacggcagggagggccacacgcgtttgtttctcacacgatgggcagggcgacacatgtttgtttctcacacggcggggagggcgacgggcatttctcacagggcgctccctgggtcttttactcacataggtctaaatcccatgtaaacacgtgttcaggactcaccaagcccctgcttgtcatttaactcaggaaaactctcaggaacgacagcacttggatttgccttaatcttaagagaagttgccttcggaaatgcgtttttctttttttgctcattcatttactcagtgtccacgcactgaccctccgtgccgggtggtttggatcctgctcccggggacagacacacagtgaggggaagccataagcaagtccatgcagacacagcgtcagggagtggtcat

SEQ ID NO: 88339 - DNA, 1016 bp, Homo sapiens
gggaggactttggccacaagctcctaggcctggaaaggttctgttcagcccctgcccagccttgcttggggtcatgggacaggcatgtgtgccagttccggtaccagccagttcctggaggtcagccccttgggggcccctcaggggtggtgtgggcccagccaggcggtgcgcctcttctgatatgccctgagagttgatcacgctggtgccagggtgccaagggctgcagggctcggcacggccgcctgtcccagggtcagtgtgctgcagggctggccaggccactccgccctcccagggcaccagggcccgggggtgctctctgggtgctctcaggctcgtgtggccccttgggtgtgagcaagcctggctggcctctgtcccgcaggctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacggtacagcggcgggcggcgggcgggggcactgagctggggagcgcaggtgctgaagcgccgtctcctgcatgtcccagcccggtgcgaacctctacgggtctcaccctttctacctggcgctggaggacggcgggtcggcacacggggtgttcctgctaaacagcaatgccatgggtaagctgcccgccgcccagcgcccgggccggggtctcctccgtgctgcctgccctggagactggaggtccgcatgaggggccctgggcacggtgctgggccttgtgttttctgggaaatgagtcctatgggctgatgcctctcccaactctggccttctgtgctcctaaggagggttctggggccctgcctggaggtgggctggcaccacatatctttccgtcccatgccaggttcctcctgagtcaggcttagcacggcttccccaggccactctgagctcct

SEQ ID NO: 88340 - DNA, 1340 bp, Homo sapiens
ggctccgtgtgccttctggccgtgcctctccttctggccggctctgaatccctggaaaggacggcgtgagtgagggcagcttccagccctcatgctggcaccacagagcggagacttcttcccatcagctcccatagaaaagtcccaaagcaggactcttgagtcacccagcacaaagaggcccttccctgagccagtcccacagccagaaggatgcagtttgggggctggtccagcccgagtctggtgtccggcacgatggccagaggaggaggtgggaggcagggcgagctgaaaagatccaacagttcctgcccggaagatccacttcagcagaggaagcacagatgagatgtggggctgtgctgatgctgcctgtttccatccctgccttctgcaggcagcaaacagtagtagcccttaagagcaggagtggaaacacagacttttttctttctcacatttttttaattataaaagaaaagtgattactgtagaacacttgggaaactctagaggtttaaagaaaaggtaaaggtaaagcttccattccggcgcgcccctcatcagccagctggtcctgactcgcccggccctggctcctctccaggcaggcgtgtgcaggcatgtgcaggtacacaggcaggcatgctgtacacacgcatgatgtcatccccagcctcatcctctcactgtctcagttttccccgtggctggcgccagggctctgggccaccctcaccttgacaggtttccctcttcccaggatcctgccatcagcagctcgggccctgccgggagctacaggccctacgacgagggtctgcggaggggggttttcatcaccaacgagaccggccagccgctgattgggaaggtagggcgagggtccaggggacgggggttagaaagcagaggcctccagccagggggagccggcagctgctcaggaagacggtgggatttgaggagccatcacgcccagtgggacagctgagaggaatgggccacagtggcccgtgacgatggtggctcctacaaggaatggccccgtgagttcttccatcagcaggcctttgacttcatgggcagctgggcctggcccaggcacaagccctgcagaccctcagtgaggccttagggtcctccttgtcctcccagccccccaggggcctccaggcagggcccccgctgagggagcagctagggagggtctggtgcggatgtgaggctgcctggcagggcttgcacggggccgtctccgctgcccttctccctgacgctctctggttctgcagcccagcccctgggtggacgtgttgggggtgacccctcgtttt

SEQ ID NO: 88341 - DNA, 1075 bp, Homo sapiens
gggcctctatgggaggcttgccggggccccccacccacttagcaggtggggctctgggtcacttggcctgagctggctctgctgcagcagcctgaggaccagcctgactctgccctcccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctggtagggtgggggtggcggcatggcaggtgggcgatcccacccacccaagactctcccctgggaatcccacccctgctggagaagcaccccatgctgggtggctgagaagtgcagctctcccgaggcggggactccaggggaccgcggccccagcacccaagtgcttcctttgcccccgcctgccctgcagccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagtgagtgacctaggcaggggcggtggcccatgtgtgccctgggggaggggcacgtaactcccaggcagccctgtcctgctgtgggctgtgttccccaggacccagcaggttgccgctgagtgagacaacatttgggcctggcttaagggggaagggcagcaagaaaacccagtaatatcccccagacaggccgtagtacacacgaggagttcctaacaacagccctgcacatcagtgtgttgagggaggattcccagagagtgaggtgattagttaactatttgcagaagtcaatttatttttcttgcataccatagaaacataagttccagataaattaaatagttaatgtcaaaaatcaagctgtggaggccaggcacggtggctaacgcctgtaatcccagaactttgggaggctgaggcgagtggatcacctgaggtcaagagttcgaggccagcctgg

SEQ ID NO: 88342 - DNA, 1048 bp, Homo sapiens
gtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaatcagcttctgcgggtctctctgggattcagggcagggaggatgtatccaggggccctggaacagaggcagctcctttgtcctcagcaggcccccagacattcccacagtgggtgtgcgccgtcctctgtctcaagccggcatccatcacgtcatgttcccatgtcacgaggcctgacatcacctcatgtcctgtccccatctcacctcacatcccgtcacctcatgtccccgcatcacctaaagccccatgtcacctttgtgtcccatacccccatctcacatgcctacctcatgtccccatgtcaccttcacgtcccatctcacctcacctcccctccccaccccacctcacctcccctcccctcctcccctcccctcctcacctgacctcccctccccacgtcacctcccttcccctccccacctcacctcccctccccacctcccctcccctcccctccccaccccacctcacctcccctcccc

SEQ ID NO: 88343 - DNA, 1018 bp, Homo sapiens
acgaggtcaggagataacgactctctgaatacacatatagggtgcacacagcacggtgtgctaacacggtgaaaccccatctctactaaaaatacaaaaacaaaattagcctggtgtggtggcgggcgcctgtagtcccagctactcaggaagctgaggcgggagaatggcgtgaaccctggaggcggagcttgcagtgagctaagattgcgctgctgccccccagcatgggccacagagtgagactccgtctcaaaaaaaaaaaaaaaaaagcaaaattaacttgtttttgtcagagaaaagagcaggagaattttgtggtttcgagataataatggcataaataataatcggtgatcatctcggaggagaaacagtctttctttttggaaaacgtggatgtttctctctcccaccctggacgtgaacctgtgctttgtttcaggggctgcttgctctcggtgactacatgaatgtccagtgccatgcctgcattggaggcaccaatgttggcgaggacatcaggaagctggattacggacagcatgttgtcgcgggcactccagggcgtgtttttggtaagcacttttgtcgctaaaaatggtgctgccggtagtatttgtaagaagtgcttaaatggtacaggacagctttcgatttggtaggccgcacggtagacttttgcacctgggtcacttgcaggaggtagagggaaggtctctggaaccctgagaccagtggaatgatgagctctttcttgggagcctcaggtgtgattatttcaaaatctcatagatgtgatttgtcgtaagtatttcaaaatctcatgttatagatatgattcgtcgcagaagcctaaggacacgtgctatcaaaatgttggttttggatgaagctgatgaaatgttgaataaaggtatgagcaacaaaagaattactcttctactgacataattcttagttcttaaattttcacagtgtaaaattgaaacagccagtgactgttctgaatgtgaat

SEQ ID NO: 88344 - DNA, 1033 bp, Homo sapiens
taggtctcagtccggcacaggaaaaacagccaccttcagtatctcagtcctccagtgtttggatattcaggtaatttgccattcttaaaacaaactgttatgtaattctaggaaatacttgctttttcttctgtaactacagtgttcaaaaagtacaatttaaaattttctagtatgtattgactcagcaaatttttacacagagtcttagttgtacactaatatatgcactaatattctgtcatgattttctatttaactagaggaagctcttgtctgcagacgaggatgctgacacattaagttattgttggatttgcaatttaaatgacaatatttgctaacctgtaagagatgagaagtatgattaatatgagatagtatttctcatatagatctgagtgtgaattactacaatccactttgataatactgcggattctctattttctgataaattatttcaccaggttcgtgaaactcaagctttgatcttggctcccacaagagagttggctgtgcagatccagaaggtgagatggctaaagatagcggtgtccgattaacaagtactgcttttgtgatttagttgtgaaacaccgacttatttatttaatccaatcctgttttctgatacctcaaaattttcttcctgattaacattttgccattaatcattatataaattgctggtttgtattaagtcatttttggtgtggcttgtgtgctctcggtagttttttacagccttagaaatgtagattttttgcgaaaaatcaattttaataaaaataaattaggtcgaggtgggtggatcacctgaggtcaggagtttgagaccagcctggtcaacatagtgaaaccctgtctctactaaaaatacaaaaaattagctgggcgtggtggcaggcgcctgtaatcccagctacttgggtggctgagcaggagaatcacttgaacccgggaggcagaggttgcagtgagctgagattgtgccgttgtactctagtctgggcaagaagagtgaaactct

SEQ ID NO: 88345 - DNA, 1090 bp, Homo sapiens
ccccagcctgtttccagggaattcaggtccacacgccgctcaaagaacctcagcgccccagtccgcgaaatcccgcggccggtacgaaacaccgccaactttagaagtaccaccccctccatccctttcgtaaggaactgggtgccccgccctcaacgagatcccgcgggaactgcatatggcgcgagagcagaaacaccttacttttccctgcggcaaacgcccagttccctttcacgtgacgaagagtgccccgtcccccagaggcgtggccgcgtcgcgcgtacgcacgtacgcacgtacgcacgcacgtctctcgctttcgcatacttaaggcgtctgttctcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggtgagcgggcgcgggccgcgggggccagccgggggcgagtcgggggcgagccgggggctgagggccagactggtgactcccgggccggccctgcgctccggaggtcgtggtcagggtcgaggctcgggggccagtgacgtccgacccccacccccacccccgtcctcgccctcacgcctggctgtgtcggcgctttcggtgtgtgtcccccgtgcagagctcggcgctgggtctgtcgggggctgcagccgcttcgaggcacctcagcgtccttcattcagcagataactgatttctacctattagcttttctaggtactggggttttggcggtaaaccggaagggtttgcgcctttacgggttttgaatttcgtttggggggaaagcatactgtcag

SEQ ID NO: 88346 - DNA, 1020 bp, Homo sapiens
actttgtgaggggctcggggtgaccccttcggcacagggcagaggctcgtgtgtcctgcccactgcctggcagagcctccaggtggggtgggcccgggacagcaggaaactcaggttccctttccctccgagctcgcggcccacatctctcttggggcccacatctctctctggccccaaatgatgagccaggagcactgtggccacacccaccacaggggctggagtacacgagctaccaaaaaggagacttcttttccagtccatgggattttagaaggatcctaaatgtcaccgaatcagggcctcttgttataccattcaaggcactgaggcccagagagatgacgtggcggtgagaggtgtcggctcgacaaggcacctcccgctgctgattggattggagaagggagccgcccagagtggcgtaggttcggcccttccgagggcagctcctgtgtgctgagggctctgctgctctgagatgccgcgtcccttccagacctcacgcccaccatcttggattggttctcgatcccgtaccccagctacgccatctttggctcgaagaccatccacctcactggccggtccctcctgccggcgctggaggccgagcccctctgggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggag

SEQ ID NO: 88347 - DNA, 1080 bp, Homo sapiens
cacagcaggtgctcaataagtggtagaacagacaacagatgtcagctccttgttcttaggggttaaactgagcagtgtggaggtctgggaatgagtccttgttaatattctggaagagccaggcgcagtagctcatgcctgtaacctcagcactttgggaggccgaggcaggcagatcacctgaggtcgggagttcgagaccagcctggccaacatggtgaaaccctgtctctactaaaaacacaaaaattagccatgcatggtggcatatgcctttaatcccagctacttgggaggctgaggcaggagaatcacttgaacccaggaggcagaggttgtagtgagccaagatcgtgccactgcactcctgcctgggcaacagagtgagactccatctcaaaaacccaaaacaaaactaaatattccagaagatcccatctggggccacctttgccctcccagttcatcaccaccatcatggtcttcctacaatgcaggagacacagaggggcaggcctgggaccctggaggcccacagctggtgtcttccttcccgcggctggggtcttaccgatggccagcagctcctggttggcatcgatgcggtaattattctgagatgctaaagggaaccaacggtaaagacctggtcagtaatattcaacatcgctcaaaaagtattcacaaaatgtaacacagattatgaatttctacacacggcaataagttttgtaaatctaagaatacacatctaaaatattcacatatatgtgcgtgtaaacatgtgcttgaatgtatcacagagtggaaagaggtacagtaccatgtaatcaggccaggtatggtggctcacagctataatcgcagcacttttagaggccaaggcaggaggatcgcttgagcccaggagttcgagaccagcctgggcaacatggcaaaatctcatctctacaaaaaatacaaaaattagccaagcatggtggtgtgtgcctatagtcccagatattcaggacgctgaggcgggaggatggtttgagcctaggaggttgaggctgcagtgagatgagatcgtgccaccgc

SEQ ID NO: 88348 - DNA, 1090 bp, Homo sapiens
atctgggactataggcacacaccaccatgcttggctaatttttgtattttttgtagagatgagattttgccatgttgcccaggctggtctcgaactcctgggctcaagcgatcctcctgccttggcctctaaaagtgctgcgattatagctgtgagccaccatacctggcctgattacatggtactgtacctctttccactctgtgatacattcaagcacatgtttacacgcacatatatgtgaatattttagatgtgtattcttagatttacaaaacttattgccgtgtgtagaaattcataatctgtgttacattttgtgaatactttttgagcgatgttgaatattactgaccaggtctttaccgttggttccctttagcatctcagaataattaccgcatcgatgccaaccaggagctgctggccatcggtaagaccccagccgcgggaaggaagacaccagctgtgggcctccagggtcccaggcctgcccctctgtgtctcctgcattgtaggaagaccatgatggtggtgatgaactgggagggcaaaggtggccccagatgggatcttctggaatatttagttttgttttgggtttttgagatggagtctcactctgttgcccaggcaggagtgcagtggcacgatcttggctcactacaacctctgcctcctgggttcaagtgattctcctgcctcagcctcccaagtagctgggattaaaggcatatgccaccatgcatggctaatttttgtgtttttagtagagacagggtttcaccatgttggccaggctggtctcgaactcccgacctcaggtgatctgcctgcctcggcctcccaaagtgctgaggttacaggcatgagctactgcgcctggctcttccagaatattaacaaggactcattcccagacctccacactgctcagtttaacccctaagaacaaggagctgacatctgttgtctgttctaccacttattgagcacctgctgtgtacctgaccctgaggtctgtggccttggtctagatccaggaacacctggaatgtcccacctcggggagggagcacctagtgccggg

SEQ ID NO: 88349 - DNA, 1088 bp, Homo sapiens
ggtaacaagagtgaaactccatctcaaaaacaaacaaacaaacaaaaagtcctctgggccaggcgctgtggctcacacctgtaatcccagcactttgggaggccgaggtaggaggatcatttgaggccaggagtttgagaccagcctgggcaacatgacgaaaccccatcaaaaaaataggaaaaaatagctggacgtggtggcgtgcacctgtagctactcaggaggctgaggtgggaggatcacttgagtctgggaggttgaggctgcagtgagccatgatcgtgccactgcactccagcctgagcaatgagcaagaccctgtctcaaaaaacaaaaaattaaaaaaaaaaaaatcttcctctgacagcattcccctggggctgcgtttcttctcaccattcactggtatggaggtgaagccatacctctccgggagactctgagatggcaggtctaccaggctgccgacccgtgtgctacagaggaacatccctgccctggctaaagtctgtctgtctctcaggtccccgttctccgtgtcctgctgtccgctgacctgaaggggttccagtacttctctaccctggaagaagcaggtgggcacagtcagacatcctgtggctttggtgattttgtaaaaatcataaatgcttattgtaaaaaatatgggaaaccagctgggcacagtggctcatgcctgtaatcccagcactttgggaggccgaggcaggtggatcacctgaggtcaggagttcgagaccagcctggccaacatggtaaaacctcatcagtactaaaaatacaaaaattagctgggtgtggtggcatgcacctctagtcccagctattcgggaggctgaagcaggagaatcgcttgaacccaggaggcagaggttgtactgagccgagattgtgccactgcactccagcctgggtgagagagcgagactctgtctcaaaaaaaaaaaaaacaaaaaaaacaggaaaccacctccaccccagtccactttggtgatcactccatacccctcccctaaacacgcatatgtacctgcctgtcaggatgtggatatatgtttgcggtt

SEQ ID NO: 88350 - DNA, 1686 bp, Homo sapiens
gatggcggcttgagggcagtggtcttccaggaactggatcacggtccctccaagggtctctcctgcagttgcgtctgcgcttactgcagtctttccacagccccgtgttgtgggcagagggagtgaggccaggcctggctcctgcctccagcctccccgggctctgcccaacctccgtgtgctgctgctgctgtttcttcctggctggccactcccctcctgcaaggcaggccctggggaggggtgctggcagctgttcctaaggtctgagccctttgctacatcaaggaaagaagcggtagggggcctgcatcttccatgctggtgggaggtggggggtggtcaggggcctgcctcagtgggctcctcctgttccgggctgtgactcggcggtccagagcctcaggattctccgtctatttctgccagagcctgattatgtcatcgaagctgctagagcatccatgaccttggcttattttcaactttcataattagggaaaaacttaatttgaggtttgattattttaaccattagaaatctttgggtaatggccaggcacagtggctcacacctgtaatcacagcactttgggaggccgaggtgggtggatcacctgaggtcaggagttcaagactagctggccaacatggtgaaaccccatctgtactaaaaatatgaaaattacggccgggcacagtagctcacgcctggaatcccagcactttgggaggccgaggcgggtggatcacctgaggtcagttcaagaccagcctggccaacatggtgaaaccccatctgtacaaaaatacaaaaaaaaaaaaattagccgggcatgatggcaggtgcctgtaatcccagctacttgggaggctgaggcaggataatcacctgagctggggaggcggaggttgcaatgggctcagatcatgccattgcactccagcctgggcaacaagagtgaaacttcgtctcaaaaaaaacaaaaacaaaaacaaaacaaaaatagctgggcgtggtggcatgtgcctgtaatcccagctactcaggaggctgaggcaggagaatggcatgaacccgggaaacagaggttgcagtgagctgagattgtgccactgcactccagcctgggtgacagagtgagactccatctcaaaaaaagaaaaaaaaaaaagcctttgaattgcaaataatggaaagcccagctccacctttctaatcccattgaggaagtttattatggacacacctgatgagccccgagcctgtaggtgaggcttggtgcaggcgtctccggccctgtctactctgccttccggacggctcccccactgagcctctcatcagctgtttcccgttactccctcgtgccacacagtggcttcccctgtgatccacctgctactctgtccttcaggggacaagacagcgcctcctctggtgattgattcctctggagagaggaagcgcttcctcaaatctcattggctctgattggctcacaggccaatcccccagtgggtccctatggccaggatgatagacatcagtggttgacaccagcccacgcacaagagctgcccttggggctagagtaaggctgatgttactcaaaccatgcagccgataacagggagagccaagggaccattccccaggatgggccatccagcgctgtcaccagg

SEQ ID NO: 88351 - DNA, 1052 bp, Homo sapiens
ttgtgcagagtccgaagagggagcacagaggagagaggaagagtgaaagcagctgtgtgaagcgtgaatcgcacaggactggagttgaatgaatgtgggtggtggtgtgctattcttgcgacctttttgaaagttcaaaaattttcaaagtataacatgagagataagtcctttcagaataaaaagccggttgtgcagtaggaggaccagtagtggcccctggttgggtctctgattctagaaagccaacctgggctgctgtgaccggccactagcatggctgactgttgatgaaggttggggagagccctggtgttcgcggagtcccgcgctctctgtattgccgtaatgctctgtctttctcctttcatgggagtgtgccgtggcatttagtcgtgagagtgggtgtgacctgtgtgcgggttttgcaggtctggaggcggctggtggaaatccaattccccgcggagcatggctggaaggagtcgttgctgggagacatggaatggaggctcacaaaggtaccaaaagtttgggggcagtcttttcagggcgtgaaggcaagctggagaaccccagaccattagcgacagccaagagatctcagcagtgcctctctgtgggcagggatggggtgaatcacagctccgtgtttctgtttctgatccagcccttatagtctgtccctagaagagcgcttcggagtcttactgagaggacagagaagaacaagggcccaggatctcaccatcatgggggtgcgggatttttcctgaccccttcgttggacttgcgacagggatgctgtgtttacttggcccgccgtgctcaaccccttgtgggagggagcacgtgagtgagtgtggcatctggccagctgctttgggagctggcaggagcaagctccgtgcaggccctgcagcagtgcccagattgaggtgcctgcaacccccgaagctccagagggcatgttacagtgctctcttagctccgccgtctatggacagtagtgtgttatcagctcagtgggtcccttgccttgttgcctaggg

SEQ ID NO: 88352 - DNA, 1050 bp, Homo sapiens
gtagctgggactacaggcgcccgccaccgcgcccagctatatttttgtattttttgtagagacggggtttcaccgtgttagccaggatggtctcgatctcctgacctcgtgatccacccgcctcagcctcccaaagtgctgggatgacaggcgtgagccaccgcgcccggcctatatgtaactgttaaatggatctttaaagggaaaagtcagaaacaaggaaaaatgacctatgtctcataacttacctgtttttgcaagccaggtgctttttctgcagagtgggaaaagagactcttttaaattttagcctttggtctactggtggggggcagggaggacatgctttgcgtgggccaggagaagcttaaaattgggggaaacagtaaaacagcaggaaagtaaaaatgatgaaagaattttcatcccatagagcactggagcgctgcatccgaaagctctgaaaccacccccctttgatttttgcaggaggaacccctctcccagatcactgcctactgcaatagttgctgggacaccaaaggcttagaggacagtgtggccaagaccttcgagaaatgcatcattgaagccgtgagctcagcctgccaggtgaacaatctctcctcctgggaaacggattcgggctcacagctgtgttctgccatgacccagctaagggctatgaagcacccgctgggtctcagctcctccgctaactcagagattgggaagtgggcaccctcctccctcgccaagggcaatggcgctgaaatctagttctctccggattcctcagtgtgctgcacagtccctgctgctcgcaccatcctgcatgtgttccatatggaatcacggccgtgcgcgtgtggcacaagtcacacgggcttgcaggccgttcctcagatggccctgtcatcactgtggctgctggtttgattgattgttaacacttgctcagtaggtgtgcgggaagagactccaaaggttgacagaacatttatggaagcaaaatatgtgaaatggaaaattgtatcaatttatttagct

SEQ ID NO: 88353 - DNA, 1008 bp, Homo sapiens
cataaaatatatgctatattaagggtttattcatttttggtatttttcatgatatgaaagtccaaaaaaaaatgtagaaactggcagccagaaggaaggagggtgactggttatgttggtgtgtgtttgtgtgtgtgtcttcacatctctggtgctggacacttaaggaggcagtatacaaggaaatgaaaattttcgaagaaatgtaaagtgttttactattttgctctttttgtggccttataaaacaagttacagtagatttcagaaatgctatcgagtaggtaatttgcttttgttatttcaaaacaaactaatgaaaaacttctaaatgtccctcttttattaattttcttgtagtctcagaccagtatccttcaggggttctcttactctgatttgcggaaatttggcatcgtcttgtctgctgtgatcactaagtcctggcctaggaccgcggacaacttcaatgacattttaaagcatctgctcacgttggcagatgtcaagcacgtcttcagattgtgtggtatgtttgcgggagtgctgggaacatcagctcaggcaaggtggtgtcttcctgattgggaaaggtgggaggcagaagatttgacatgatgatactgaattgggatgggctgatgtttgacaaaggctgcagtttggacagagagaccctggaaggctcagagtgtcttgcgttgtaaataataactaatgctaacagccactattcattgaatgcttgctgtaccctagcgactgtgctgggtcgcaagggaagtgcccttgaaacaacccttctgaaagtcccctttaaggcccccagttttcagatcaggaaacaaatggagaaggcaatgcgacttacctaaggtctcaaagattataagtagtaaaaactaaaatccagacccaggtatgtcttatttggagatcaatatagaatgtccaagccaacattgatgacctcaacagaaagtgaagtactgtgctgtctgatttccc

SEQ ID NO: 88354 - DNA, 1039 bp, Homo sapiens
ccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttgtaagttatttgctggggactgtgggggtttggaggggcgtcctgcctcagcctcttcaggagccatgggctttgtggctttgaaaaggggggcggatgacttagagcttccgtcaggggctcctgtgtgtgtggtacttgaggcctgaatatcccaagggctttgtttttacctttgttataaatagtaccactgctccttagccagagggagtttccttgggtctgcgtgaagatcaagaactcaggaaagggcaacaatcctcttttcataacgggcatttgtaaagggtcataggctctctctaggttacagaagccaaaaagcaaaacactttgtcggctgcccaactgcatctcccagttccacccaaaagcggtaaatcagttgtttctgttagagttaagaggtgactcttttgcttttttttttttgagatggagtctcgctctgtcgtccaggctggagtgcagtggcgcgatcttggctcactgcaagcttcgcctcccaggttcacgccattctcctgtctcagcctcccaagtagctgggaccacaggtgcccgcaaccacgcccggctaatttttttggtatttttttttttttttagcagagacagggtttcaccgtgttagccaggatggtctcgatctcctgacctcgtgatccacccaccgtggcctcccaaagtgctgggattacaggcgtgagccaccgtgcccggctgagtcttctgcttcttatgtttttaggtagaccgaga

SEQ ID NO: 88355 - DNA, 1626 bp, Homo sapiens
agacggagtttcgctcttgttgcccaggctggagtgcagtggtgcaatctcggctcactgcaacctccacctcctggattcaagcgattttcctgtctcagtctcctgagtagctgggattacaggcgcccgccaccacacccagctacttttttgtatttttagtagagatggggtttcaccgtgttggccaggctggtcttgaactcctgacctcaggtgatccacccatctcagcctcccaaagtgcaggcgtgagcaagtacaggcgtgagccaccgcgcctggccccacagagagatttttctcacttctccattgatgctgtgcgtttcttggcagcctcttcagttctgtggcttagatgtcgttggcagaggagagaggaagaggcagaggaggcaggaggggcacaggtggcagtgcaggtgtgctcgggggtctgggggccaccacctgctggatctcaggctctggctctcttgggagagccgctgctttcagtggtggactctctggtccacactgatgcacatccttcagtgagtaatttatctgaggggaatgatctgagtgtttcatagttaattgtgaacatgttatttacagctgagccttggtttctttttgtttaaatggtaatgttgtgtggattgaaggaaagagcatacacagaagtgcagtacagtgcctgggacattgaaattgctcaggaacggcaagatatcgtttagtgctattaacagacagtacaggctgggcgtggtggctcacacctgtaatctcagcactttgggaggccaagtcgtgtggatcacctgaggtcaggagttggagaccagcctgaccaacatggtgaaacctggtctctactaaaaatacaaaaaattagccaggcgtggtggtgggcgccagtaatcccagctacacgggaggctgaggcaagagaatcacttaaacctggaaggtggaggttgcagtgagccgagatcatgtcacttcactccagcttgggtgacagagtgagactctgtctcaaaaaaaaaaaaaaaaactacaaaagattaggtgttccggactcttactgaaagcagaaagtggacagaaccttaaaaattcatgaaatatccatttcagcttcagtaaggattactgcccaagaccgagtcttgtgctatcgtggaatagtcccacgctgaactcccctcttctcttccccaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactggtgagtcttattctgtctctaatgcagattttgttgaatagagcattgcttagcaacgttagggcagtgactgtggaaatggtggcacacctgtgtggtaggtttgtacacagccgttttcaatgatatttaaaaagcttttcttcataaatggaaattcaccatcttgttacctagaaagcaggat

SEQ ID NO: 88356 - DNA, 1035 bp, Homo sapiens
tacttggggaccacagaaggacactgaggacttgggactccacagccattgcttccagcgtcacccccagagggttctctgcattggggacctggcagaatgatggcgtctggtagagaggcaggcgggcggctgctcattcccctccactcctccacagatgtaagtcaagtgcccccatgtgccagccggggcaccaggcactggaggaaacgtggaacagcgagtacaaagcagcactgagtgacagatcatgttgtcagggtggcacctggtccagctggggcgctgggtgggcgactgcgtcctgagccctggggaagcgtggggagaaggctctgcagcgaggcagaggcgggaggccgaccacaggagggagaagggcaagatcctcgctccaaccgtggcccgtgttctctccttttgtccccatagtgtgactccgccaggaacttggaatggctgaagactgtgaatgagagtcatgggtctgtggaacgctcatccctgaccctggccacggccatcaaccaaagaggcatctatgtgatccaggcgcccaaaggtggccaaaaggtgagcggtccccagccctcggcgcagctgcggcccttctgcaggctgctgccagtccaggtcttctggccccaagaaagtgacttctaacctatgctcttcacagatttccccagacacggttctgcacttgatccttcctgagagccctggcagccacgaggagtcacgagagtactctttagaggaggtgaaggagcttttgaacaagttgatgctgatgtctggcaagaaggatcgtaacaacacggaagtggagaggttttcagaggtgagggcgcatctttgcagtggcgctaagctggtggtgtcatctcgtccgtgagggctgtgtactcccaagaaaacggaaaggatttgacttgggatttgactgataagaagggctctgctcttaggcccatggagagtagagttggcacatttgtagggtgcatggaactctagtccgcggcccca

SEQ ID NO: 88357 - DNA, 1049 bp, Homo sapiens
gcactctgctgggaatatgctgttcaggacgtggatcgccatggcctactgctcccccaagcagggtgtgtccctccaaatggactttggcttggacctggtgacggagcttaaagaaggtggagatgtcactgagctgctggcagccctctgcaggcagatggagcacttccttgacagctggaagagatttgtgacccagaagcgaatggagcacttttacctgaacttctacacggcagagcagctggtttacctgagcactgagctcaggaagcagcccccgagtgatgccgccctaacgatgctatccttcatcaaaagcaactgcaccctgagggatgtcttaagggcctctgtggggtgtgggagtgaggccgccaggtaccgcatgaggagagtcatggaagagctcccgctgatgctcttatcagagttcagcctggtggacaagctgaggatcatcatggagcagtccatgaggtgccttcctgccttcctgcccgactgcctcgacctagagacccttggccactgtctggctcacctggcagggatgggtgggtctcccgtggagcgttgtctcccgagaggtctgcaggtcggccagcccaacctcgtcgtctgtggccactccgaggtgttgccagccgccctggctgtctacatgcaaaccccaagccagcccctgcccacttacgatgaggtgctgctctgcaccccggcaaccacctttgaggaggtggcactgttgctgcgccgctgcctgaccctgggctccctggggcacaaggtctacagcctgctgttcgcagatcagctgagctacgaggtggcacgccaagcggaggagcttttccacaatctgtgcacgcagcagcaccgagaagactaccagctcgtcatggtctgtgatggggactgggagcactgctacctcccctctgccttcagccagcacaaggtcttcgtcaccccccaggcacccctcgaggccatccaagcctacctggcaggtcactaccgggtcccgaagcagaccctgtcgg

SEQ ID NO: 88358 - DNA, 1773 bp, Homo sapiens
acaaaagcatttcttagaaagtcttcttgtaaccatttcattaatgtctctcctttccagcgtacacgtgtaccccagttcagttttcttgacatcttcccaaaagtcacctgcaggcctcccaaagaggtgatagacatggagctgagtgccctgaggagtgacacagagcctgggatggatctgtgggagttctgcagcgaaactttccaaagaccttaccagtatttaagacgattcaatcaaaaccaagacctagacacgtttcagtatcaagaaggctctgtcgaaggcaccccggaggaatgcctccagcatttcctgtttcactgcggggtaataaacccatcctggtcagagcttcggaactttgctcggttcctgaattatcagctcagagattgtgaggcctctctcttctgcaatccgagttttattggcgacacactgaggggcttcaagaagttcgtggtgaccttcatgatctttatggcaagagattttgccacaccatcactccacacctctgaccaaagcccggggaagcacatggtcaccatggatggggttagggaagaagatctagcgcccttctccctccggaagaggtgggagtcggagcctcacccatacgttttcttcaatgacgaccacacaaccatgacattcatcggcttccatctgcagcccaacatcaacggcagtgtcgatgccatcagtcacttgactgggaaggtcatcaagagagacgtcatgaccagggacctgtaccagggcctgctgctccagagggtgcccttcaatgtcgactttgataaactgcccagacacaagaaacttgagaggctctgcctgaccttagggatcccccaggccaccgaccccgacaaaacgtatgagctcacaaccgacaatatgcttaaaatccttgccatcgagatgcggttccggtgtgggatcccggttatcatcatgggagaaactggctgtgggaaaaccaggcttattaaattccttagcgacctgcggcgtggtggtaccaatgctgacaccataaagctggtcaaggtgcacggaggaacaactgcagacatgatctactccagagtcagggaggctgaaaatgtggccttcgccaataaggaccaacatcagttggacaccatcttgttttttgatgaagccaacacaacggaagctataagctgtatcaaagaagtcctgtgtgatcatatggtggatggccagcctctggctgaggactctggcctgcatattatagctgcctgcaatccataccggaagcactctgaggagatgatctgccgtttggagtcagctggtttgggctacagggttagtatggaggagacggccgacaggctgggctccattcctctgaggcagctggtataccgggtccatgctctgcccccgagcctgattcctctggtgtgggactttggacaactgagtgacgttgctgaaaagctctacatccagcagattgtccagagactggttgagtccatcagcctagatgaaaacgggactcgcgtgatcacagaagtcctctgcgcctctcagggtttcatgaggaaaacagaagatgagtgcagctttgtcagcctcagggacgtggagcgctgtgtgaaagttttcaggtggttccacgagcacagcgcgatgctcttagcgcagctgaatgcctttctctccaagtccagcgtcagcaaaaatcacaccgagagagatcccgtcctctggtcgttg

SEQ ID NO: 88359 - DNA, 1112 bp, Homo sapiens
tggttctggtttccccaaggaccaagagtacacccagctctgcagaaacatcaatcgtgtgaagatctgcatggaaacaggcaagatggtgttgcttctcaacctgcagaacctctacgagagcctctacgacgcactcaaccagtactacgtccacctcggcggccagaagtacgtggacctcggtctggggacccaccgcgtcaaatgtcgggttcaccccaacttccgcctgattgtcattgaagagaaagacgtcgtgtacaaacactttcccatccccctcattaaccggctggagaagcactatctggatatcaacacggtgctggagaaatggcagaagagcatcgtggaggagctctgtgcgtgggtggagaagttcatcaatgtcaaagcacatcatttccagaagaggcacaaatacagcccctctgacgtcttcatcggctaccactcggacgcctgcgcgtctgtggtgctgcaggtcatagagaggcagggtccccgggccttgacggaggaacttcaccagaaggtgtctgaggaggccaaatcgatcctgctgaactgcgctacgcccgatgccgtggtccggctgagcgcctactcgctgggcgggttcgcagcggagtggctgtcgcaggagtactttcacagacagaggcacaactcctttgcagatttccttcaggcacacctgcacacggcagacctggagcgccacgccatcttcacagaggtgattgtctttctgcacttgtaccctatcccctgtcacccaagagtcctaaatccctcgtgtcaggattcaagattcttccccaggcagcggttagggatcctgcagggagatgctgagacgctgagctctcctccgcggtaagtgtggggagtaggtccagttaaccaggtgctgagtgcctggctctgtgcagtgcaccatgctggtaacagcaccatacacagtgttcacaccaacaaataaagtaccacgtcccaggactgggccaagggcactagggacgcacagatgaatctgtagcccttgtcctttgttagcattagggagcatggagagaccagcacatgaacagatgccatcaatatca

SEQ ID NO: 88360 - DNA, 1607 bp, Homo sapiens
acgtttcgacttgcactgtgatgggggagtgacctttgggacaggagaattgctgacatctgggggaaggggacagcaccaaccacgaactccatctgaaagcatgagtcgtactataacaggaaatggcatttgtgctgagccctaagggatcatgagaatctcaagtacggaccaagcaggcagagacacgggcctctggggaggagaggaaggcaccctcggggcagggtggggtcgtctctccaatgcctttggccctgtagggcctctcggccccagcgctgccgtgttttgggaaactcctttgggtttggattctgtgccgttgtgtggcaactgcaccgcgctgaacatcgcaggtttctaggatctgtctaaacctggcagcagacttgcaacctttccttgaagtctggcaagtaatttgcatttcttaactctgtagatcaccactttctccaggctgctaacaagtcacgactgtgaaattttagaatcagaggtcacaggcagggctccgaaacccacactcctgtggctgcagcagtttgacaccgagtactcattcctcaaagaagtccggtgaggttccctgccttccctgctgccctctccctccccagccgcagccgtgtggcttctgcgtggcgatggtacccgcgccggttaatgagcgccacagtcacgtgactgtgaaatagatccttgttaaatctctcccagcatccctctcatctccatcatcttctgcaacgcggtgtctggcctaacatcctcctccgagagcaccatcctcggacctcgttaggaggcattccttgggtttcctcccctggactatctgttcttactgaagaaaatcctacctgagtagctgtttctttgtagcctttatgtttcccatcactttggggaattttcttttccatttttttaagacagagaactcacttgaataacttcccttttctttcagaaactgtttaacgaatacagccaaatgtaaaatcctcatttttcagacagattttgaagatggaatccgtagcgcccagctcattgcctcagctaagtatgtttttagtatttttctcagaaactatgtaaaaaacccaaaacgtaggaagtcctagagaattttttccttgaagacagtatagtatcataatcagtatagaaataaaaataacaattcttcccccgcctcattcccccaagtgggattagggaaactgaagagagacaaaaagaaaaggccaataacattacaaaaatagtggaatgggcctgggcaacagagcaagacctcatttctaaaaaaataaaataattagccttccacagtgcacctctagtcccagctgctcagaaggctgaggtgggaggatcgcttgagcctgggaggtcaaggctgcagtgaactgcgatcccaccactgcagtccagcctaggggccagagcaagagcctgtcctccccacaaaaaaggtgaaatgcgagaggtgtaaataatggaacattaacaagctataaaaggatgcctttgaagcctgtgtttgtagacatgttttggtcattattaattttgaattatacaatttgaat

SEQ ID NO: 88361 - DNA, 1865 bp, Homo sapiens
gaggaaactactggagatgtggacaaatatttggttcacagggatgtccttttcagctttgcttcgaaaaataagaaatagtttaattgtccggaaatacaggatgggcaaattaaagtatggccgtatgatgggttattgagcagccattaaaaccatgtttttcaagtatactcagtcatagggaaagttcatgatgtcatgttcagtggcaaaaagcccagacgacacggtgaccttaacgtgggaggagaggcagatagaaaactggacagaagcaaacgggacagaatagcacacatggtttctaatttcctcttttatggttttccaatagttcggatttcccacggggaaaacataccatttttgtaatttaaaaatatattctaaaagcttttttgaatcccagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcctgatggaagcccgttggaaccatgagctggctggatgtgagatggtatggccctcctccgcctgccctgagcaagccttgtggtgcttccaactccactctgggaatggagagcttctggggctgtgttccaagtgggagatttcttcacaaggcacataccttagctgaattcagagatgttaaggacacatctcgctgacgcttctcacatcctagacaatgaaagtttaggtcgcaagcctgggacacaagtatacatgcagctaacagccggggcctctggtgggccggtgggaggggcaccgctcagccacgccctgctgtccgtctccccagaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcaggtgagacccaggagccctcacccactgcttcatctggcgcgcgctcaccaggagcctgccaagtgccaggcatgtccatgagaagacgggcaggtgctcctgccatgggaggggctccgtcctcacccgttcactccgcatttgccgaacccttagtgagtgccaggcgtctcattagggtgctggagacacgagaggcggctgtgcattcagggagcgcactgtgtactggggccgtagaaaggcagacgggctattgtgatgccgtgtgagaaatgctgtggtagaaaggacaccccgggcgggcaggtgcacagagcaggacaggccctcagggccagagtccacttccctaaaggtgaggtgggacttgacaggcgcaggatcatgcagtgagcgggttgtggtggtaccccatgcagaggcatcacagtgggacaccgagtcccagctaagctgagcgtctgagagcgagagctgggggcgggccaggaagtatgtcacatagggcttgcttgtaatcccagccgctgggcctggaccccgggtcccgcatctcttctcccgtctccctcctcgtttcacccttgggttccttggtgggagccgagtgagtgagtgagtggcgccctcttttgacagagcccagtggagtcggattttctccaccgcactcttcgtggagcacgtgctcctaggaaccgagagccgcgtccccgagttacaggggctggtgaccgagcacgtcttcttactagacaagg

SEQ ID NO: 88362 - DNA, 1032 bp, Homo sapiens
acatggtgaaaccctgtctctactaaaaatacaaaaattagccgggcatggtggtgcatgcctgtaatcccagctacttgggaggctgaggcaggagaattgcctgaacccaggaggtgaaggttgcagtgagctgagatcgtgccactgtactccagcctgggcaacagagtgaaacactgtctcaaaaaaaaaaaaaaaaacactggcgtctacattccttgggcctctggtgaggacctttgttaagactttctggcttagttcctctgaatttgttgtctgaaatctgtatgtgtatgtcttggggagagaataatcttgagataccagatatttatgaaagtacgtaagtggcgtctcttatgatagttctctgaggtcaggttttctaccaaatgaaggttaatagagtttatatttctgaatattgtgtttgccaaaaaaggaaaatgaaaaaaaggatgctttcttgagagaaagggtgttgtacctgtgcgcttgggaaacagctggagagaattcgtctggcaaggcagttaaacagtaggggcatatcatctgctctgaggcaaaccaggccctgaggcagcgcaggcagtgcacgtggtcgcagggcagacagacggggtcctttgcatctcccaggcagatggagcacggctgaatcccaaacctagaatccaagaagggcaatcagttctgaagcagagaaactggccagaagaagtgaaaaccacgagaggttcagaattctcgccttcacagatccaaacctaaggtctcacctgctgagggtcttgctggctgtctccttgcattcacagagagtgcgcatcacggcctcaaaaggcccgtgcgtcttcacgtcagagttctctcgaagacactgaagaaaggcagggacaggagtcattagcaggggggagggctgagggcggccaggccgggcgacagagggagcaccacattcagggccaaggctgcgccgtgtgtgtggggtgtggggtgcgaggcctttgtgatcctgtg

SEQ ID NO: 88363 - DNA, 1035 bp, Homo sapiens
gagaactctgacgtgaagacgcacgggccttttgaggccgtgatgcgcactctctgtgaatgcaaggagacagccagcaagaccctcagcaggtgagaccttaggtttggatctgtgaaggcgagaattctgaacctctcgtggttttcacttcttctggccagtttctctgcttcagaactgattgcccttcttggattctaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacaggtacaacaccctttctctcaagaaagcatcctttttttcattttccttttttggcaaacacaatattcagaaatataaactctattaaccttcatttggtagaaaacctgacctcagagaactatcataagagacgccacttacgtactttcataaatatctggtatctcaagattattctctccccaagacatacacatacagatttcagacaacaaattcagaggaactaagccagaaagtcttaacaaaggtcctcaccagaggcccaaggaatgtagacgccagtgtttttttttttttttttgagacagtgtttcactctgttgcccaggctggagtacagtggcacgatctcagctcactgcaaccttcacctcctgggttcaggcaattctcctgcctcagcctcccaagtagctgggattacaggcatgcaccaccatgcccggctaatttttgtatttttagtagagacagggtttcaccatgttggccaggctggtctcgaactcctgacctcaggtgatccacccgccttggcctcccaaagtgcagggattacaggcatgagtgaccacacctggccgacgccactggttttaatgcatcagtatcattcacagtcactgacctgaggatcaaccc

SEQ ID NO: 88364 - DNA, 1579 bp, Homo sapiens
ttgttatttcacaggaagctgttctgttttcttcacagacagcttgagaagtccagcagaaggaaagcagagttccctttcttcctctaggcctcctgctgagcagcagcacccaggtgacaagctcacttatctagagctgtctctgtcttcttgtttttcagcatgcttttcttccaaccatgcctgaagacttgctggctcaagctcggaggtggaagggtctggagcgagtccactggtacagtaagtgttggggtctagatgaccccacactcctttgagcttcaaagggtgtccagatgctatgaagcattgggttcgacttggggtccacgtggtttgtgcctcagggtccaaaaccacctgcattctaccggtggcgtctgcagaagacgaatggcttgaaggagctggcactccgccggctagatgatccaaaccatttcatttctttgtcgtgtggaaaaggccctctgtgatgcacttctgttctctggaatatgccattttgggagaagggagggactgggaaccacatcagagacgcattcaaaggcccaccacaaaacaaagtttttgacacaaagctcttctgaaatatatgaaatatagaaccgggagactgactcatataacccatgacatgtaaattttgctgttgcctgagtaaatattttaaaactagtttttaaagttgttataaaatatgctcatgacaaaaaaaaaaaaatcaaggaaaatagaaaggtctagaatcctgtccaccttgcctccaaaagtacccctggtatgggcctatattctaattgctctttacttgataaaattaataaaattagactcagacatttttcactgacaacatacatttattaagcttcaggcaggtgtcatgtaacttaacaaattagcgtgggatgctctggacagtcattctcatattgtggtcagggccagagagtagagagttagctttcccttttcaatgtgggtcattgggtgaaacctcattagccaatgtgtgtcctgttctcttcacagcttgtcccaacggccatccttgctccgtgggagaggtgagtcttggtatttaagatagggtttgaggggtggcgtgcactcctgggttggaggagggggatcgtgggtcaggagagtgaggctctcggccttccaggagagcacaggctcaccgaggactgcccagggtgctctgagcagggcaatgccaatggcgctaagggtttctagcccagggcttctcagactcagcactgtggacgtggctctgcggcgtgggctgtcctgtgcactgcaggctgtctggcagtatgcctgacctcgagtccctggatgccaggagcacccactcctcccagtgtgacagctaaaaccagacattgacaaaggtcccctaggaaagaaaattgctactggttgggaactgctgctagccattctttctagccactgcagcatggggtcagtgagccttgtcttgatagaatggcaaggtgttgcctggaccacaggctgcattattagccctcagaggaggtgtggtccagatgccaaa

SEQ ID NO: 88365 - DNA, 1046 bp, Homo sapiens
gaggtcaaggctgtagtgagccgtgatggtgccactgcactccagcctggaggacagagcgaggctctgtctcataaaaattgatatatgaaaaagtccaaatgaatataaggaagtcagtttggaagctcttctagtattcttggtattagatcatgaagtgccacaggctagtgtgatagatggagggatggaaaaagtgctgaatacaagaaaggaaggttgaattttatatatttgtctataaagtgtcactctgggaataaagcttaaattgtctcacttatttaaaaaacagttccagtttgcccacgtgcaacattagtgagtacctaccctgttcccatgggttctccacccacccgaaacaagcacacactgggacaatctgagggtgctcacgtctgccggtgataaggaggtgttcatttgcatgatggcatttgtgcataaaatggtactgctccagaagtggttctagtgccctgtcttcaccctagtgtggcaggccgatggaacagagcatctgcattgactgccatgcgccgattggaggcattgaccacaaacctcgggacggctttcatctggtcaagtatgtgggtcaggattctatttcctaagtactcaaactttggggtgttgggctgtttttattccagctgataaagtgatactcaagatagtactaattactccagtacatgtgggcctgtgtcatattgaatagcaatgccaaagtcccagcagtcacacagcagggaggcatctgatctgttgttggatccctgggccctgaaatgcaaagcaggctaccctttaacagctgttaatatgaatacaggtgtcttccttttgggccttgggtgcaccttctgtagaaatatgcatgacataaacagatgatctaattcacgaggacatctatgtctgcaggaccaaaacctgggcatccgtctgtctcagcagatgccatctcacttgccagcaatcttagctttctccattttttattttttgagaaaaatgaaggagacagacatagt

SEQ ID NO: 88366 - DNA, 1050 bp, Homo sapiens
tgggctttggcagtcaggtgaggacacacagaaggcacagctaatggcatctgctggcaggttacccatggaggctgaaggaagaggggctgtgggggtggtggtgccattaactggtagaatcaagacctcaacaatcagctgggtgcagtggctcacgcctataatcccagcactttgggaggcctaggcgggtggatcccttgatcccaagagttcgagaccagccgggcaacgtggtgaagccccatctctaccaaaaaatacacaaattagctgggcatggtggtgcacacttgtgatctcagctatttgggaagctgatgtgagaggatcgcttgagcccagaggtggaggcttggcaccactgccctgcagcctcggtgacagagtgagaccctgtttcaaaaaaagacctcaacagttccttgggggactgaggtgcagatggccctgcaggagagggctcaggagagccctgcggcccggagatacaggtggcgtggtggcctcgggagctgcaggtgtgagggaggagatacagaccagactgcagggtgaggtgctgcttccctctctcgagaaacacaccaagggctgcttgttcacaacagacacaccaaatgagcagcagtggcaggagtcagccctaccttgaggctcagccggggcttgccctggaggaagcggctgacgatctgccgctgaatcttctccagatcgaactcctgcacggtctctctgccctcctccacctggtactggcagttggagagaatcagtggagtcaggtcccgctccacttcataactgatgacatgcagttcagtgacctcggcggcatccacggaatagctgaggggcagaaagacagcgctcagcgtccaggccaggcatgcgggcctagggctctatgttgcagggagcaggctcccatttctcacagttggagcagtggaaaaccctacccaagtatggggcgggtcactggtgggggcggctgaaggagtgagtgtctgttagggaaggggctgaagcttgcttgtgtct

SEQ ID NO: 88367 - DNA, 1114 bp, Homo sapiens
tgatcctgtgcacggggctttctgccttctcagtgtgtttccctccgtgttaggcctactccagccttgccccgggtgtttgctgtgagcccacagtttctgcggcctcccttacagagagcaagcaagacagcaaatcagcaagttttcttgtagagtaaaagcagattgacatcttgtgggtttgattcttaggaatgatgttgatgcatggccatgcctgctgaagcgggaagtccatggaaccgatttgttcctgctctccgcatgcgggtactgataggtagacctgtgtgtctccatggcctccaggaactgcctgcacaccgtgcgcccaagtgtcagctgttagagagttggccccccgcatgtggcttgggcagtgaaggggctcggctctcttaccaggtggtgagatgccagaaacccagcccacagacatccctctcctgcttttcatttcccaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggtgggtctcacaccgaaaaggaaatcagcacagcccctcaccctggtctcctgcttcccgcgagggataggagcattcagggagtgccactctaggcgctcctgaaaaggatggggagacaagaacaactgctcacccagtcagtccagcataaacaggacacaccagggacagtagagacagacacgcgctagaaatgccagcagtctagatagagcccaaatgtgactgagtacatgaggcccctgcaaacagcgtgatgtgagcgggctgtgaggtgccgcaggagggaactggtagataggacagagatggccttcacaaggagggagatcacattagtacagggcagaacgaagagaagaatgcctgtgtggagagcactcaggctccctggtgcacgacatgagtgggggtgtgagacctcagcccccactcaggaattctattcc

SEQ ID NO: 88368 - DNA, 1038 bp, Homo sapiens
ctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctct

SEQ ID NO: 88369 - DNA, 1056 bp, Homo sapiens
tggagacgggacaggggttactgctgatctagtcagggagaggacagaccagctgggctcagagcccccagagaagcaagtgttagcagggaagcctcggcttgcgcagagcctacagggaagcacagactggaaaccagtgaaggctgagcagctccaactgccactggtggggaggagacccaggaccccctcactcagcctgtccactcaccagctactcaggcccttcagggactgcccagctcggtttgagagctgccattgcggggctttgaccccaaagtcccaggcatgcctgtcccacactcgctgacagggccgcggctcctgagcctgaagaactggctgtgacctgtgtgtcctgagtgggcttctgtgggggatggaggcattgccagcagcagctcctggtgggaaactggtctagagaccagctcagcacccagcagcacgtctgtctcccccaggctgacatctgctcccgagagcacatccgcaagtcgctgggactccccgggccacccacaccgaggtgagcacccagggaggctggggcactaaaggggcatctcacagacacctgcatgggctgtttccggtggctcagcctctccttgttgcaatattgtggctcaggacagacagtgcagggccagggaaggcaggggacacaggagaggtcttcaaagagggaggagagtggagtggggtagactcctattctcgtgggaactctccagaaacaccactgcctccacgcaaagccctggaactacggccctgtctggtccaagccctacctcccaatagggctatccccagccttcctcagtccacttagcctgtgaggtaccaggacgtgggctctgcagaaaaggcgtggcctcggagtcagacatgatccagccctgcatagccagctgtggcgtttgcactcttcgagcctcagcttcctcatcgtcgggataggctctgtaattcttgtcccactggttcttgtaagttagagtgacagtgtgcctggcacagtcaccgctaacagtgcaaggcatt

SEQ ID NO: 88370 - DNA, 1040 bp, Homo sapiens
tctgcttttagtgatgcataatctagttcccgtgaagtggtttgtctcctgttgggcacctgggaggaagacgaagggatggagaatcggggacgtctgtccctgttgggcagctttagctggcatggagtgatgtctgggcaggggccccaggcccagctgctgtggttgtccatggctgagggaccagctgcaggaggggcagagtccaggtccccccaggagaagctccagggcagaggtggtcggtgccatcccttttcttgggctcccccagaggagggatggatgtagggctggagagtcagggacagggagacgaaacggcacctaggagtgtccgtgagagtccgtgatcgggcaggcacagaggcactcagatccccggcctagggatgggcccccagaccacctggcgacccctccactctcatcctctgtttttctctgaaggacactctgggtggtgggtttgatgccacccaggcatttgtgggtgagctggcccacttcaacatctgggaccgcaagctgacccccggggaggtgtacaacctggccacctgcagcaccaaggctctgtccggcaatgtcatcgcctgggctgaatcccacatcgagatctacggaggggccaccaagtggaccttcgaggcctgtcgccagatcaactgagcacggcaggccaggctgagcccgcccgccctcgccccctgcttgtgcggcgatgatctgttttgtgcgtctcttctctcccttttccccaggaatgaaccgaggccgtcgcccctgcacacgcacacgcacacagcctggttttgtcctcatgcacacgaagcagcccctgctcccatctgtccctgaggaagccccacttctctgtaggagcccggactctctcaggcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttg

SEQ ID NO: 88371 - DNA, 1027 bp, Homo sapiens
ggattgagggatgggcggatgatggatggtggatggatgggtgggtaggtggatccatggatggatgcacagagggaaaaaggcacattgtatcagactccaaagggagaattaattgcagcataaaatgggagtccaggacctctcttatttcagagttcatcgtgtagatgggaacagtgtttaacccttccctctcccactgccctctgtcagctgcttcccagttcctaaattattggctctgaaagtgggggctgggggagtggggaaaagagtggagatgctgagactttcccatgtgtccagcttccagaggcttccaggacagactgtggcaccatggttagtagccaggagcaggttagggcattatggtacctccccaaacaaagcagggtgctccagcttcaggcagtcaggaccccatctgctcagtgagtgtctggtcagcacccactcaggccaggctgtgtggcaaatacaaaagaagttaaaaaaaaataaagacattccattatttcaatagaaagaattttttaaaaatgtgtcactggaggtacacttgctttacattttttgctttggaagatgtagggaaaaaagtcatgaaatgttttcatttctctgtgattgagcagactcttaaaatattaaactattgcttaataattgattaaaactaatctctgtgggagccaaccacccatttggtaggatctctttaaacttttaggggcttttagctccccctggccgcctaacctttctcttgtctgattcattctgggctcagcagacgtttggtctcttgtggattgatgatgtcaggatgcttctgtcgggccgtgggatggctgatgaggctggattccgaacaaggaacatcctagggacacagtgtctggagaggcagtgagggaagaggaaagaaatgtctgtgaataattgtactgcagcttctaaaactcgggacgggagtcagagaaaacagccctgtggccttcagagccgcttaagttgtctg

SEQ ID NO: 88372 - DNA, 1006 bp, Homo sapiens
gacaacgtgcgatataatctttatacccacatgattagtctactttttaaaatatccaagctgggtgaagtgcagaagtctgatatactatgctaggaaatgagattactggaaaatgttcaactagtaacaaattagtgcaaagttattataaagttacactgaacttcattctagtcttctaaacaatttctcttgaagctagattttcctccttttatgtagtgtcctgttgctgtaacttggaaacaggatttctttaatcgtgagttagggtatgaggcgtcgagacttgggtgcaggttttagggtgtccgcatggtgtttggagtgtggagagtgactcacaagcagctggtaggaaagaaaacagccgaattttgttggatttgtccttcataaaacacccatctatttcctggcctcaaaagcaaaagggtagtactgcttctcctctatgcacacttataatttgtctttttgtaagttattttctccctccaggctgcttttatttgcacatttcagtggtataaaagaggaagttggtgttacaatgtttgattttctctaggcttatgtatatgtttatggaatattattgttttttagtatatgatgttgaacatatataagattacacttctgggctgggcgcggtggctcacgcctgtaatctcagcactttgggaggccaaggcaggcctcccaaaggcaggcggatcacctgaggtcaggagtttgagaccagcccggccaacatggtgaaaccctgtctgtactaaaaatacaaaaattagctgggcttggtggcaggtgcccgtaatcccagctactcgagaagctgaggctggagaatcgcttgaacctgggaggcagaggttgcagtgagccgaaatcgcaccattgcactccagcctaggggacagagtgagactgtgtctcaaaaataaataaataaataaaacttctggtaactctagtcagtcagtcagtagtaaccagt

SEQ ID NO: 88373 - DNA, 1022 bp, Homo sapiens
gtgtcattgtcagacactatttccatgcatgtgtaggaccactgacaggcatcctatgtctacatgtgtaggggatgaaacggttagatgaagaaggctattttgtaaaccattctctagactcagttgcattgctctgtagccatactttgcccaggtcatggaggaagcagagtagatctgttcaactaatacatggactgccaaaggtttatgcggtcttttcagcaagggtaatagcaatccttcataatctacactaccccctctgctttcctcaccttgcgtcctctccacattccaactgtgccctgttccactcccctgagactggtctccatatggccccagtttgttgctaaatctaaagttctcttctctgtccttctctgttcttatttcacctctcagcagcattccacaatgtggaccatggcctcttcataaagctctttcctcacttgcttctgtgtctccacgaaactcggattttcctcttaggtcactagttgttccttctcagactcctttgctacctgacacctaaatgcaggggcaccccaggaattgatcttggaccccattctctgttctgggtgtgcccctccctagcagatctcatcggggcccatgattttaaatagtgtctacatgccagtgatgcttaaacccccaatctttagttctgatctggcctgaaatttctgtctcagatgcctactgcctgctttttcttagttttctccatcaccgcttgccacaaccaccatccactcagttgttcaagctgtaagtttagagtttatccttaattctttcctctccctctctttatcgccccatccaattcattagaacccatcagcgttacttccaaagcatgtcttacattggcctgcttcattttgtctccactgatgcagccccagtccaggcagccaccgtctcttgtctggacactgcatttgtgtcctgactggtctccctatgtccattcttgccctacaaccagtttttcacat

SEQ ID NO: 88374 - DNA, 1079 bp, Homo sapiens
cattgcgatgttggcactgctttggtcctgagtttcaagggaggaaattgaaggcttgagaggtgaagtaatttgcagaaggtcccctgaactcaggcctgactgtctccaaagtggcgtgtcagctgagggaacacagggtatcttgcagtcgtgatttctgatcaacacaagctgtccagcttcccaacatggccaaacaacaggacagacgtggctgctttccgtgggctctgttgcttctgatttatgtgtgtcttttctctttgagttgaagcattagaaggtgtatccaccaagatccagtaaagaagacagaaaacacaccaggtatctcaaccaagcggatttaggtggggaactggttttacaggctttcgaggggctgaaagggccaaaaggaaaccttgactgagacggtaactacaggaggcaggtgctgctgctagggctgggggaacaaatagaagaggctggagttacttaaatctagatggctagagaagggacccagtgagctggggcttgggccactgaggtagggacacagcctggcgcttgctggcaccgctgctaagtgcacagtgcaggggcctgggagcagaaggaagcaggagggcatgggggcggccggcagctgggaagggaaccatcctccctcctcgcctgccagcctccctggagggtgctggacaggtttgaacttcatgtggtagcagtaattttaaggttttgttttgtccccttgcaactctccttacttgctttgtccccttgcaacttataactaccttacacaggtactctgcattggtactctgcacaggtactcggggttattatttacatatgggatctgagcctcctgtgctttgcccgagttagggcctcaaggactttgtggatcccttcctgatcttttatttatttatttgtttatttatttatttatttattttgagatggagtttcgctcttgttgcccaggctggagtgcaatggtgcgatctcggctcaccgcaacctccgcctcccgggttcaagcgattcttctgcctcagccccctgagtagctggga

SEQ ID NO: 88375 - DNA, 1017 bp, Homo sapiens
tcccaaagtgctgggatcataggcgtgagccaccatgcccggcccttcctgatctttatggcaagaggtttttgccacaacaacacttcacacctgactgaagcccagagaagcccacgtcacgatggctggaggcaaggaagaggatctagtcttttctctctcccagaggcgggagccttatgtccacatcactgtgagcctgctggccttgcccaaggactattcttttaaactaagagagtaaattaagatatttccgaggggtctgggatccatgtaaatgaaaaagttcaaccttttttgtaagccatgttcttaaaaatctgcatgtggggtagttaagtgtcacttactagagtcgaggatttcagcgcaggtctttttgaagttctgagatgaacttctcctcctctttatacttctcattccaaggatgctgagtgtgggattattcctgatgcagtgctgcctagggagaggagcctcagcacggcatctatcatgggctgctttgcttctgtatttagaaagagaactagaattttaaaataattgacttacaactacttagaaaagaaagggccaaatactatgtgcaatcatggcttcctcacggtcaggcatgtttcctgatctcatctcctttttcaggagactctttggaaatacatgcatatatttcattattgggaattaccaataatttaaccacttttgtgctattagacatttaggttgcttctgattttttaatattataactcatgttatgatgagacagtgtataaatctttgttcagatttctggttattttctcagtatggtttctggaagtgatagaaataactggataaataataaataacctttaggggaattggcacgttttgcaaaattgctgtttgggaagtttgtcccattttatgtgcccgctcgtggggtctgagggaggctttttcctggctcggctgccagccctgggcattgccatttgaaaatacctttgcaattaa

SEQ ID NO: 88376 - DNA, 1086 bp, Homo sapiens
tgaggatcatccactggcctcccaacccggtagtgaagggggaataacaaggacgtctctggaaagtgctgcaggttcccctgaggaaagctattgtagagtagaaacgagaatgcacccccggaatcagctctccgatgatatgcaggtgcagctgcctccagccctgccgttggtcaggaggaggcaaggggtacctaatgtgctcttatttggcccatgatgagtggagaaagagacctttgcccaggtgtccatgtcactgaggcagtggcggagggtgtcccccagctctgcagtggtcaccctctgcctcctgtcctcgggcagctgcctgtggctgcaggcggtgaaggtgctgttggttgtttgctcccagacctggctgtggggcctgctctgcagaggtcaggggcatggcgcagggggacccagcagggagctggagccaggcagtgcgggctgagccaggccgaggagacccccgcttttatcttgagtgttgtcatctgatgctgagttctttctcagcagtgaaggggaatcagtgtcctgacttgaattgcactttgatggggtttttagtttctgtgtgttggatttttactgagagctctagagaaactagtcacctgggggtttcagaggagggttgtgaagtgctgaatttttctttgagcttttaaggtcagaactcaggggagctaaaaaaaaatgaaaaaataataatttaaaccttataaggtgactcataaataactgcctttcaagatgagtggaattcttctgggaaaaagccctgtggaaattctcctgaccaccgagaacaaagaggaccactgctataaaaacctccagaatcatcatctgcggatggagggaagactctgccaggagtgcgatttttcctttatgtgttactccgtttaccatgtctcaataaaatggcagagaaagtccttttcctgtgtttcatttttcccacaacctttccccttttgacttctttggggcttccccttatctgagactggcccaccgcagaattcagcttcacgggcctgtccggatggaacgtggacgcca

SEQ ID NO: 88377 - DNA, 1039 bp, Homo sapiens
aacctcccaaagtgctgggattacaggcgtgagccaccgcggctggccggtttattattttttcctcagtgccgtggaggcgcacagggctgctgcacccgttagggtggccctgggtcctacagccccgggcacacggtgcacagcacttgcgtagggtggtcctgagtgtgcacgctgctacgtcgctcaggcttatgtgccttaagcagttgcatagtttaggcacagtgctgcttctcaaagtgaattctacttggagccacttatatatagattagattttataatgtgtaatatgaagaggagcctggaggtatacttaatttaggaattatattatttttggtttgggttttaaagtatttgaatgcctgttaaaccaattctgtagtggctagaggttcaaaatttgtagtatttatgaaaaatactcattctaagtctgcttccttttataatttaggtatatacactctctgttcagaattcctcaatacaacgcattaaatattgttccgaggtcttctgagccccgttctcagtggtggccgtgagctaacatttccacatctgtcacaatgttgtttgcagtttgtcgggaggcgctctgcagccaggcagatggaggggccgctaggcaggatgttgcgagtctgtgagggcatcaatcccccgtttctggcatagatttaattgtttggttcaactgggaagccatatattaacttctacttcaacccatcctgatctctccacagatgctagttttatacaggcctatttttctctgaaattgagcctgagagacaaaaatccacacttgggctgtcatagattttggtaaattgagtcttgtgactgattggtgcctcctgcctgccccgtgatcctgtatgtagtaaccacgtcgtgatcacaggtcatggattggggaaagttgcctccaaagatgtgggtgtctgtttttcactccactttccatttggccaaaaattcaacacttcagtttctgtttcaaaaaagtaacaaagaatta

SEQ ID NO: 88378 - DNA, 1036 bp, Homo sapiens
gaggtgcgtgccaccatgcccggctaatttttgtattttgagtagagatggggtttcaccatgttggccaggctggtcttgaattcctgacctcatgatccacccaccttggccgcccaaagtgctgggattacaggcgtgagccaccacgcccggccgtgcagttctttaaacgtaggaaatgacctttgagttttgagttcgataccagcgtttctactattaaaggtggactttctctgtcaatgttcttggaatcttatgctttccacgaagtccttgcacttgtgcagaactgtatccccttagccatgtgaactgcacggagcaacgctgttgcaggatttccttctgcctcactcagaacatatgtgctctgtgtgtgaagaagctcgtcaggctgtgagcacagcacaagaataaagcctttagaactcagcagagagaaccagccattactgaaaatggaatgttttaattaaaaatatccatcaccgggtggctcttcttttcctttatttctcaagtgtggcaaatgttaataacagtggctgcactgtggctccatggtaaattgccagttggtgagtaggatttctcccatgaagcttagagatgaacccctgcaacatctgttcttgtgacaacgaatcccttttttactttggcttatgcatatttcagaggttagagacaggaggctccttctaaaagtgttcagtaactgcctgggctgatgtgtgtgcctgagagtcagagagagagagggagaaagagaatgggggctaaggggaacaagaagggagagagagagagagagggagagagaatgggcactagggagaagagaaagagagagagagacggggaatgggtgggagcatatgaattcattggtaaccctttcactttcttttcttcctgtattaattgatgggttgaccttattaagtgggttgattttggggtttctactgcagtgtaacaatgagcatgcagatggattttctgattgtttacaaggaaatcaaccttt

SEQ ID NO: 88379 - DNA, 1294 bp, Homo sapiens
cattgtcctgtcccttcctgacaaggaaatggctggacactctcttcatgtcagcacccctaggtgctgggggctcaaagataagccaggcctggaagacccacccagagccaggggagcccacccccaatacacatactcaccaagccacatgctgcggttgggggtcccagaggtgtgctcaggccagcctgtggggacagcaaagtggcctccccgagaagggggcctgtcctcagtgtttcagaggcctcaccttgtctcatgcttgaaatatttcctgaagaatgccatttttgaaatttattttctaaagaaaaaaaatccaaatattgaaaggctctgcttgaatttttgtcaacaattactatatcaagaaaatatttctgatttaggtggctccttcagaatatctgattcctgtgttggcttctgcgttgcctttgcaggcctgtgtctgtaggtgaggttttcctgttcagatggagctctgtggtggtaaatgtggccttccttgttttatgttacgtgtttctctcaacttcatgagatcagaccagatagagaatgttaaagaaaaaatatttcgggcaattagaattgcaagaatgtcaagaagaaatatgtgtagtgaatagcaggctgtagaaaccatctcactgctcagatcttaaaatctgtagccaagagaggctttgaagcacccagggaagatgcatgtgccactctgcattttgtaaaattctgaaccatggactttattgtagtgctcgctttgccgacagctgctttagtcgtcgataatccccaaggatacttgcgtgtgctgttgccttcgtcaccaggacttggaggaaactgcagtgttgctatttgttatttcacgttgatatttccttccacctttggccttgtcctgcggtaattcctcatttaggattcctttgaatagttgggtcatggggagagttctgacgttattttactaaggtgaggtttgctaagccatcattcttacgtagatggcagaaaaagccattcggagaaaatatctgagtctgttcccgccaggttaaatagaaaggggatttgccaaggatctccagaagacccgagagccggtccctgacgttatggtaggcttcaagggggcttctgtagctgctgagcaactgagacagtggaggagtcctagaagacctgccaccgcctcctgaagagccaggtgcctctgccacacagctcacagggtgctcacctccctgtggaacgggggcctcgagtctcagggtct

SEQ ID NO: 88380 - DNA, 1037 bp, Homo sapiens
agctagtgatgccgtgtacctcatggcagggtgggggaattaactgggagcagagacctggtttggtgcagagactggtcctcacctccgccgccccaactctagtccctacttctaccccaacatcacaacacctcaaacaccccgacccctacgtcacagcgcctcaagcatcccgacccctgcaacactgtcttagtctgttgttgctgctgtaacagaatacccgagactgggtaatttacaaacaacagaaatgtatttcacgcagttctggaggctgaggagtctaagataaaggcactggcaggtctgttgtctcttgagggccctgtccatcttccaagatggggctgtaacactgtgtcctgtcacggtgaaagggacagaaaagcagaagtgtgcgtctagttccctccagcccttttatgaaacacgatcgcctcctgaaggccccatctcttcatactaccacattgggcttccgttccaacacgtacatttttggggacatattcagaacatagcactagccccagtatccccactccagatcacccacacccccgcaacacgccccagtaccgccactccagatcacccacacccctccccaacacgccccagtgctgcatggggagcaggggccaaggtgctgcatgagctgcttcctgaatccgtgcctcttccgctgctttctgtagggctgactacgaaagagggctgcagtgaacacacctcactgagccccactgccgggcatgtagccttgcaggacggccgctcactcagggttgaaggtctccagcagattctgggagtagatgcacggtgctgcttatttcgttttacaaattaaacatccaatatgcaggtagcaatgtgtgtgaatccccagtgctttatgtagaaccctgagtatggggttcatttttgggcagggtggggtggagcggaaggtggtctgtgctgatgtcagaggggtctgagaagcttgaaaaataagggtaactgtgtgtgcctgaaccatgcaggaa

SEQ ID NO: 88381 - DNA, 1288 bp, Homo sapiens
cgtgatcgcccttggcggcggctcgtgggtttacagagcacttgcacagacttcgtcattgattcttgcaaccatttgggattcatagaccagtcaagttggttaacagatattgattaggtggaaacgtatatgttaagcatagtgccatatacaaggaactgtaagctgtgctcttgctttcaaggcactgatagtacacctggggaggtaagactaggatccatgcagtagaacagagaccaatacgaggtcaagcttgaacggcctggaaggccagagaatgctgcggtagagacgtcagggcaggcagtgggaggcaagagcaaagagctgaaggaagagcatgagcccacactctgaggtccgaggggctgggttttcgcacaccagctgggctccctttgggcctggggggtcagtagcacccgttagccacggccagtcacagccgtatgctctgtgcacacagctctgtgcccacagctgaaaccttggctctttggggcttatggtttaaaatgctgttttcttttcttcctttcttttttttttttttttttgagacggagtcacataggctggagtgcagtggtgtgatcatggctcactgtagcctctacctcctggactcaagcgatcctcccacctcagcctcctgagtagctggaaccacaggcatgcaccaacacgctgattaattaaaaaaaaattattgtagagacggggtctcattttgttgcccaggtttaacatactgttttctctgccagttccattggtgtctcaaggtggtatctctgcttcccctctgaaggaatctgaaagaagggggttaactgcttggagcccacctctctcctgtatctactttccaaagtgaggacagttttttaaaacaggacatgttcatcccctcatatctgctgaaaatccgtctagctcttggtttttgtataatacagcaataggcaacacaggaacgtaattttgtagctatgtgaggagtgaggcctagtgttagaacggggccagactgtaaaagatctcgctcctgtacggctcccgtcctagtcccacagacgctgcaagggccgcgggtcccggccgaagctttcctgtcccagatgcctgcagctgtgtggctccaagctttgcgcctgagctgaggaagatcacacgcctctcactgtatacaggactaattattacaaaatagacagggatggcattatggttaggaaaatatagactcattaaaaatcatttctaatttcaaagtagcccc

SEQ ID NO: 88382 - DNA, 1058 bp, Homo sapiens
atgttttataagacacaactacagttttacatttatgatctgtccacttcaccccacatcagactgatactgttgtcaataatatctatcggggaatttaattttagtttatttaaattatacttaatcaaatgctaaatgcatcgtttcatttgacctcattctttcccgtctcttcctctgcttctcatttcagctctcccacccactgccctattcttggaagggaaccatacaattaactgaccacagggattcccagtggataggcggttatagtgccatgtagctggtcacggcctggtgagcagctgacagtggtttcacccctcctgggtgggcaggtatcctgacctgagtcagggcagggagagtggggcccctgccaggctgtctctactaacgagggccgccatgtctctgcaggatgttgtgagggatgcagggaagtggctgcctcctgccaacactggggagagggtgggatgggagaagggcctggactttccaaggggtgaaatccaaggagggggtactccttgaatgggaactccctcccttcttcctctgtccgtggttcactggagagcatgcatagtgtgagccaccgctgaccgtcgtgatgcatggacagttttctgaccatagatgacagccgcgggccgcgaccatgctggttgctgcagttaagtatgggtgactgaactcaacgccttccagccagccctgtgcgtttactttgctcctcctcatgcatgcggcaaggtcgctctttggcatctgtttgttaaagctgttttttgctttcctttgccttgtttgtgtacttcgtggcccctattttttgtttttcagatcccaatccaatcctatcttgtgggtctgatcacagcacagttgatttgggtcactatgatttttttgagaccttagaactttgttcctgagagaaatgaagaccaaacatgtaacgtctgaagtcacagattacggattataacaaatttaccacaattcttccagagaagttagatattacctggtttttaccaagcttt

SEQ ID NO: 88383 - DNA, 1074 bp, Homo sapiens
gttaggagctggagcctgtggaaaaagacaagcaggaggggcctcgctctctgtgtccttctttccccagagagagtggacaacaccagaagcagaggccacacctctttacttggggtgagctttaattcttctggtgccttaaaaataagtttctatgggaatatctatcatttactaaggaagatgaaacagcatggcggtgcctccactgaccaagtctgtccgtcgggcaggtgtgtctaggggaggaggcggaaggcgctcctcagtcatggagccacgttgttgtaggagctcattctcatcttgtccaggtctgcgagtagtgaaggcagcaagtcctgtgtggcggccgtggggcttccagggagctgagcggtcaggttgagtcagtttccatgtggtggacagttcttacttatccatgcacagccctggtttgtggattacagtgaacagattttgaatgtcagcttcccttcagttcaccgtgcttctcagatgtgtcacagttaatttgtggttaagggatgaaagttggttttgccattagataaacatgttttttatagtgcctaaccccaagcagagtatgttcaaggagagaacaaaacagctcccaagatctggtccattagcccagtagaaattgttattgcattttaatgtaaatgacagtcatcctttcgtggtattgataatagagttgtttgtgtgcttttatgagatgctttgaatgaaccgaagctgatgactatacctcctgttgggaggagggggtttggggagcaagggggttgagaaggccagtggtgggcagttttggttctacttaacaggtgtgtcttttggattttaggcacaagtgttatttgcagaactgaatgtttatgtgtaattccatgttgtttaggggtttggagtgaggataattggaatccaggcatcttctccttgtccctgaatggggctgctgcttgacctgtccacctcacagggagtgtcatgtggccatgtgtgacaaactgtgaaacccttggtattgagtgctcacactgctaggtgtggtgg

SEQ ID NO: 88384 - DNA, 1030 bp, Homo sapiens
ttggggttaactgtggtgctttgacagtttcacttaactgcttactgcccagaaagttaagaactgttcctatgatcaatgtttttacttatatttttgccttggcctcagcagtgctctcccacttcgtcttccctcctttctagtgcttctcgcctgaaagcttttccacgtgcgtgccgtgttcagtgagaactctgattcatgctcttcagccagaagccttcgtagtcagccctgcccacgcacttcctgccttgccctgtccccagaggccatggtattggaagcagcttcctggaagcaagcttagattatgcgaagcagtttattccggactctttagaccaattgcaccagagcataaaggtgttgtcacctactgctatccctccgaataccttagtgacatgacctataaattcttttaggcacaccaaagacattacagaaagaagaatgaaagaaaggcatggttctgcagcctcctggaggatggcagcctgttgtgactagactcctcagggtttcagtccattagagctggtcccagaggggacccctgctggccagccctgtgttggactcttgctctccgaggccacctaggggattcactagagagcccatttgggattgaagagcacgcgtgttgactagagtgggttgcagcatgggccgcagcctgtttaaacactgcctagggaagattggtggagtccgcctcctcccttctgcctcgtaggtccgcagagtcgtgctgggctcaccgctccttccctttctgggcgggagcgcccctctcactggtaggggagctccctgggaaatgtggtctcctttctaccagtgcactgaggggtggggtggggagagcttaactgtggaaagaatgcgaactggtttagttctggctttgccacttcttagaaatgtaactctggacaaattactatttaaacttttaaaatttgtacatgcaaatgagagttaatggacagaataaaagtatataaagcatttgcaccag

SEQ ID NO: 88385 - DNA, 1172 bp, Homo sapiens
gtgggcagtgaggcctcgtcttacgcatgtggtcagaggagataatgtggctagaagtgctttgtaagcgccaaggattgctgttatgaggaatttactagatttcaggctttcatcagatagttagcgaggaagcgcaaaagcacagcatggtctccatgtttgctgacctgcagcgaaaagtcagaaagctaattggaggccattcataggctgattctaccttacaccatcattatactttttgtctataagactggagaagatctttctgagacatatcactatcagtgttttacgcgtatgaaacatatttttctttccttctttatgttcatttttaaaatttttgatcagtgccctcaagcattctcctattcaatagaaaacatatttttctaggtatgataatctttcagatttttggtatgtgtacctttgctaaaaacacatttaatatttctacctgtctggacaccttttaaaaatgtctggctgcaccttggagaaacgcttcatgcaagcagattctaattaaagtaggaaactttactttaccattaagttatatgtaaaagcattctaggggagagtcttttaatcattgaaacattttcaaacgtgtttgctcatttgcttctttatttgtttttatggcttattcatttgtttatttttaaactttttattatgaaaaatttcaacatatacccatcatctatcttcagtcattttcagctgccagttccagtctcctttcatctgtgcccccacccagtccccccttcccactcccctggctgattaggaagcaaatcccagacttcatgtaatttcacctgtcaatatttctgaaagaaatatttactttctctaaagataagtatgcttctaaacacacacacacacatacacacacacacaatgtttgtttgaatcaggatgcaagtgagatgaatgtattgtgagttacttcatctattctgttaatccatgtaattaatccaaaagtcagtccctcaccccagcactctctgtgcacctgtctgcctgtctctttctgcagttgattggttgaagaaactggatcatgtagcctgtagaatttatcgtggtctcgatctcgtcagtggcttctccccccttgccctgggtgagccacactcacctct

SEQ ID NO: 88386 - DNA, 1069 bp, Homo sapiens
gttgactcagcccacccaagcagggagcatcttcccatttgttcacgtcttctgtgttttccaggagagctttgaaaatcttccatgtctgtgttttgcacatttcatgttaaacttattcctatgcattcagtctgctctgtggctttcgagatggggttttctttgccatgatgttcctttgtttattatttgtgtatatcaaggctattgattgttctctgtcagttttagattctgctcattcagggttaagggcccaggcaggaggcggagggaggagctttcagcagggcgattccttactcggtctcttcactcttctgccattgctgccatgtgtacattgcaggctccttcatttgagcaaattctctcttccatgctccagatgttttcagaaggaccgcgtacttctgagaaacacttggtaccccagtggcagctgcgtttgccttggtgttgccatgtgacaggcattacttgtttatctcattgttgttcctagtagttctcaatgtttgttgaatgaatatttataaccatcatgtgtggcagttcttatgtagtgttttgatttgtttttttgagaccatctcactctgtcactcaggctggagtacagtgttgtgatcatggttcactgcaacctcaacctcctgggcttaagtgatccttccacctcagctgggactacaggtgtgtgccaccacacctggctaattttttttttttttaattgtagagatggggtctcattctgctgcccaggctgatcttgagctcccgggctcaaccagttctcccaccttggcctcctaagctgctgggattttcggcatgagccagggtgcctggcattacctggttttatagatggagaaactcagagccatgtgtccaggaccacacagctattaactgcaaacccagaggaaagggtaggggatgagttccaagcattccctggagtccgtggtaaatttcttcatttcttctcctgcaacaggcccggtacaagcagagccttgacccaactgtggatgaagtcaagaagctctgcacgtcc

SEQ ID NO: 88387 - DNA, 1068 bp, Homo sapiens
gccatggtgggcaggcaaggttggagggggcctcctggagaaggcggtgcttgctcgggctgagtcttacagaagagaacaaaggcaacagttgtccctgagaggggactggaggggatgatctcagaggaagtagatgatataataaaccagcatggtattcattggaaactacaagcagttctgtgctatgggagcctggagcctgaattgggtttcaaaagaaagaaggccagaaagtgttccaggctaaggcatagagcacctcgcagactcttagggatgtgggcttagataaatccttttgatgccgtgtgaagcctggctctggggagaaaagactggctagagaaactccaggtagaaggccgtcgtatacaagaggccagtggcggcaccctgagtcaggctggtggggcgaccctcaggaccttcctaggacaggtggaggttgagttagagggagcaggtgagacctggactgtgaccaggcaccagaagcgagaagaaggagcttgtgggcatttgttctcaggttgtgagtaggccggaggtccatgagtatggggtcgtgagaagtaggggcagacatgctgcgggcggttcccaaaatacagtttctagagccgaagaaggccaagagagtgaaatctggggagcagaagaggatcctggcaggtgatggggaggagaattgggagaaaatggcatgggggaagccgggaagggtacctgtcagcccgggggaacagagatggaattgatatccattattccaaggagtctggccctttagcaagaagagcactttatattccaagtgaagcagtcctgttcaaaataagcagctccccatttctgagaagatgctgagtacatcttctgccagagaactcagaatgtgaatcagaattctcagccctattaaagtggcatcttctcagggctcgttcctgtaaagccccttaagggcacagccttcctttaaactctcagccaggaactgtggtctcatctggatttgccgccgcagctttccctggactaaagatggacttgtgccaccat

SEQ ID NO: 88388 - DNA, 1040 bp, Homo sapiens
aagaaagaacaaggctaagcagggatgtttagtttctgcaagaggtaacttatgtttgtagataggagaaagggggttgctgaagaaagtataaatcagtggagtaaaggatgagaaatgggaaggtatgagaagattaattcaggacagagatacagcatttgacttggcaagcccaagcactcttctctgagacgtgggagggaaggagaggtgaatacaaatgtggtggagctttgaagctggacatgagagctggttccccttggagcctgtctcctgttaagtgagaagccaggccatgtcctgagaggtgggggccatgagtgccaggatggaagggtcaggagagaggagacatggcaacccaccccttcctcatgtttactgcctggcatagttggcatttttctttatgttgaggaaaatgctgctatgatctgattagtaggtgctaaataccccagtttgtataaagtaggatggtatctttgcagggctaatgaaatggccaaatcaggtttgggtaaggccacctggagatccatgtccttcagctgatggcagtcttcctgtgtatcccagctatccacagagatgcttgcgagttctaccatcgcaacagcggcgaggccaggttctcccatcccaacagtggtgaggccagaaatttccaggctcatcacatctacctgctcagcctgtggtgggttggagttggggttgggacaccccacctgcccttccagagggcgactgtctgcacctgcccagtgtgccccccgttccctcctctgcagtgtcagagctgctgtgcctggatctgaggaggggccgtgggagaagaagccgcccccacgacacttgcgcttgccttttcagctggagcacggggtggcggcaccgtgtcgttctgcccacctcacccactgggatgcaaacttgctgaggccagggcttcttcctgccatgccttgccaccacgccccttgcctcccctgggacatgccgttctcttctttgtactcatctgtttggta

SEQ ID NO: 88389 - DNA, 1083 bp, Homo sapiens
tgtaaatttacaatatgttttaatactttttattgtataacatgtgagctgaaagaaattgacaggtgaatgatttgttccagggtttaaaaaataaacaattgattaaatataatgcaagaaaatggttatttggaccagaaagcctccaaataataaacattaacacaaatatgagtgacataaattttaagagatggtgatcagctttcatattcttagtggcacagtgcttgtcctgggaccaggaggtttatttattgtttacttctctctcagaggagtgctgtaggtagagtagaagacgacttcatcaaagcacagatacagtattgcacacacttcaaaccatcagagccggaaaatgacatatctgtcactcagtaatccttcttatatttttattgtgtcatatttctttgtaatttaaaaattaaggataatattcaagtctctccgctttcagtcttcttttataaataagtatattttaccaaattagtatatgccatggtttgaaaaatcaaataatacagaaggtttatgatgaataaagtagtccctggccccacgctttctctgctgagactctatgaccaaaggcacctccttcccctgtttccatttctagttcttctggagggtgtctccttccctgtagatgacatgctgagaccactgcttcttgatttgtcgtttttagattatcagtgggctttgtcttagggtacaaaccaagaacagagctgccattaagttctgtttaaagaagggagaaacgatgtggaagcctgttagcaaagaagtcaattatgtgtagattacatgctggtttaaattcctatgtgttatttgtattcagtagtgaattctaaagagaaaattctagattgaagaggctgcgtcactcacgacgccttcttgcgttccctcttattcactctattgggtttctttatactttgtaaactttgtggtttcaagtaatatccttatgcttttatttctagttttatcagtaatagctcatttcttccattttcaaggctcttagcttccttgtactttcttctgccttttttc

SEQ ID NO: 88390 - DNA, 1050 bp, Homo sapiens
aggtctgcctcacgctctgcacacccctcccctccctggcggccgccctgcacaccccttccctccccagcggccgccctgcacaccccttccctccccggcgaccctcgttgggagcgtgtgaaggatggtcctgagtgcaggctgcaggtgccaggtggtgatcggcacataacgtgacagatgggcaggtgtgtttgtcacgcacagacctgcatggtaggcacctgccccatgcccatgtgtccttgcccgctgccatctgagaggatgtaccctcatcctacaacagctggcccttggtgtgccaggtctgccaggccagagctctctaggggtccgtgttgggtaagtgcacggcaggtggccccctggccgagagcctcaggaccccgctgtctggggtttgggggctgagtgtggcacagcaccactttcatgccctctggaaggcttggcttttgcgacctggcctcctcaccagctcaatggcagtttcatggcatagcgtccctgctgcccccagacggtcagaaatccaacccgagtcatatcattatcctcgtctttgtcggcactggagacgtggggaggtttcgttcctcagaactgctgcacgatatgtcttccaaaataaatgcggtttatttcaaacagcagcactcaaaatcaaggctcctcaggaaatccagtattaaccccttccgagctttcgccgtccttgtcagatgggcaaaacacgttgtttagcatctcagcacaagactggagagaagatcgggcagtttgtgcataattatttagcagtctttaaaactaggagaggaatctgttttctaattaagctgctgtgtctggaagtaaattatagtgaaccttcctcgagcgacccccccagtttctaattatctatgctaacctagcagcctgatgaataagctgttgctgctgcagtacatatttatattctgaatcctttgagagagtggcaataagatccgtgcctggaaattaagggacatttttcagccctgaaacaaagtaatgcaa

SEQ ID NO: 88391 - DNA, 1054 bp, Homo sapiens
cggaagtactgtgccgcctttgggaataatatggtcagtacatacctactgatatgaacaatgttcacagtgcattgtttagtttaaaaaggagctgagaaatagaatcacatattatctagttcaagatcagtaagagaagtgtggacataaagaacaatgtctgagttcatatacctaaatgtcaccagtgggttagctttttaaatgcaattaaagcatgtttgttctagtattttctacattgagcatcttttatctgtgtaataaaggcataaagcgtgttttcttcacctgtctaaaagcatgaacttgtaaggaaaggagcaccagctctaggtaactgaagcagcagacagatctgaactgtggtcagaccgctccaaagctggcagctcatgcagcagcgtttcggggttgcacaccagtatggtttgcagtgataccattttcttcttgttcttccaggtgctgttaagccaagtgcaccggctgagagcattggacttgcttggaagatttttggacctgggtccctgggcagtgagcctggtgcgtgccttccgcattaacctgggggctgagggaggtgggacagagattaggctccgtgtttcagtctgtgcacgtatttcatgatccagagccacccccagccgtgagacccagggcgagtgtgtccaccgtgttggtgtcctgtcactcctgaggccctcaaggagcccactctgtacccgtgcagcctgcagtgctgcctggcgtttgggggtctggggttgtcgcccctctttatgtctgatgttagacataggagtgagtgtgttgtcggccggtcaccttttcctgagccgcccccagcgctgcggaggagcagggcgcccctgagcctgacgcagcacccacctcgtggtgctgcttcccccaggaggagtctggatcctcagcactgtctgctcaccatcatggcaggcacaattcggaaacgctcttctggttcctcattctatagcagagtagtaatggccactaaaaacaccctggcagaggcaggatc

SEQ ID NO: 88392 - DNA, 1974 bp, Homo sapiens
tcgtgttgctggtggtcctccggggctccgcccccacatgatgagtgcctcctgcagccctcagccgtccctgtgactcctggggcttgccattgtgcagatcggggtgcacatggtgtacagacgggtccacctgtgaagatcgcagagcctgctcagaggttcagaggtgcagacagaagccagccactcccccagtgttctcagcatccccctgctgccgccagccggccctcaggacacacttaagagtttgagaaggatcggagcccactcaggctgggcccagcggaagggcgagcctgggacctcccctcatttcccaagcacctttggggcacaccgtgtgtcccattgtgccagaagctctgagggattcatggggaggccttaaagaaggtgggctcgggcggaagaaaagacggaagaacaccatgtgccaccggggagaagtgtgtgccgtttacatgagacagagcagggcacagtggtgacactgatctgacacagatggtaccgcacaggacaaggagcaccaaggggggcacatgaagaaagccgtctgtccaggattctcccaggactctgatcccagagggcctcccccagcatcactccccatgccaggttacactccacttcacactaccagccagaaattaccaggcagatagaatcaggaaaatatgacccgtaatgaagaaaaggaaatcaacccattaaaacctgctcagaactgctgcaggtgttatcattagcaggccaggacattaaaaagttagaagtctactctacatattcaaaaagttaaattgagacacggagaatataaaaagaacccaacttgaatttctagagatgaaaactgcaatatgtgatgggaagaaatatacttgatgggattaacaaccagttaagcattgcaggagaaaacagtacacggttaggcacggggctcacgtctgtaatctcagcacttttggaggctgaggcagacagatcacttgagtaaccaggatttcaataccagcctgagcaacatggtgaaacctcgactccacatgaaaaaatacaaaactcagccatgcatgttggcgcgtgcctgtagtcccagccattcagaaggctgaggcgggagaatcgcttgagcccgggaggtcgaggctgcaaagagccgtgattgtgccatggcactccagcctagggaacagagtgaggccctgcctcaaagaaagaaagaaaatagcaatagaaactaacaaaaatgaagcatggtaagaaaagaaaaaaaaatttaattaaaagaatattattccattgcgggacaacggcaagtgacataacgtactatttgggggtccataaaggaggctagcagaaaaagtatttgaagaaacaatagctaacatttttttgaatttgatgacaattataaacccacagatccacaaagcttagcaaaccccaagcacaagaaaactacacgaaggcatatcgcaatcaaattacttgaaaaacagtgagaaattcaaaagtctaaaggcagccagtaaaaagccagtaaggagcaaaggtgagaatgacggcaggtttcttcttacagatttcctacagatggaaaaggtgagagtgacggcaggtttcttcttacagatttcctacagatggaaaaggtgagaatgatggcaagtttcttctcacagatttcctacagatggaaaaggtgagcgtgatggcaggtttctcacagatttcctacagatggaaaaggcagacagcggaacagcatctttaaagcagagagagagacagagaaagagaaaaaactgtcaacctagaattctatacccactgaaaatatatttccaaatggaggcaaaataaagacttttaaagacatacaaaagatgaaagcttatccccggcagatccacactacaagaaacgtgaagtcctttagccttgaggagaata

SEQ ID NO: 88393 - DNA, 1134 bp, Homo sapiens
tgtgctcatggaagcaaatgtccttttccttaggaatatttctgggcaaagcgtcatgctatctgcaactttcacacagtgcagaaaaacacaggggatcagggggcagaaagcaaacatggcagagtattttttgaaattgtccttagggtcatgtgatgggaccagagctcaagagcagcagaacttcatgatgagaaagtccaggagatgtggccacagctgtcttccgctggtcacactttgcaaggatggtggtagtggttgttttaataagttcctcaagcctgctgttagcatttgtgtatctgctaattagcaagattaaggagggggagagttaattaaggactcccgtaggcaaggttccagttaattgagggtttttcatagataaaattaatactcagtccagactgaccttctgagttatagttaataaagttgtggttatggtaccaccagggaactccaagagcgtaatgtcagtggatctggaaagatgctctgtgatggtattcatgaagtaaatccagatttggaaattcaaagaggcttcccactgggaacaggctgctgtggtccccggaaggaacccgcactatgaagaaaaggcagatgagagagtcatagaattttgtttctgcagcccccacgtctgtgctggttctcctacccgtgctcaaattctctactgttttctctgcaaagtcgtttcaccacagttcgtgtatgctggcgttgatagcctctcctcttcctgcttctccacttttccccactcccccttcctcacacacgtacacgcaaaactcaattcaaaaaatgtgcaaggttagctttctctgtcatccagcgatgactcagtctcaccaagggggcaagagagtgccatctagagcgtgtgaccctgctggtcccacagcagaaggcagtgccctggtgggggctagtctagttaggacctgagcaaacattttacttgtgtcccgaactcttgttcctatagtttctatcttaacaaattttatttttttagaacagttttagatttacagaaaactggaaaaggtagtaaatagagttctcatgtaccctacacccaattttccctgttgacatcttctattagta

SEQ ID NO: 88394 - DNA, 1033 bp, Homo sapiens
gatccgctgaggcatttcaaggaaagttacaccctttccaacgcagttttccttttagaaagatttggcctcagtagatgaatccatgtgatcaagcctagtgatcagctaggattcttgaatctcgggacccgttgccagaataacaaaatgggggcttcctgtaacctcggctctttaaagcaacacttctgataccagggttagggtttcagaaaatgcagccgccttaggagcctcattggcagctactttccactaaaacatcttccatttctctctctcaggagtttcctttaacagtgtttacactcagatttggagagtcctgctgcacctggctgctgacccctatccagaggtctcggacgtggccatgaaagtactcaacagcatcgcctacaaggtacgtgccgggcgctccccaccgcgctccagctgctggttctcggttacgagtatgcatgccaggaactccaggtgtgcccgggtccacaccacagtttagaaagtaacaaaacgagcttcagcaaatatcttaaatctggagatgtacacagtacaccccaaactgtgtctgtgcagctcccacgtgggcagagggtgctggatttactgatgcctgtcaaggcaattaggggaggactgacattatctttcaggatcctctggtgtctgggtgagctacagtgctggcccttcttccattttttttttctttctttacttaattatttataagagatggggtctccctgtgttgcccaggctggtcttgaactcctgggctcaagggatcctcctgcctcagcctcccaaagtgctgggattacaagcgtgagccactgcacctgttttttgtttttgtaagacagtctcactctgtccagactagaatgcagtgacctgatcacggctcactgtagcctccaactcctgggctcaagcaatcctcccacctcagccttggaagtagctgggactacaggtgcacaccaccacacccggctaatttttaaattttttgtagaga

SEQ ID NO: 88395 - DNA, 1039 bp, Homo sapiens
gattacaggcatgagccaccacacccagacttttcttccctttctgatagcagtaatttttgactcattcaaaacccttctagttaatggtttcttattcatggccattctagctcaagggaacttttcaaagaatcagtttttggtttcattggtttttctctgttgtttgtccattttccatttgattgattgagctttcatcaataaagcttgctttcttctgcttactttgagtttaatttgctcttctcatcctagtttcttaaggtagaagcagaggtcattgattttagtcctttctctttggggactgtaaactcttctcagtcccttttgtgagctctgggcatttggcctaccgccttcccgctgttttttctctgcctcatgggttgtcactctacccttgagcagatgaatacttagtcaaagaccccaggggcctctcctgcagaccttggaagctttcccctctccagtgctctgtcctgcaaattgtcaccacctcagcctccctggagccccagtctctgtctcctgttccctgaaagtgctgggctccccgtctctgcactgtggcctgggactgcctgaaactacctgcaagccggacacagggcagctgtttatttccgttctctcagggatcacaagcccgtgacacccagcacccagtgtccaaaaacaattgtttacggtatttgtcctggttttctagttgcttatggaagttggatgatttatgtggaattagaagtcactcattatagcacttaaaaattttttggtaactttttgataaaacttcaaaagcttacagaaatgttgcaggaagaatgcagggaaaggccacactcttgcagcctctgtggtgttctacgtcttcatctgacctcgtcacggctatggcgttgcctcgggtatcactcagtgccagggtctgcagggtcgaggagccacggcttcccatcctagtccatcgctttttccaaatgagctatcgagtctccccctctcatttgctgtggccttctgg

SEQ ID NO: 88396 - DNA, 1052 bp, Homo sapiens
tagccgttccctttgacccagtcatgaatctgctaaaatactgtcttgagaaaataatcagagatgtagatgacttccgtgttgtttctaagaacgaaaattgagattcacttaaatgtccacagagggtgaatagttaaaaagttatgaaatatttgatgagatattattggagctactgaaaagttaaacattaaaaatagtgtcctaaggaagcgctcatgacaacattccttaaaaagaaaaaatgcaaaatgcagaccaagaagccagatttacagaacaatcacagccgtgcttctcatacagacacagatgtgcatacgacggagaccagcagagcccgctcctaactagagattcgcaaatggcgccacccacgactgcactgaattgggcttcttttgtgcctcttctgcagtttctacactaagcacgaagcacctttagagtcgggggaaaagaatcaaagaaacaaaccccaggagatcattgaggctggtggattcagtcctagtcagaagcccctcaccaggcccacctgctgggctcaccgctgcttacctgcgggtggcatgagggtggcggcccctgcagacagagggaagtgccccttcccatcactaggaggcttctggttaggaaaggaaagcatacacaaatcctggaattggatgcaggaagcaggagccacccaaactctgagtgagccagagctgggaggtggctggacactgtgccaggggtgccaggccgtcctctagaactgcggcccagtctgttgaaaagtcaatggaatttagtctaatgttaacaagcttggtgtccttgatgcggtctcgtgcttaaggcagacaaggtcaggcgactaagaaacccacatggtctggtcttcgctcttgctgggatggcagtggctgtacatgttggtaatttcttggtgtgataacgagaggcttttcttgaagtccttgaaaaatgcctattctcagtcatctatcctatgatgaaagaggaatggcatagataatccaaaactcattgctcttaaa

SEQ ID NO: 88397 - DNA, 2621 bp, Homo sapiens
agcgtgggcaccctgtcggctggggtggggggcccgggcagcgtgggcaccctgtcggctggggtggggggcccaggcagggccacagcgggtcactctcgggcttccctctgcagacgggccaagctgctgctcaagaagaagcgataccaggagcagctcctggacaggacggagaaccagatcagcagcctggaggccatggtaggcggccgggtgcttcgccctggagtgcaggtgcagctggaggcagctccgcccggctgcgtggacatcagaaatttctcccgagagctgaaagctcctctcagatgcctcgggctgaagctgacctgaagaggggcgggcctggaatcccggggagtctgccaggaagctaatggtcttaagaggctggggggcaggttggctctcgcaggactgaggtggggaaggttgggccacccctgggtggtgtgggtaggtcaggggtctgcatggggactgagtgtccctggtgttagggacccgagcggcgtggttctgctctttggtaaccagagctactaacaagcaaccagcggtcccctgagtgtgtccctggcacctgctcagtcctgcgcatccccacctggcagtgggagaggacagggaggagcaggtgtcaggagtcaccctcacgcccagcagcacccgcccagcaagggtgtcatcctgaaccctgccccagggccgggaggagggcaccccggatcctcagcacctgcgtctgctctggtttccttttcaggttcagagtattgagttcacccagatcgaaatgaaagtgatggaggggctgcagtttggaaatgagtgtctgaacaagatgcaccaggtgagtctctgcagggccaggggcatggaggtgtggggagcccattgggctggagctggggatagggcggggggcttgtcccacggtgttcgtgtcagacacagggcaagaggctggcaggggagatgtgttgggtgctgccaggcaggcagggatgcagtgaccgggtgcagcacaggctgggaactgtgggaactgggtccccaggcgccgaagtgacatagaagggaagtctgagggtggggagggggctggcaaactaatcacagaaggcttcctggaggtggcgggtgtggtggctcacacctgtaatcacttttggaggccaaggcaggcagatcacctgaggtcaggagttcgagaccagcctggccaacatggtgaaaccctgtctctactaataatacaaaaatgagccaggcgtggtggcaggcacctgtaaacccagctactcaagaggctgaggcaggagaatctcttgaaccgggaggcagaggttgcagtgagatgagattgcgccactgcactccagcctggatgataagagcaaaactccgtctcaggaaaaaaaaaaaagaaggcttcctggaggaggtgaataccggcctcatctcaggccgggcatggatgtgaagcccagcgtggccataccacgttcccccaccaaccccatcacactcctgacatgggggccagtaggtggggctagttggagagccagggactcacctggcgggaggtctggctgtgctacttttccaagtgtttggtgagtactggtggtgtgtgccggtcaagcacaagtggccctttgaccttttgccactcaaaagaaatcaagtcacctgcccagaatgttctacctgttgcttgtttttactggcggctgtgagagctgactcagggtgagagggggcatcgggcgccagggcagtgcagtcgtggcctctgaaaagactcatcaaacggcccctgtggcctcaggacaggcccatgcctgggacacacatgtcctggcctcatttaaacagggacaggagctgggtgtggtggcatgcacctgtagtcccagctacttggacggatcgcttgagcccagcctgggcaacacagccagaccttgtctttaaaaataaataaaaataaacagaggggtgaggccatggccctgagagcccaggaggcctctgtcgggggtctaccattggcctcgcgacaggggtcaacacccatcaccctcgtccacaggtgatgtccattgaagaggtggagaggatcctggacgagacgcaggaggccgtggagtaccagcgggtaggtggcaccctgaccggcctgcccccaactgtgagaacccacaaggccaccctcgagggccaaactgtcccacatcctagagcggccgccttctctcaaggggacgagacccagccacaggccatctccttcctccctgaggggccacctcctcgctgctctcaccaccgcctgtccttttgcagcaaatagacgagctcctggcaggaagcttcactcaggaggatgaagacgccatcctggaggagctgagcgcaatcactcaggtaacggcccccccgggactgagcacagtcactcaggcagcgggacccccagagctcagacccccaggaggccctgcccatggtgatctcgtatgtggtgtcctttaagtaaatagtctgcggtttgtgactggttttcctacctgaggtgactctgttttcagggttgctcacccaacggt

SEQ ID NO: 88398 - DNA, 1053 bp, Homo sapiens
ggcccctcctggcactgggggccgtactcggctcaacctccctgagcaaagacgaagaaagacgaactttgcttaacgctcagtataattagtcttcatttaccgcctgaaacgttgtctttgttttcttatcactctgcttcttaaatgacttaaactgccttgaaagtgatctgaaaggtatttctggatgggagcggagggaatctgttcttcagaatctgaaattggaggacacctggaaaacaagacctcagtgtgttcccgcaggtccctgcagacaggagacagcagagctgtacctgcgggtgccgcttcgcatgccgtcagggaggacccagacgtctccatgctgctgggcgccgcgcagatggcttccctgcccggggctggctgcttctaatttcagctgctggaggctccgcgctctcactcttgctcgcgctctctctctctctcttttattccatgtttatttaaagccagattttgaaatgttgtcttcagccctaaaatctcactttatcttcttgcagcagatcctataaaaccccacttaggtgcctagagggtgggggacttcgaggacagagtttccctggcccgctgcctgacactgtctccgtaaacattccgatgactggtcagtgttttcccagtggagcagcccagtgtcacgtccacccagacggaatacagacgagccgggtggacgtcgtgagtccagatacacgagagagagcatggcctccccagtgacatgcaggaagcacgcctgccccggtgctcggagttgaacttaggcaggggagtctgaggctgccctgccgtctcctgtctggggtcgtgatgcagtggggcctgtcatgagtggtccagacgtgtacccccggaggtggaacagtgacagcctcaggtgccctggtgcctcctccttcccggctcttcctggcactctgcttccttctcctaacctgagagccacacgctatttcttcttgtccatctagaaaccaaggacatctggaaggggtcttccaccttagaccctaa

SEQ ID NO: 88399 - DNA, 1075 bp, Homo sapiens
accggctcacggaaaatgtctataaggtgagcgccccccggcgccgagctgagcccgctccgtgtgcgcctgggtcgcgcgccgcccgcgcgcccgagcccgaccagggcggccccggggccgcgcgccgggccaggaggctgggactttgggggtcttcccggcgcggccacccgggacccgggctgctggggtggtgagcccggcgccggccgctcacaggtggccacccccgcccgggcccccccatcccatgcgcgccgcggcccggtcagtccccagccccaggcccggggagcactccccgctccgacggccctgctcggcccccgcgcgctcgccttggcgtcggcgggaacggagccgcgcgccgggccccggaagccctcggaccggtcggggtcgtagcacacccgggcagggccggggcggcgggggcggcgggcccaggggttgcggcggccaggacggcatgggggctgtctgaaggccgcggtcggcgcggtggcaccgtggggctcctccaggcgcggttgcgcgagcctcgggcacttcattctcaacaggctttcccttcccacaactcctgcccggcgcccatgctggggcctaaggtgggaggtcggagcgcgggcaggctggatgggtggacggataatctatcatcttatgtaaccgcggagagagaagactaattgtgtaggaggctgacgtgcctgcctttgcttcagatgtgttaagagtggcatccacgttctcgtctgcgaaatgacaggttcacatccaagggccgcagagcaccgctggaagcctcccctgccgccccctccccagtcgtttttgtggctgggataccgacaaacaggcccttggttttctctttcttcagcatccgttctcggtccagacccccacgcctgagcccggcagctgccggggagcattttctcagaggagaaacccctgctctgggtgtccctgggtcctgggcgatctcttacagatgtgctttgtttcaaaactgtctgcaggttcagtgacaggctgggcgatgagtggagtgggtatttacccg

SEQ ID NO: 88400 - DNA, 1059 bp, Homo sapiens
cacgtcggagccactgggaaacaggattcagggtgacctgaggagtcggcttgggaaaggcacaggccctggggttgttaggtttggtttcacagagtctgtggcatacggttctggccttgttgctctgtggaagcacatgttgtcaagggagggaggtttattaaattattagtcattagctccattacgacttgtttgtgattgcagagggtggaagagaagtaccagcggaacctttttcctattttttctccttctgcgctgaaaccagaaagcaggaactttcgtggtgagagttggcagggggtgagtacatggagtggttttgctctgggggaccgaccccgtgatcgtccttaataaaactctcctaaccgggcagtaggccttcacctaggtgaagctgtaatttatctgcaggtctaagtgaaatctgctggcaggaaaactcttaggactgagtgtttggggactttgagcccctgtggacgcagaccagctggtctggagcacgtgaaacacacaggttctgcgttttgtcttccacgggtgggttaattggtgattttcccaagtgaagatgtggcggttgatgatttgatttagcacggcaggacgcggtgggccgcaggtgtctgaagggtcgatccactctggaaaggctttgccctggtgacaggcttgcgctgctgctgctgcacacaggcggggttggttttgtaggtaggtggctcctgctgccactccgggagcctgactgctgagtctttgagacctttttgtgctttgtcactggggagctcaaggtgccttggtagtgccggtactggttgggcagcttttggcaatgtcagccaggcagaaactcagcccacatggagacatagtcaggagaccgctgaggccaccggtgtgcactcctgggccggtccagccggtccaggcagtgctgagctctgtcctctcctgggacggtgctgcctctggcatcccttcccggggccgctcctgtgcctgggttggcggcttgcagagccctggcagtgcctcttggaa

SEQ ID NO: 88401 - DNA, 1086 bp, Homo sapiens
ttcttcgttggggagattggttggctcgtggtactgcccgagtggacctgaggttcaggattaaagtgaaggctggtgctgccctgggctttcaggggccaccgttagatgggagggcagtgggtgggggctgctgggagctgtgttcctgttgctgccttgtcttcgactgaagcttccaaaggtggagacctgagggccaagacctgtctgctggctacaggcaccatgggctgaactgtccaggataggtggtcttgcaggggagggctggtgtgtgacctggccattgaataggaggggcctgtcctccttccgagctccaggaggcagactggccgggaggctgaagcccggttcacccttctccccagttcacaggtctgggccctggtcaggggagcaaccccagcgtcactgcaggagtggcaggtggtgagcagagctggacatcaccacttgtctccacccagccttgcatggccctctctgccagctgccctgggctagtgttgcctgtgggtgccaccatgggtggggacactcgccaccgtctgtggaggcggggtgccactgactgctggttgaggctggctcctgtccttccttacattgagccagagtctgccctgtgttgccttcccagccaccttgtctggtgactttctttgaggccccaggatagggaagcatctttgtggctgcacagagcccgtggtcccctggaagctctgcacttgggcggccggcgccgtcagccgccccccacagcctgcgctaagatccctagtaattacaggcaggcggggatggtgctggcaccggcctccaacgcacttccacctcccccgagcgctgattcattcctggcccctggctgtgcctgtacagctgcacaatgacttgaggggcctcaacccagaggcagaaagggaggccgagaagggacccgtttggctctgtgactgcaagggcttgatctgtcctgcccacggattcctcctttgggcatggaacggcggccagcctgtgaggggcccatcggtatttgggaatgaacacatcttgtttctggattctggagca

SEQ ID NO: 88402 - DNA, 1281 bp, Homo sapiens
gtggtgaccccatgatctctaggcacagcacacgatgtccagattctccgggcccagctaagttccgtgccctgtgaatgagaccagttgttcatctcttcctggctgggtctgaatcttggccattacaatgagaatccagagtccagatgatcccacccctggagatgggggctggtcttgcacattgcagactgacgatggcttcctttttccagagccactcgtctgtgggacacttggtgacctcatctacggtagagtcttccgtagccctcacgtggctctccgaggtgtgggtttcttccccgtcgtccgcacacggggaagtggtgtggatgccgctttcagtgggttgcggtgggggccggggcctgtgttcccctcctctgggtgagcaggcacttcggccctttgatgccaccaaggcgtgggttccgttcgggcctttccgctcctgtttggttcctcatgagggtggcggggctgagtgtggagacttggagctttacttcctgctcctgcttttcttgatggcctggtgggaatgagctcggccgtccaggcagcaccgccaccttagccgcagccagccgccctggagtctcacttctgctgttgcgtttttctgctgttgcgtttttctgctgttgcgtttttctgctgttgcgtttttctgctgttgcgtttttctgctgttgcgtttttctgctgttgcgtttttctgctgttgcgtttttctgctgttgcgtttttcttttgttcgaggcagcacacccgtcccaggcacaggccttcattcctctgtggacgtggtcttgtgccgcagaacaaattgtgcgcttaattgaaaagtatataaataaaatctgataaagtgcccagttataggcccctaagtgggttctgtagaaaacggattagaaattgtaattacactgctctccggggccctgccccgccctttctgcggcctggaggtcagggcggggctccctgtcaggtggaggagtttgccaggcactccctggagtccctgaggaggaagcccaggctcttccaggagcctgctccacccctgtggctgtggaggagttcagcaggcccggagcccttcacacccacttctgattagatcagactctgcctctgagatgctgggaggcccctcaggcggcggcaataccaagtaatgcctttagcctcctttgatcagctgtgacgggcgtcctggtctgagactgtgaagcaattggaaatagttctcccactccaggctca

SEQ ID NO: 88403 - DNA, 1028 bp, Homo sapiens
gggtggtggccacatgctgctgccctcgtgacctctgagagacccctctgcccgtcatctgttgagggcccctccttgggccggtagactcttggccctgtgtttcccgctaggcgtcccccggcacagtcctgcggccctgtgtctcccgctaggtgtcccccggcacagtcctgcggccctgtgtctcccgctaggcgtcccccagcacagtcctgcagccctgtgtttccggcatccccagccttgtcgttccttgtgggggaatcccgccctgggatccgccatgtcccaggaccaagcctggccctgctgaaccaggagcgagttcctcagggacgggctgcagcagccccctccatggatatcctgagccccgatgtgagcaaggggatcccctcctaggaggctgacttagcccccagagcaggcaaggcccagaggccagactccccaccgggaacaggcagggccagcaggcccctgttcacccatagtccatgggtaggagttgggatgggatcacatgtgtcccctggaacattctggaacatttcaagagtttcgaagatgtagttccggagccaagcccaccagggaggccctggtcatgtctttctaaaataaagggttgcagggatccacgggctataccttgacacttgttccccccacccaccacactctcatgtacgtgcgcgtgcgtgcacacacacacacacgcacgtgatacagaaccagtgctccagtccccacagcctggggacagccaggagacaagtgctcttccctccctggagaggcccctcctgccggcctgggcctgctgggcactgtgggcaggtgcaggcaaggacagcagcagcacctttgacccctggaggcagcctcgctgctgaaggactcagcggtgacaggctgtgctgccacagctgccaggcagggagcgctgtggagcgcaggcctcccgcctgctagacccaggacagtggcgggcgtctgcgccctctggcgggggccaggcccca

SEQ ID NO: 88404 - DNA, 1050 bp, Homo sapiens
ggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagctcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgcacgagttgggtatggacctccttccggttcccggcgtgcgtctttgccgtgggggccccgccttgtgcccacctctgccaggtattttctcggcactcagtcgcctgctagataacctgggcttgcacacggtgctggccccagtgacagtcgctcactctgcccgggctctgcggggggccgtctgcagctgaggcaggctcctggctccctccaggcccgcaagtgaggcaggctccgcaggcgccgtccagggagagccagagccccagctgtgtgccgactccgagtgctccagggttctaggtctcctggcagctcgcccgtggtcccccctcctctgcacccccgagtcctcagaccccatgctgcctccaactgagccttgtgtttccttgcagcgccgatgtggaagtggccagattctgagccgcctgactagagttagtaagttgcctggcgttctcgtgcagtcactggcctctccag

SEQ ID NO: 88405 - DNA, 1028 bp, Homo sapiens
tcacggtgtcgcccgcgcccacgtcccgcttctccatcacgcacgtgtctgactcggacgccgagtccaagagaggtgaggcctgggcggggctgtggcagaagggcacgcgggaggcagggcacggagctccgagggtggggcccctccgtctaggtcctgggccgggccagccccggctccgctccgctccgctccttcccggccccgctccttcccggccccagacctagcctggaccccgcctggccctcgcctggccctcacctgaccctcacctgaccctcacctgaccctcacctgaccctcacctggccctcacctggcccctgcactcggctctcctctgcctgaccctaccccgcagacctgcggcaggccctctcaccggaaccttcccagccagaagtccctgcagacccaggtcccacggtgccccggccccacggtgcccaggtggagccctgctgggggcctgagccaccgctcccggccatggccctccactatccgccccaccccaggctgggctcatctctgccaggtgtccctacccctacagcctctgcccacgtgcctgacaagtgcccacctcctcggagaaggccccctgccagcttcctcttccctagctgtcctggcctgtggctgcagccctgggggaagggcctgtcagcctcacccctggtgcagggtgccccctgtgtggctgaacaagcaggcaggtcaccaggaggccactgcatgaccttggccatccccttcctgttcaggcctcagtttccttatgcgtaaaacaggactcggaggcatttgctgagagttgttggcctgagtccagtgacaggagtgggggaaatgggtccatctctcacctagacacagccagatctgctgcagggaaggggcccggcctgtatgtgggccagggatggaggccaggtgggagttgcgggggaggcagccctggtgtctcagaaccctgtgttcactttgttgtcctgcttgccaggacctgaagctggtgc

SEQ ID NO: 88406 - DNA, 1002 bp, Homo sapiens
cgggggcctgagcaggcaagagatggaggtggagggtctgctgggtgctttggcctggaacgaggcccctgccgggggcacccaggggctgcaggtgtccccatactgcgttcaggtatggactgggagtgcgtggcctcaggccaggtccattgcagattgggaaggggcccttcaggggtttgggcccagagagcactgtgcaccctgctgaccggaggcccacccggatggaatctcactacagggttgcccttgggggctgcccacagccaggtggggctgggagatgggagaagacgtcttcattcccaccctcacacgcccaccctgccccccagccgttgtcacccatggccctgatgctgcccccaccccagttcataccagcatccccaacagacacaccaggctgcgtcattcacttaatgctgcttttcttccattttccttcaaaagctgggtccaccctcacggctgccgcctcttaccggccccaacggcttctgcccaggtgcgtggtcaccccggttaccccatgggagccccttggctggccagggctagtcatggtgctacttcttctttggaattttctcctttttgatcaattcagaaaattctagagcaggagaccaatttaaagtaagtacccctgttttgtgtcccccagttcctgtaggccctttaactctcagaggaggcagagggagtgtgcctggactacacagtccagggggtcctgtccccaagtccttgagcagggaccaggcctccagcccatctggccgggggcggccccacgctggagctgtttgtcctgggcccagctgcttggtcgtcacaagttgaccccagctggggactgggggcttgcagtggcctggctctctgcagagactctcaggaattcccaccagaccctctgagagcaggtgctcattgatgatcatctctcagtggggaaactgaggcacggagcagctggggggcctgagttct

SEQ ID NO: 88407 - DNA, 2921 bp, Homo sapiens
tgctgctgctgtggcatcctgggggctcgtttctgggagtcacatctggctgcttggggttgttgtctgaactgacgctgagtgtgttgctttcagcccatcttttgcgtgggctctggaaggatcaagggtgcctggagcgcatcctctgtggtccgagaacaggcgttgcccctctcgctaggggctgctacacccctgcgccccacgaccagcccactgacactcagatgtaccgagagggacacgcacaacaggggctccccccttagcctctggggccttctgtggggggtggactctgccacggtgacagtcccacacacattctcaccacccatgcccgccgcgaggctacagtccaggctgaccgtgcccgtcacctggtttcacaccctggtgggctgggatgtcaccgagcagccaggcaggctttggcagtggatgcctctgggcccagtagcatgctcccgacgtagccctgtggggcccagggctggacagatgaaactctgggagttttcagaggcttccaggaggctgccagcttaggctctgaatgcctgggcttgggggcccaggccccgccctcagcaacacgcaagtccaactttcccatcccatctggtagcagaaggtggcctcaggttgtcatgggctgtgggtctctgagggaggggaccgtgggctgtgcatcatgacgatctctggtacgcctatgcccacactgggtcctgacaacaggacgtagcgcacccctggacaggggtctggagagggggaaggccccttgctcccctgtggctcagagcctggagccccccaggaccccctgaggctggccctggccccgcgggccggctccgggtggcaacccccaggcagcgcatgtccccccaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccggtaaggacccgccatggctgggtcaccagctggggaggcccacgagctgaggcgcaaggacccgtgtgtgactgggctggagtgaccctgccctccccccacctccagcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgagtgggcgggtgtcaggtgggcagtgggcacccacaggcccctcctgcatgcacgcagccagtcgctggcagccggctcactgccttctgtgcccacccaggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggaggtgggcggcgggggctgcagggctggagacggaggcggggcaggggagcgggcaggacctctgcagctccaagccccaggaggctgtggctgaggaaggccaggagatgcagagacagggccctgtagacagaggctggtgtgggttccatgtttggggcccaggagacctagatctgttttcctccctggtgcttagtctagggtgtcggccatccctgttggggcacccgagtgggtcgggtctgggcctggcgagttctccagggagtcagctcccggggccctgggctgggtggacaggcgctgaaagagctggggcactgtaaggttcccagcgagctccctccacgggggtcctgcatccttcctgtgccatctgctgccacaggctgagaggtgggtgtgggcgaggtgtcccaccccatctgggtaccaggcctccccaggtgtggccagggtcatactccagtggcctgtgttgggtcctgactcacagcaggtgggttgcctggacagctgtctgggccagccacaggagtcgtggtcagcagggctgggaccaggctgaccaggcggctgccccgtgcaccctgtgcactgcaggccactctggggacatggggcgggggccacactgaagcctaccatgtactacccacagggtgaagacagccctcgcgaggaaggaggaggccgtgagcagcctccggacacaacatgaggtgagtccctgtggccagccctgctggacctcggggctgggagcaggcctgaccctgtgggtgtgctgcaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcagcgccttgagtgactgccttgtcttctctcctgggctagaggctgcccaagacccccagagcagccaggcgtgggtttggctctcttcctcccactcccctccgcagcctgagcaggctgaccaggaaatcacgaagcttggccatcagccccccagctagcagccctcaacactcagccagcagcccccagcactcagccagcagcccccctgcactcagccctcagctccccagcattcaacccaacccccaagttcctgttccctgccttgccctggac

SEQ ID NO: 88408 - DNA, 1076 bp, Homo sapiens
tccagctctgaccttggggcccagggacggtctctctcattcactcccttggcctggggtctgaggggtgactgctgctcttgcgtcctgagccctgggggctggggacgtgcccagtggtggtcaggatctgcgggccacagggggcagtggcagcccctcctgcactgtctgcgccaccaggacagcctggaagccaccctctcctatccaccctgttgcctgtcgtggctggtcctccccagatgcagcttggctggtcccccagtctctcctcgaaggtggggtcaggacgaggccctggcgcgagcttgctcaggtcacggagccaggcacctggcaccctcaggccggaggcaggggaggtggataaggccccacgaggcacctgcctcccgccctccatgcccgtggggcaatgctgaacagggtgaggccggcacacgggctgagggaaaagggggcctggacgcggctccacagccacttcccaaagtgccacgagggcctggagctcagggaattgctgcgcttggctgatgggcaagttcctcgtggccttgcctgcccccgggcggtggctttgaggggccttgactgccgagggggaggggcagggccccggagggctgctctccagctgtgagtcaggcctgtggtcggcccgtgcccctgcggtgggtgggtcctgggaccgcccgtcccggcccccgagagccagtcctgaccgtcccgcaggttccagcagcacctggagcaggagcagtgggcgctgcagcagcaacggcagcggctgtacagtgaggtggctgaggagagggagcggctgggccagcaggcagccaggtgccgcccgggggcaccacgccctctcccagggacccctcgctggctgacccctcccccccgccccctcacccgctgacctctcccatccctgactccttactcgatgacccctcacctgctgactcctccctggccgcaggcagcgggcggagctggaagagctgaggcagcagctggaggagagcagctctgcactgacccgagccctgagggctgagtttgagaag

SEQ ID NO: 88409 - DNA, 1050 bp, Homo sapiens
gtgtgagctccctgggggcctcagcctccctggctatgcttcccaccagcttgggcagtgatggtcccgagcccaggttctggagtggggcttggcactggcattttaaaatccctgcacgtgactgtggctgacagccggggttgaggactgccagtcccatggaagaatgcaggctctggggccgtcccgacaggcagcagcacccctctctggggcaaggcctctgcaggctgatggctgccctcccatgtctcaggccaccaaggtgtgtggcagggtgggcctgggcctccagcctggccccgggcgctggggagggcagcagtggctctgtctcggggcagcacacccaaccatgagtgccggccttgtgctggtggacctggaagcccggccctgactgtgcccacagggtggcaaagggacgggggtgtccttcgtgtcgtttcctcctgccctgttctgctcgtaggagattaaaaaactcaaagaattaatgagcgccaccgagaaagcccgccgggagaagtggatcagtgagaaaaccaagaagatcaaggaggtcactgtccgaggtgggccctcccctcccatgagccggccaggtgtggggtgggtgctgcggccagggcttcttttgagagagccataacttcaggcattcatgtagtccgagaccttcctgggcagaggtgaacactcatgccccaaccacccccgtcacggcctccgctgcggcttctgccgtgacccggggggcaggtgggctccacacaggagcctggcccagcccccagcatctaggcagttgcctgaaacgagggggctcagtgcctcacttcctcagggttgggctaggggagattgggagtttgtggacgactgtggcacgtgggccctgccacgggaagcagagtgagccacaggaggaggcaggggcaggcaggcggatggggcaggaggctggtgggtgttgtggtctgaaggggcctcggacccttgggtgatgtgcagggctccccgaggcctggtcctctcgctctggac

SEQ ID NO: 88410 - DNA, 1029 bp, Homo sapiens
ctcccgggttcacaccattctcctgcctcagcctcccgagtagctgggactacaggtgcccgccaccacgcctggctaattttttgtatttttagtagagacggggtttcaccgtgttagccaggatgttctcgatctcctgacctcgtgatccgcccgcctccgcctcccaaagtgctgggattacaggcgtgagccaccacccccggcctgttttaaaatattgagaccgagcagaccccatgtggtgtggttctatttacataaaacaccaagcaaaggcaagtttatcacaggaggtcgaaggctggtgtaggggtggcagagagggctcctccaggggcagtggaacattccagaactgcactgtgctgatggtcacacaactctagatttgctaaaaatcattgacttgtacactgaaaatgggtagattttatagtatggaaattgtacctcagtaaaactgttaattaaaacaacattaaaggcaaagaagatacagaactgaaaaaagccaacaacacccaaagctccaggggctgtgggcggagcctcctgtgatgatgactgttgggggctgtgcccctgccgcttgcccctggggagctggaggggctgtgggcggagcctcctgtgaccatgacagtcgtttcttgtcaggacagtcgcgggggtacctccctgcctggactttcggagcctgctcctggcggagccgtcacctaccctaccgcccagttagggctagggagaccaggcctgtagacgcggtgggtggcacgagggaagggggaccagaagcccgcaaccccttgaagccccccagttctgcccggggcagactgctcccgagctagggctcacacgttctgggttctctgttagtgcctttgctgagagaatccacacatggtcccgagagccaaggtgaagcatttttttttttgcttaatcagttttacttagtataatttgtatacaatagaaggtgcccattgtaagtgtgcagttccatgagattccacc

SEQ ID NO: 88411 - DNA, 1342 bp, Homo sapiens
ccagactgccccctccctcaagtaaggtcttctggggaggccgcggggctgcggggtccgacctcagttagggcatgtagtcagtgcacctggggtccgacctcggtcagggcacgcggtcagttcacacagggttctaccttggtcagggcatgcggtcagtgtgcatggggtccaacctcggtcagggcacgtggtcagtgcacgtaaaaccgcgtggagcagctgtgaaccgggctccccatccacgtccgccgccctcttctgttcttgggtcggcagcttcccacagagagaaaacagcccagatgtggcacagtgaggtctggggctcaccctgaggtggggcccccaggaggaagccaaggcttgtgcagagcccagaaggcgtcacagcgggggtggaccgagcggggcaaaggagcccccgagtccaccaccacatggtcttgcggggattggggatggccttggggttgctcaggggtccctcaggctctggactcctgtgacttttgggaactttctcaatggaattttttttttttttgaaatggagtttcattcttgttgcccaggctggagtgcagtggcatgatctcggcttactgcaacctctgcctcccaggttcaagcgattctcctgcctcagcctcccgtgtagctgggagtacaggtgcccgccaccatgccgagcgaatttttttgtgtttttagtagaaatggggtttcaccatgttggcaaggctggtctcgaactcgtgacctcaggtgatccgcccgctttggcctcccaaagtgctgggattacaggtgtgagccagggcacccagcctctcaatgtaactttagtgagaagtttttaaatgcaaagagctcattatcctgggtaccagtgagtgggaccttgtcagggcacaggtggtccagaggccaggatgtggcacgggagagccggcctcgcacctgccgctgtccccctctgccccggctgccagcctgccagcaccacttccaggctcagtcctgggacttccgggagtgggcacctgctgcctgtgggcagagctgttcccctgggcggtgagacgagggtgttttcttcttacctgtcagcaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtgaccgatcttggggcggtgggggggggcctgagcctagaacacagaggtgggcaggcatcagggt

SEQ ID NO: 88412 - DNA, 1058 bp, Homo sapiens
ccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcac

SEQ ID NO: 88413 - DNA, 1763 bp, Homo sapiens
agggatggagatgatggtgatgatagcggtgatggtggtggtggtggtggaggtgacggtgatgacggtgatgatggaggtgatggtaatggaggggactgtgggagagtgggtcggtgggctcgtgccgccatctggtggtaatgactgagtattacatggagtctagttctccctgcccccagttaggtgtaaatcgcattttgacatatttttgttgtgaatacacatgaaaaatgacagttttctgtgctacttagctgctaatgatcgaacaggaaaaagaaactgctttgactctgccatttggctggaaaatatggtaacagtccagggagagctgccccgctcctggagctgcttggcagtgcagttccctaactgtgccctgctcccagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaaggtgctgggcactggctgggggtgcggatggggaagggcggccccgggtcctcctttgcaggctggacaccctgcggggtggctctcagggctgtgtgtatctttttcccttcagcccagcctaagttctggtcctttttgttttctctgtctttcaattcagatgaatgtcctgcccctcccagagcaacttgtttgcagctgcccctgttgaactttagcatcagctgtgcttggccaggcagcagggaggccggcaggggaggtggtatctgttggcctgtgtcacactgttgggagccagaacccagggaagaacccagttctaattccctgggaagggaaggaggggcctcagcctgaccccatctgtcccccgtgcccttgcagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggtgtcagcctgggctcgtgtcggaagacactcccctcttgggctggggaggctgggcaggggcagcagaatcgatggttcctccctcagtccccagtctctctccctgcaccagattagcatgcaaatggagcgggccccggcagctggtggggacaggaagaggctggtggctgacagctactgtaatatctgtcacacagttgtttgccagaccactaaatgtcaggtgccgcgctgtgctcgtgtgtctgggcgcacacggggggcggcgcggggggcgcctgacaggtaacacgttgttaagtgcccgtct

SEQ ID NO: 88414 - DNA, 1001 bp, Homo sapiens
gctgccctgagacccaaatcgaggcgcgtggtgcagagcagccagagcccccacctccagctgtgctttttatggctgaagtgcagagcgtggacttgtgcactttctacatgtgtggagtgaaagtgagtgttttctcccctgcccctggtgcttctctctgcatttgagtcagcgacgccttgtgtgtctggaggccctgatcacttctccgggggagggtgctacgatccgggcagtgcgcggcccctggtcaggcccctggattttccaagctcaggtgagacgtctggagtgggcttgcattcctcctgctggccggttctgcggctgtattgatctgataactgccgaaatgaaagtcacggggtgctctgaaaccaggtgtctggcacgctggtccgttgaatgaccgcgtcctcaaaggaagttcttaggctgtgcaggaagctgtgctggaagtacagggctggaggctgggctggggctccgtgggcttcccccgccactgaggctgggcagccgctgtgctccccacaggccccccaagttcccggccatcccgtctgtgcagaactccacttacgcccttattcgggattccgagggaactactgaccgttcccttgtctatgtcacacgtcccgtggttggattcccacactccagtggcaggacaagcacgggggagcctggcacccaccctgtcctcggggactgcggcgtccactccgtggtgtctgtggcccagtccccggcagagttctcacagctgccttggggacttcagtgaatgctgtgctgcttccacatgcccagtgcccgctgctgctgctgggtccgtgttcccgccctggctctggcacagaagtgaaaggtgctcacacacactcctggcacgtggcagccacagactgggatttggtcactgcatgcgctgccccctcatggatgaggcatggacccaaggcgctatcacaagtgcccatgcggcctcctcg

SEQ ID NO: 88415 - DNA, 1329 bp, Homo sapiens
cctgtgttttctttcactttcttcaaggcggtttgggatttggctccgctggccgctgtgctggtccatttactggctgctggctttctgcatcccgccctcccccggcccacctagcttcctttgtgcccttgagcccctgccctgggacagccatggccatggccacctggacaccctaggagcacccccctggactcccactccagagtcctcgttcagccccatggcagagcagctctcacctgtgctctggcgtgtgcctggcccaactcccttctccccggctgcacacagatgctccatggccccagcctctcccttgtcgtctcgcccacccctttccagaggcccaggtccctgtgcaggtccctcggatgcgtctgctgcctgtgcagggctgtcatgtccttgcctggctggtggcttgggtccctcccacccctagcagcaccacactcctggcaccaggctgtgggaccgaagccagttttctcatcacacaagtgagaggctgcagtggggaatcgcgccccaggccgcctccttgtctgtgccgactctgatcatgcctgtgcggaggcgccgagatggaggcgccgagatgggccggccgcccaggccagggtgtgtttgtttaactttccctcctcttgacagcgattctctgagcagcctcctccggctgcttgccctgtaaactggctgctttgactctcagcacccgctccctggcgtggagcagcagcctgtcgttctgtagccttggggaatgttcgcatggtgcacgctctggggggtgtcctgagtgggggctgctgcaacgctcctgtcctcagcaacaccaagtcctggcctcagcgctgggacttccagtgtgcagagaatgttgcatgaaggaaggtcagagactctcactgggctgcagagaggtcctagaagtggagccgctggggagggcgtgcctctctcaggtccgctgtgaaatggcctgtttctatacagccaggtgctgcccacctacgacagcctggatgagccgtcagtgaaaaccatgagctccatatttgcttcctcccttaatgtggtcaccaccttctacgtcatggtaagagccttgccacgccctctccgcccctgtgtcatgccagcatgatgtgccgtggtgccccgtgggactgccacaggcatggccctggccctgtgtgctgctgggtttttctctctgttcccatcccagtgtctggaggctgcgcggggacctggggcagctccatcagcttccatcattccaggaccagccctgtgagcctgggtccaccctgggcc

SEQ ID NO: 88416 - DNA, 1750 bp, Homo sapiens
ggggctgggatgtgggtgggaagagctgcactctcctgccactccttcctagcggcgcgtgggccgggatgctgagtcccgcctgcgtcctgacctgccccgtgctctctcccctctccctctgcagatcgtgctctcctctctcaagcacggcctcttcagtgggcagtggctgcggcgggtcagctacgtccgctgggagggcgtcttccgctgcatccccatcttcggcatgtccttcgcctgccagtcgtaagtgtcctgctgtggtctgtggtggagttctgtgacggggagggcgagctgctgggagacgggaccctctctttctcgtttactgtgatcgctctttgctggctgctaaagagtgatgtcttgttcagtgatgacctttcccgccccaggttgagggagatagttatattttaatcgggaggtaaatcggcttcattcctgggacatgtttgggactagctggtgagagtccctggtttgccagatccccacaagcagagcattggctgtgggggatgcagcagcaacccagccatctgactgcacagagtcgagcgcttcgccagaatttagctgttctgagaatatttaaaaggaaatggcacaaacattgacttcagacggctgctggatgcatttggaggcctgcatgtgcgcgcgagcctgctttctctctggcacgcagggctctgtaaatgtggatcgggctcttccataattccagcagcattaccttctccaccaaaatgacaagagcgagtgattcgtgcccggttggaacatggtaaccggctgaaaagagaggcgtaaatccggcgcagacgggaaaagaccatcggcatgcggggggctggcagagcggcccctgtagcgttagtgggcatgcattgagccaatcgtaaactaatgtgacagatgaaatttgttcataccgctgtgtttacacccacatgcgagatccaaatcgtcatttcccacttagcgtctctcttggcagctccatctccaccagaacgcgccccagtcttgctgtttaatatcccattatgatcggtgacagaagccgcattcttccgccacgtacctagttaccagttgccctttgtgtctgcgtgtttgcatatttagaaataaatctgcagctggggctttttggtggtggccacgtagcagccggtgcacctcgttcgggtctggttccggagtcaggtgctgggttgaagcgctggagcgtgcggctcaacaagtgcagctttccttctgtcccgccctgaggatgtgcaggcccacggattcacctgacattctccccagcagggacatccctccttgtgctggccgctgcgctgacctccccacccctgtgccggccgccgtgctgacctccccacctctgaacccaggaatgttttctgagagcagagacatctcttccctcccacagcgtcactgcaccagagtgcctgtccctgttgggtggcgggccgcgccccctgcctgtgtgattggcctggatgccagctggggccaggtctcccttgtgccttcactatctggccgtttttggtaaatgcatacctggttatgcagaatggttgtcctaggcccagagaagcagccgggcagcactgagcccaggaggccctggaggtcagggtctatctggagaccagggtccccatcctcacagtagggcagaggggcacacacccaagagctgcatgtggatggctcc

SEQ ID NO: 88417 - DNA, 1047 bp, Homo sapiens
ttggccaggcacagtggctcacgcctgtaatcccagcactttgggaggctgaggcaggcggatcacagaggtcaggagatcgagaccatcctggctaacacggtgcaaccccgtctctactaaaaatacaaacaattagccgggcgtggctactcggctactcccagctactcgggaggctgaggcaggagaatggcgtgaacctgggaggcggagcttgcagtgagccgagatctcaccattgcactccagcctgggcgacagagtgagactctgtttcaaaaaaaaaaaaaagaaaaaagaaatcacatctgtcattcagcccagccttggggtagtccctggcggcagcccaggtgtgtgccagcttgccctgatggcatttcccgtaccccccgtccctgtgcagcatgatcgggctgatgctgggcacctgcatcgccttctacgtcgtgatcggcgacttggggtccaacttctttgcccggctgttcgggtttcaggtaaggatgtgttcagggttctgggttgttcagatgctgacggctgctctgaggccctctgtgggatcctcccgaggaccgagacctgggtgctggtcgggagaagcttctgtcgagcctgctgtcattctaggggcttggtggagtgcgggggctttgctgggtcacgtctgtgagaggtacacgcgaggaagcaagccaggcagagtctgacaccatgtagatgaggggcgggtgggggagcctcagacccgggcacagtgcagagcaagtctctgccagcccgggctgcccattggagggcagaggcggccaggccctcaggcatccccggcctccatggtcacccagagcttctgggggctgtggactcagcacttcttgcagggaccttggggtagcctcctccgtgcttgccccccaccacagagaggcccacctgacgggcccacacacctttccctcgctgccggggagcagagcccctcactgggcagggcaggcatcacggcacgttagggtgctaacagcgtagaaaggcttt

SEQ ID NO: 88418 - DNA, 1041 bp, Homo sapiens
atttagtgctttggaaaagaaaggctgactgaaacgttaccaagtaggtagaaaaatgaaaacaacatgtatattttgaaacaaagtggcaccagtagtttaattttagattagcttagcaaacactgtgtttttcatattcattatctttggaataaaaatatccaaaaaattttttcagcctgggcaacatagtaagaccccgtctctacaaaaaaaattaaaagttagctgggcatggtggtgcatacctgtagtctcagctgctcgggaggctgaggcagaaggatcacttgagcccaggagtttgagattacagtgagctatgattgcaccactgcactccagcctgggcaacacaacagtaccccatctctaaaaaaaaaacaacttttttttgatcaaggaattttcaaaccctcccgtgcagccctccaggctgttgtgtctgagttgtttgcctgatatggttggtgagcctgtcaggggaagacagggctacatgcctccagagccccccgggcagcatctggtctgggcgtggagaatcccagctttctgccagccacctctgggtgtttctggactgactccatgtcccagtgtccactgtgacttgcctggcagcagaactgcattctggcatgtggagcagtagctggtccttctcctgcaagtcaaagactgttatctttgttttttcaagacggagtctcgctctgtcacccaggctggagtgcagtggtgcagtctcggctcactgcaacctctgcctccagggttcgagtgattctcctgcctcagcctcccaagtagctgggattacaggcatgtgccaccacgccggctaatttatttatttatttatttatttatttgtatttagtagagacagggtttccccatgttggtcaggctggtctcgaactcctgatctcaggtgatccacccacctcggcctcccaaagtgctaggattacaggcgtgagccaccgtgcctggccccaaatgctgtcatctttgatgcctgtcggtgaagtg

SEQ ID NO: 88419 - DNA, 1026 bp, Homo sapiens
gcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacaggtgagtccggtgggcccggagatcaccgccctcgcctcccccgcagagggggcgtctggctgggtcgtcctggttaaagttcccgccggggcagggcttcgctgggcgggtgcaggcggccgcgggcggggcgaccctctgggtcccggcgcagttcccgtagagaatccgtggatgagaagcgcacggcgttggccctggcagcccttgtcagcccgggccggaaagttccccacactcaaaaactcgataccgaagcaaagtgtaacaaagcaaaatgatcctccagaatcggaagggaacggtgggactccgtatttttacattttatcgtgtttttaaaaactctgacccaactgcacctgtcttcagaagcacacaactcaccactcccaggcttcgacactagatagggaccttggttgcaaggtgattaaaaacatccaccaggttatacacctaagatctgcgtttcacaaaaaccgcacatttggcagggggtggtggctcacacctgtaatcccagcactttgggaggccgaggcgagtggatcacctgaggtcaggagttcgagaactgcctgaccaacatgctgaaaccccatctctactgaaaatacaaaaattagccgggggtggtggcacatgcctgtaatcccagatacttgggaggctgagacaggagaatagcttgaacctgggaggcgaaggtttcaatgagccgaaggttgcagtgagccgagatcacgccattgcactccagcctgggcgacagagggagactccgtctcaaaaacaaaaacaaaaaactgcacatttgatctaatgtgtgcagacgttaccacagttggaaaaaatc

SEQ ID NO: 88420 - DNA, 1026 bp, Homo sapiens
acaagcaggatcctttcccacttctgaaagtcttcaaacccagtcaccccaaatgcaaacatcgtgtgaaaccccattaatcaggtaagaaagtagggagagctctgactcagctgcctctaattttgggaggagaaagagaaagtgagtttctctttcatcaagtaccccaaaataacagcgctccttcccttcagcccgctccaaccgcagccttgcctttgttgaaagacccctgtccttcctaggaaggggggcggggaggacaggctcacattccgaagagttctgtccccaaaactgttcgaagattcttttgtttgacgtgcacatgggggaggggaaggagcccgctcaggccacccggcctcctcggaccccgctcaggccacccggcctcctcggaccccgctcaggccacccggcctcctcggaccccgcccaggccacccggcctcctcggaccccgcagaatacccccaaagcccatgggcgtctcctaaccgtgtaagtccggggctccgggggctaggaggggctgctccaagacaagggaagctgcccgccagattggggccaatatcgggctttcccaacccaagcttcctccgaaaacaaccccctcaaaactgagcatccctactagaaaaaatccgcattttccaggaggacggggtgggagagcttcggggaacaaagcccggtcctcccagctctgaggccgaggcagggcgcacctcctcctgggcgaattcaatcggagctgcagaagagacaagcatttccaaactggcacccgctccgagcccaaggtgagggtggagaagggtccctggtggaagctgcaggaacactttgggccggggtctaccccgcgttcggcggctccccgaatcccgcagaaagacacgtttgcagcgaaaggctcttacacaccagccgggattttattcgttccctaccgagagtgcgctctgggagcgcgggaaacaaggaaaacgcacgtacctggcggcgctccgaggg

SEQ ID NO: 88421 - DNA, 1189 bp, Homo sapiens
aaggtccccggctccagcccaagcagggagccaggttgggggtgtgggaaggcagaagtcccagggatcctgggggaggctcaggttgtacctgaaggccacagtctcctcgacagacctcggacgaggttgtaagtgttttaaagaaactagagcagcagagaagagagactcagaagcccgtggcacggctttctcggcgtcccctccagcgagggggtctccattgctgcagttgccggttttgtccaaccaggtcaggaggctgcccggccccctccccactctcaaagttgcttgttaaacacagagtcgtaatttgtggctaaatataactagtgtgttctcacggaaagtataattcagggtgctcattgtatgaggttatcaacaagacccatctgggttaaattaaagtgattttcataaagggcagaagcgcccctttgcctggtttcccctgcctttttattagtgacagtgttattgttgcaattattagaggggatcaaggaaggtgggagttgccagggacccccaggctgaggagggagcctcccagcccccctccactcaccattgtcctgctgcccctccagccccctggtcactgtcacctctgcggctggagggctggagaaaggcccaggagcccagggaacctccaccatgccaggctgccttccctaaaggccggctccttccccccaggcagccagtctgggggtggacctggaggggcagggttctctgggaatctctgggccaagggatgcgctttggggatctgctggaataaagagtaatcggttttccttacaggaggttgacccgaaacagccctccgtcttcctgcccatgaggatgaggacaggaagccagacccgggagagaaagcccagatcagacagatgggggttgggagggcctagtggctgaaactgccctgcttggggacaatgctcaggcaggaccaatccaaacgagggcactgcttatgtggtccttccggagcatcctccaaggcagagcctggcttcgggccctccctgcaaggacacctgcctccactccctgccagaccaggcctggctgcagaggcggaggggcggcagggctgcctgtctccactgtttggcggtgtttacacgtgtcgctgtcagggtgtctggacagtgggggtcggggg

SEQ ID NO: 88422 - DNA, 1056 bp, Homo sapiens
tcaaatcccccaagtgctggtcccttcgtgtccccgaaagaggctgctcgcgtgggcaaaggccccgaggcgtcgagtgcgccttccagggcagtgcggaagctccctgccctcctccttcctccccacttctgcctcctcctcccccagtgttcacttgaagcaaattctagtgggctttttttttttcaatactgtttcaaaacagttgttacagcaaataactgcagacgggtctgctggacgcggtggagaggggctggcagctgcccagcacaggcgcctggccgctgggcagctcccgcaataccaaaataagctcccgagttcccctggaagacttgggccgccgggagctcaggctggcgatctgctcagaggaaacctccctactttccttttttactcttcctgctgtccagagctaacaaatgtttttaatttcagaggaacatggtgtggggatctgcagacttgccttccactggggagagggccagcgaggggacagagggggaggaaaggagaggggataatagacccgaggtcagtgttgatgctggagggcccaggtctctgaagttcctgcagctttgcaggtgagcgggctgcaagtgaggctaggcctgtggacacccagtggggcctggaacagtgccaggagtggccttgaaccccaccttgatccctctccagcaggatctggagtcacttccatgggcctggcatacaccactccagatttgccctctggcctggggagcagataaccccccgccccacataaccagctgcgctcctacacctagcaggccggctcacatcaccctttaacgcacactatattcacacacacacttgtgcacagtcttgaatgtgtgcccacacatctgcctgcacacactcatgtgcccacatgtgaatcacttggaagtgtacacaaaaccaaacccacagcacagatgggcagacaggtgagcctcgtgcagcatgtgacactcccacatgcacaagacatgtgtgcagaggcatatcacacacgcagaagcactcccg

SEQ ID NO: 88423 - DNA, 1924 bp, Homo sapiens
ttagagtggtgtgtgcgccgggcgagcgttaatagggactgctggtgtaagacgagcaaatcctgtttctatataaagccttaaagtgtcagggcgagaatgggtttgcagggatgcatttgccttaacgagtgcctctggtatcccgctaaagccggacaaagcgtggccagagtgcggcccagcctctcagcctgcggcccggggaggagggcagcgcgggcgcgggctgggggtggcgcggggcggcgctcaggatttcggtgcaggcgagagtgcggcggatttgctccaagaggagagcgaggcggatttgctccaagaggagagcgtggggcgccgtgctgggcctcgcagggacggatcctctcgggcggtcccctctgactccctgcccgagaggatcagtccttggcagagcgggcccaggcctccagggcagccctcttcccggtggctttgatatgagtgtcgagggaggtcagggtaggggcagctaccacgcctgaagccctagaggtcaccaggcggcgcgggtagattcgggggaagcgcgcagggctgcgctagggacccgccgggtcaccctggtacatgggtggcttttgtttacagtttgttctaaacatcagaaatgtttgtcgcttttaaaaacaaaattggcagtaacagttattattggtagcttgatgaactgtgaatactaataaaattatatctgctttaatgggattacaattagtgtgtggattaaaacggatggcagagacggggctagaaaggaaaacgtcggaaaaagggagggcactcaaagaaaaacgtacattttctagaaaaaaacaaacttgaaattgcttaattgctaacgggcttccagcatttgcagcgccaggagattggaatgggggagccgcccagtggaggggtctccccagcacttcccgggttggcccacacccgcttccctccctgcctgggcctttggcgaggctgcccttttctctctgttgcccttccttctttttctccctttcttttttctcctctagatttgtaactggaaagagaaggagaaaaagcacttgcctgagcgatgggtgatttaaaaatatctcttctgctgtccctgtggttatcaagcttgtcttcctgcccctgcatgggagctgctgcccacccggctcaggtgcacggggcgctgaggctggggccgccctggcagaagggacagctcgccagcctccccaccagcccctcttctggctgaaggctggtggcccccactgggggtagggggattgtgtgcaccccacctccactgtaccgtgccctccagcctggcaagtaacagcacgacagagacaggggcccctgacactgaggcttgcatgttggtgcacaggcaggctggggctgtcccctccgggaggcaaggccaaattccccatcaggtcaggtcagcactctccctgaccccatgccccagctcacatcctggccaggtccaggccagctgcattctcccccttctgcccttacttccaggtctaggcagcacccgggtaggtgggcgcctggtcgggtggcctagccctttgtcttgctcattctaagtttggccacgtggttcttggcgtgtaggccccggagggctgtgagaaacggctctgggctctggcctggcctgtgtcctccctgcttcttcttgatcccaggtcctcccagcctccccaagcgcagggtgctctagagggcgctggaggcccctcggggctgcctctttcagggtctgaagggtcatgtgtccccgtccctggaggccccatttcctcccccctgcggaccgaagagaacgcttgtgctcggagatgttcaacccatttgtgatgggcaacttggtcatgcagacatccagctagaagca

SEQ ID NO: 88424 - DNA, 1095 bp, Homo sapiens
cggcttcctccccgcgctttcccggaatgaggaatgtggggcagggccagcaggggggctgctcctccttcctgcctcccctcccgtcctgcacagctcccttgggagcctggctcgtgggaagtgtgcttgggaccgcccatcactccgttcccagccactcctggtgtcccccgcctgggcgggccctgtggggagcggggaaggtgtggagcggaagccagtgccgagggaagaggggagcctgagtgggtgtgggtcgggggtgggagctgacgcaggcggcgggtgcagccgccagactcggagccggggaggcccatgccagcagcccggcagctgggcttccggaagcagcgggagccgggagcctgggaagggcctcgctgcttctctggagctgccgccatctcaacgaggcgtttttttttttttttttttttacaacccatttcacagtttccagaaaaggaggatgctgtctcggcggctcacttaactcaaaacaaatgctcgctctgccggctccgcgcccgcctctcccggctcccgggccctgccgtcctcttgttccgtctgccttcagtctggtgccacagggcggagcagggtcagcctggcaggagagtggggtggggcacagtgggcacctggccatccgattgcccaggcccagcctctgctgtgtgggtcctcgggaccctggatgggggctgctggcacggctgctggaccgacccttacagagggagtggctctccggggagtcctgggctccagggccccagcatgctctgtacccctcaggctgcccagcatgtgttgcccttcttagccatccatggcaaggagcctggaagacaggttggcaggaggcaggctagttcccatcggctgtcctggccacttagggccacctctgctgtaagcccatgtggccagctctcacctactgtgtgccggcctccccacacagcacccctgggccggggccaggctcactgggcaccgagactccagcccagctgttgtgcagctgttccccagtcttcccgctgctgggccaccctgggacagcaggtccaggcacagcct

SEQ ID NO: 88425 - DNA, 1048 bp, Homo sapiens
acagccagccgctcggccctcacgttcaggcagctgctaaggcaggccggccggcactggcaccacctgcactgcacggagggctggggctggggctgggcgggtctgagtctcagagctctgccagtggcctggggtcttgctggggaaccagaagccacactccttgtggctggtgtccctggtgtccagcagacatgctctctgcagcccctgggctgggttctggtgcctgcaggcctcccaggccatgctcagccctgtcctgacctgccagctgtgcttcatcccttgggtgggggcaagtgtgccccacacagccagagctgtcccaaggcccagggccagccgcgtgggtggctgggtgtggctggctttcctgtgctgggcaggggcaggccgctcagaaatgtggctgccttgagggacagacagaccccttagccaagagaggggcctgtctggcatgactcggagtcaccgcctggggttttggggctggggcctgtgcaaggaactctttgcccccgtcccttccccaccctgtgcagatctcagagccggaagaggcctggccatggtgggaactcggcgtcggatggacacacctgtgacctccagccagggtcgggggaggctggccacaccccagcagcactggcccctggcctgggctgtccactgggccctggggcctgccttggggaggccaagtccgggcctggttctcctttggccagggccttggcgcagagtctgtccaccgtgccccctcctcccacaaaacctccccagagtcccttttgttgcccagcctgggagcttccgcgatcctgagtgctgctaggagggaacagaggccccctcgtccgtcctcccctctccccagcccatcagcaattcaatttgtgccgcaccggagggatggcattagtggagtcagagttaatatgatgtattgatgggttgatttccccccggcggctgcgtgctgggctctgcgggacatcgctcctgggctgcctgccggcttcttgcctccctgggg

SEQ ID NO: 88426 - DNA, 1092 bp, Homo sapiens
gggctgcacgaggcccagcccccagcccccagccccccagccccgtgtcctggtggacagaggggctgctcaccccattggcagcaggcatccctgaagaagggatgcagactttgtctttgctgagaagtcagagccggtggggccttggggaagaggaagctcaggcccagcagagccgagtcctggtgccagcgagtcccctcagggtaccggagagggcctggctggaggtgggatgggtgtgggtccttatctccaagttgggtttcctctggtagggcgacatctcatttgcattttaaaaagttctccttggggtgacaccaggaggctggagcaggaagccatcggttagttaccaggttccagtgagaagcgatacaggtgtggggccccacaggggccggcatcggtgatatctaggagggagattgggggcagggagggatagaggggtctaggtggcccccggtttctggcctgggctatgggagggtgcacctggggagcagcagttggacggtggggtgagttctgcttcagtgcagaggggctggggcgtctccccaaggggatccgagaggtgtctggacacacggggtggggtcagtggggaggggtggactgggaggttgtcccgactgtggagagggacgcccaggctgtgggggatgagaagggaggtggggacagatggtttccgcacagctcctgggagcccgggagcccaggagccctggcgtttagggctggagctcagggtgggggcagaggagaggcccagaaaggcccccacagggcctgggaggcggactagacaccctgaagggaacagagggaggggaccccagtgagcctgtgctcatgagtggccatgatgaccccaactctgagtgtgagctgtggggtagggacccgaggccagtctgcccaccctctcttggctgcccctcagccccttctccccacctcatactcactccaggacctctgtgtggcctgcacttcctcgcctgcaggagcccgagatttgctaaggctcaggagggccttggccttgcccttgtcagccagctgcaggggagcagg

SEQ ID NO: 88427 - DNA, 1029 bp, Homo sapiens
gccgcccagttccaggtaccgcccctagccacgctcacctgggccgggcacttctccccaaccctgcctggccggacctggctccaggagacccctgcatgcctggcctctggcaggatgaacccaagcagggggcccactggggtcaggggatcctgagcctgaccgagcttgcccccatccctgacagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccaggtgagagtagccgcctggcccggcccactgtgctccgctccaagccctcccacccctgcccggcagggctgcgctgaatccgggctgcctgcagggaggcgccacacctgcccagacccagggcagcatggctgttcccttcctctctcttccctcttcccagtcctcccaatgaccttgggagaagcacacagtgccccagccgcccccttcctggccgtgggctgacgaaggcgggaggaagacggggtcccgctggctgtcgtaggggccctccagcaatgaaggcggggcctgctggtggtggtactggcaccctgggggcactgggcatgggacttgaccaggctgccattcagggtctcagcaaagctgggagagggaggggcagcgaggcggggtgcctgggtgggggggtctcgggcctggcctcggcccctgccacccgcccatccactccccaccagcctatttgattctctctgagtgggactgagaggtcacactggaa

SEQ ID NO: 88428 - DNA, 1048 bp, Homo sapiens
gcctggccagctcctacgcgcccttcgtcggggggaccgggccgggcctccccaggggagcccacaagctgctgcgggctaagaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacaggtaggtccagcgggaggcgggaggagctcctggttcccaaggaaaccggggcgggctcatgcgcccctgctgcccttccctctcctttttcatcttcctacttgatttcaagttaaaaaatgtggaaaactcaagggaagaac

SEQ ID NO: 88429 - DNA, 2041 bp, Homo sapiens
gcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggttggggcagggccgaggcttccccgcgggagggcattaggtggctgtggggaggggaccgtgttacagacgcgcccgcctgagtccatccttttccgggcaggtcgcaatggaagaagagatcgccgcgctggtcattgacaatggctccggcatgtgcaaagctggttttgctggggacgacgctccccgagccgtgtttccttccatcgtcgggcgccccagacaccaggtgagtggatggcgccgcggggctcctgggttctgcgttgcggggtgggttcggtgtcgccggcgaggctgacgggtcgtcccctgcagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcaggtgaggctcggccgacgcccgtgctcctcccgtcctttccccagtcattttctgcccggcttgatttctgacatttaagtgtttctttcgctgttccaggctctgttcctctcccggcatttcctccctgaagcctccaggtttctcatttggtttctgcctgcgttcttttcttttctccacacatcacactggcatgcagcatgttgtggcgtgtgagcatggggtggccgtgggtctctgtccctgactaagccgccccttgtcccttctcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtaggtgttgtgagctaaaggtttctactcttacatcctcggtgacacagcatcactaagggagggctctgtcccctaggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaaggtgagtcgaggggttggtggccctctgcctggctcgggagagctgactggggggcgctctgtgagctgaagccgtgcctggctgtctttgcagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctca

SEQ ID NO: 88430 - DNA, 1095 bp, Homo sapiens
tcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccagccggggcagtacccagcactgtgcactattttcagggccactcagggtggcgctgtggcccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcaccccttcccaccctctctcactgggctccttccagagccctggcgctgcttgggagccctcaccaccggggtggcctctgaggaagacgcgtccctgtgacccagttacccctgaggagggctctgctgcaagggggtgtctgggaggcctggggcccctgcctggctctcccctgcgttcctctctgtggagtgggaggggcctgtggggtgctcctagtcagggtttgtctccctcagtggttgccacatctaagggagcacggccgccctgatgacactccaaacccggcctcttcagcgggtggagacagtccaaacccagcattttcagtgggtggtgacactccaaacccagccttttcaatggggccatggccccgtgcttgctgggagagctggggccaagcgagccacccaccgaggcaggcctgcaccccttaacggtcc

SEQ ID NO: 88431 - DNA, 2083 bp, Homo sapiens
ctgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggccgatgctgccaccacccagccttctctttattttcagtgctttttgtttggcctccctgcccccatgtttttctggctgggagctcttggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcatggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcata

SEQ ID NO: 88432 - DNA, 1068 bp, Homo sapiens
ttgtccccctcatttgtcctatgggcagagtgtaggcagcagcttttcacaagaagcttgttgatagaaagattaattttttcacctttagcatttccattgagtgtctgcacctctgtgaggaagtacggtttcatctgttacaatcgaatgggaagcagaggtgatttagctctgcctccagcattagagttagacagtttaaaaaattcctgttctaacagtttcagagtcacagcctctgctttttactcatatctcccctcctcctaaatcaactctggttttattgccttggcccagaaggcttggccagcttccagaccccaagctcacagctgcacagttggcatttttaagagacaccgttgggggagaagagggcgagtgctttgcagaagtggctgctctgggtagtgggggccagtgggcagcagcccccaggaggttcttgccgtgtgtaggggtccgactttggctttttcttcactgttcaagccaacaggaaatgccaaagagaaaggagcaaattctttctgagctgctccgccactgactcagaacttttccctgaaggagacagaatagagaggctcctcctcccccggcctttctctgtcaggaagcctatagctgttcttgtatcctgctagtttattttgtgtctgtattttgtctcaaaaccactcactcgggtatttgacatcaggcaccctgtgcctcttccctgcctgtgccttccctagtcagcccagggaactgcacctcctgctccgaggttcagctgctgcccatctgtctggacaggtggtgaaaggtgaggctccctctacaccagagccaccttgctagtatactgcactatttttgcagtcatctgttggaagacattctctggaggtactgagagctcctgaaggctttatccgtttctcatatatgaattatttttttttaagacggagtctcgctctgttgcccagaccggagtgcattggcgcaatcttggcttactgcaacctccgccttctgggttcaagcgattctcccgcctcagcctcccgagta

SEQ ID NO: 88433 - DNA, 1429 bp, Homo sapiens
gggaggcggagcttgcagtgagccgagaccgcgccactgcactccagcctgggcgacagagcgagactccctctcaaaaaaaaagaaaagtaaccgagtgtctgaaagctttgttttttctgagttatcctgtggcggctcagatcctggtgtcatttgtgccccttcttgccagttcttagaaaagcagcacattcaggatttcatttaccttttctaaagcagggttgatgccattcaatcaatggaattcactgttgtcctggcataaagcccacatgcttttgtgtttgtgtgtgtgtgtgtgtgtgtgtgtttgtttgtttgtttggagacagtcttgtagagacggagtttcaccacgttgtccagtctggtctcaaactcccgacctcaagccgtctgcccacctcggcctcccaaagcgctgggattacaggcatgagccactgtgccctgggcatccccattgcttttgagctaacaaagacatcgatccctggatttctcttggtgtcaagaccttggcgccactgcttccagaagtggcctctggcgggtggcgaggtgttggggccacaacctccgacctcctggtgcctcgctccaggtggagataaagctgctgacactttgacggctgccaaacttagaattaagacaacctcctcccagcgcattccaactgacattttctaaggcccataaaaagtaattgccttttaaaatggtgtgtaggcctagggattggctggcgaaaacatctgagtgaaggcttgggggagaggtagaagtgacctgtttccccagggaggaaagggggatacaacacctttattttcttggggagtggaaaagatgcagttgggtagttaagtttgaaagagaatagcatgacacaaaaaagagagaggggcatttaacaagaaaaatccctagagggggagattaaagtgaacaggtgctggaaaaatgtttctgcatattagagcttaattagatttgaagatgaattccagatgggctaattatgtgtgagttgttgcaggtttatttcttgtaggggcaagcctgtatttttggaaatggtgatttagtttgactggatttgatttttgcctcctaccaaatctccattgagaaaccacctcttttggggccccaggaccccgtgcagtaggccctgtgtctttagcgcccccatcacagccagcagagcgcagaatgcggaagcccatcctgactggcagccactcgtcacgtggaaggaggacacacgaccctcacccaagtcggtggaaagtcatttcagtgtccaaggaaggcaaacagagcagagctgtgtatttgcaggaatgtagcctttgatggggcggggagcaatacgtgaaatggaaatagagtccaggttcattctcctgccctcctg

SEQ ID NO: 88434 - DNA, 1056 bp, Homo sapiens
tgggcagttcattatagcagtgagaaaacggaccagtcgtaccgtttatctgttgagagcttcccgtgggtcaggtgttaggcctggggcgccacggtgagcaggtccctcatggtccctcttcttggaaactgtggaggtgtcctgttggggagcagggtgcgccgaggtggccattcacagtgctgagactagagtgtgtgagaggaagccacgcggagtggaatctgctgaagctatgtacctggagagcacagcatgcacccggcggggccagtctagctggagtggcttgtggtggacagtgggaggccatggaaagacttatggaaagtgagttctggaatgttcctgctggaggtgtcaggaggggtggtctggaggcgggaagcttttgcaacaatccaggcattggatgccagtagcctgagtcaggagaaggcagcaagtttagaggagtgagtggggctgaaatccaggtaggagaggcagtggacaggtgctgacagccggatggggtgggcaggggaggtccccgctgtagaagacccatcctgggctgcagtgtggggaacggtttggagttggggagcccagtgagaagctggtggtgttggcaatccaggccacatgtcagttccctgtggccttggggacaaggatggtgtgctgggactgagaggtttggaggcctggcaggtgtgcagagaggagcacaggctcaagccaggttcctggttttggggagcagggttggcactggtgccagagtagagccatgggtctgtgtgggaggatggtgagtccaggtgccagcacgcagagtttgaagatggagcaggacagacggttgccaggactcaggtctggaagctcaggcaagagatacaggccaatagttcccttttcagactatctgtggagaaagcctaaattaacccagaagtagatgagccaagccgtggttcagagggagaagagaagagtgcgttgagctaacccggaagtagatgagccaagctgtggttcagagggagaaaagaagagggcgttgag

SEQ ID NO: 88435 - DNA, 1004 bp, Homo sapiens
tatttgtctgaggctgctgtttatcatgttgttgtctctggcaataaaaatgggaaacaattgaaaagccctgtcccaagggcatattaagttacagctggactctgggatagcatgtggttactaaaggtatgtgtttgcaaattatttaaagataaggggtaaaacttagaaagcaaaattaaaaatgcatctatacctagagtataataccaattttttttgttattttcttgaagacacgtataggcatttgcacatggatgtggacatacatttacatgcactcacacatggggtgggagtagaagcttcctgactgtccttcaggagggaggagagtctacagctttgccctgtcccatatgcagccagtaagagaacgaggaagagccttgtggacagatgaggggagctgtgcagatgctggccttggagaagtgatttgaaggcacatttgtgtcatcgttcacgtgtagttttttaggaaagcatatgggtgtacacatagtcctgtgaggaccaggagcttcccgagggactagggccagccagcctcactcatctctggggcagccaggtggcaggacgtggggcttttctctttcacctttcttgtgaaagggaacatttgtcccctgcagaaaaacatgaagaaaacatatttaatgataactactctttgcatctggtagagttcttgtttccttttctattcttttaacttcaaaacaaagacttgtaattatggagaataaatgagtgcatttattgactatatggccaaatcagaatgtatttaattggtcttgtgttgatggcctttggttcttcctggttgttacagaaagtgccacatttaacaccctatacatcctcctgtgacatctttgtatatcttcaaaatagaattgctggggaggaaggtttttcgagttttgatagatatttccaagtcgctcactgaaaagtcacactaacatctctcttgataattaggaaga

SEQ ID NO: 88436 - DNA, 1070 bp, Homo sapiens
aacatcctgtttctaacaaggagtcagcatcttgatttaggggcatatttgggttcaaattctggaagttctcttgtttaaaagagattggtccaattttttgacctaatttgttataatcttacagttcataatcttgaaattacttaaataattttctgcaagacacaagtttctctttttattttattttattttttttttttgaggagtcttgctctttcacccaggctggagtgcagtggcacgatcttggctcactgcaacctctgcctcccgggttcaagtgattctcctgcctcagcctcccaagtagctgggattacaggcacccgccacaacgcccagttaatttttgtatttttaatagagacgatgtttcaccatgttggccaggctggtcttgaactctcgacctcaggtgatccacccgccttggtctcccaaagttctgggattatgggcgtgagccaccgtgcctggcctaaaatatgagtttctaagccctaatttttctcagtttgattttgattttgctttatttactgcataattaaccctttaagtttcattttctctgttgccaccaccttgggtttttcattcattggggcatctttaaagacagtgaaagtctcccagtgggctagtcatgtctgctgggggtggatgggaagagttgtgtgtcaggtagtgctggagagggtcatgggccgcagatccttcccgaggacagaagtgacaattgccgggactcaactgctgctcctgtggcctcgtgacgggcttctggtgcaggaattcacaggcagaggcgggcctaaggatcacacagcacacaggcactgctacactgaacgtgcaggggttgctgggtcacaggtttcagatcctcataccctcagatgcttccttccggccttgaggtggagctcccaggagcagctgtgtgaagtctgcattatattaccccttttgtattatgtgcctttctctaggaatcctttttcttagcttgtcaggaaagacctactctctgaaatgtttatttgcttgcttgttgtctgtct

SEQ ID NO: 88437 - DNA, 1146 bp, Homo sapiens
cactgcgagctccacctcccgggttcacgccattctcctgcctcagcctcccgagtaactgagactacaggcgcccgccaccacgcctggctctggctaattttttgtatttttataaaatacaaaaaaaatagagacgggatttcatcatgttggtcaggatggtcttgatctcctgacctcatgatccgcccgccttggcctcccaaagtgctgggattacaggcgtgagccactgcgcccagcccagatgtttattttttaagatacaaggggtctcactctgtcacccaggctggacttgaactcctgggcttaagcgatcctctagcctcggcctcctgagtatctgggaccacaggcatgcaccatcacaccctattggtttgttttttaaagaactaggtaaaagatatttatgaatggtttgtgttagaaaaacaagtgatttctttttgatggcatgttttcatcagcccactcttgttaactctacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcaggtaaacatgacgggattcaagttcctgagtttctgtgtttggaggctgtgggggacgccctttcggagaggccttgccctgttcgctttgttgtttgttccccctttgtcacacaccggtgcacgtgcacaacattttctgagttattggagagtgagatcatggctcctaaaaccttcagtgtatgttactaaggataaggatattttcttacacaaccggtacatttgccactattgatccagtgtttttatctcgtctgctgtgtccaggtttgctcattgactctgtagtgtccaggtgctcagtccttgtgtcattctgtgtctcttccaccatgcagcagtcactgtcttaggaaccatggagaaggccacagacacacctcagcaccaatcaccagagtgtcaccagagtaacaaaaactgccaccaaaataggactgataacaatttaagatttgtttgg

SEQ ID NO: 88438 - DNA, 1120 bp, Homo sapiens
caacagtagtttttattttagcctaaagcagagtaaagatgccttaattatatatcctaatcagatttttcccatgaataagaattttttacaaatatctaagtactgggctaatgtcaaagtttctgacaatttaatgaaacctgtaggagcctcatgcccgctcagtggcacaggtgagatcagtagatattctacagtattcttgaaagctttctcggatgttagtgatagatggtaaaaaacaccacagtttggtaggaaagtagttgtgtgttcctgtatggttgaagtatgtgggacagaagctgggattcggaatgtgctggaactgtaggtagagcttccattagaatcatccttagcccatcttccctgctgctgccacgtgcttagctcctgagacactgttcaggaggtataagatacttagcatgtcatttccagcctcttgctcaacttttcaccaatgtgatgtttaagttgcttctcttctatgtagggggaagtttgttgccctggagaacatcagctgcaagattaagtcagggtgcgaggggcacctcccgtggccgaatggcatctgtactaagtgccagccgagcgccatcacgctgaacagacaggtgagatgttccctgtctgtctagatttgttttcatggctgagaaacggatatttccagaagagccccttggagtggaatgctattagcactatgcgtggtggattttcagtactttttgatggactgaatgatccttttgtggaagtggtacactgaatatatcatttttaaggcttcttgctcttggagatatggagtgcgcgccctcagttctctgttttgctggctcatatggaggcagaatgttcctgatgattatttaaaatcctcagtggttgtgaggaaactggctctgaaggttggtaaaggggcaccccttggaccagctctgagcacctgtccaggctggcttaaggagagaatgtggctcaggaaggagggagcgttccggcctttctggatgttctgctgtccttgtcccgcctctgagtagcctgcctcgccttcctcctgccgctgtgcccttagagaaaacggctccttagagagaat

SEQ ID NO: 88439 - DNA, 1250 bp, Homo sapiens
ggggattcaccatgttggtcaggctggtctcgaactcctaacctcaggtgatactcccacctcatcctcccaaagtgctgggattacaggcatgagccaccacgcctggcctggaattgggtttttacaattgaattcaaaaatggaaattgaacttttcaaacatagccattggccatgcatggtggctcacgcctgtaatcccagtactttgggaggccaaggtgggcggatcacctgaggtcaggagtttgagaccaccgtggccaacatggtgaaactccatctctactaaaaatacaaaaatcagccgggtgtggtggcaggcgcctgtaatcccagctacttgggaggctgaggcaggagaatcactggaacctgggatgtggaggttgcagtaagccgagatcatgccactgtactccagcttgggctacagaacgagactgtctgaaaacaaaacaaggatagccattaactcttgtttgcttcaaagtcttaaatgttttacaaagtttcatcattgacaagacctttgcttttttggccactttattcattttaattgacacctttgtgaacagtacaaatttctttaaaagagcaaaatagcaagaggaatttggtaaatgatgggcactttccaaatttggtgaatactcttctagtagtgtctggtgtgtatggtatgtgtagtgatactttagcatttcattaaatttctgttctttgggccttgttttaggttgcaaaggagtttggcttccaaaataatggcttctcggtttacatcaatagaaacaagaccggagagataacagcctcctccaacaaatccctcaacttgctaaaaatcaagtaagtgtcctctgaggaggaagcagggaatggggggaaatgaggtccccatgatctgcccgaggttgccgagttttatcctctttcctcatcacaccactcattatggtcttatcaactgaccagaatacacatgaccgtgttgcttgccaggaattcagtaattatcctgaatctgcagttaccattgagcagatttgattgactttgcagaattctggaatttgtgtcactgaggagaaagttattgtctttgtccatgtacggcgtggagtgagctgcatactcagctgcttgtctggagtgaaagaccttgaacacagctgtgtgccgggaaatcatgttagccctgctggcttgggtaggagtgctgccactgcagtggcccatgc

SEQ ID NO: 88440 - DNA, 1097 bp, Homo sapiens
taaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctgtccccagactggatgagcagggcctgcagatggccgagtgttctgtatcttagagtggtgctattggggttggctcacctccttcctggagacctgctggactgcccccaaggcgtatggactgcacagtgccactgaaacctggcctcttgctgtagcacaacctccaacctgctgagccgctggtaccctgaccctgcatctgccacagacggcatgaggcaggtgaagtgagtgtggtagtaagagccaggcctcgagttagaaacaagctggtggccggacgcagtggctcacgcctgtaatcccagcactttgggaggctgaggcaggcagatcaccagatcaggagttcgagaccagactggccaacatggtgaaaccctgtcactactaaaaatacaaaaaattagctgggcgtggtggcttatgcctgtaatcccagctactcgggaggctgaggcaggagaatcgcttgaacctagaaggcagaggttgcagtgagctgagatcgcgccattgcactccagcgtgggtgacgagcaaaactcggtctcaaaaaaaaaaaaaaaaacaagagccagcattctcactggttcacttgttcagtgaacaggtattgccgtgaaacgccccacaggtgtgccaggtggggctcagatgaagcacaggaaatggtg

SEQ ID NO: 88441 - DNA, 1050 bp, Homo sapiens
cggaagaccccgcctcctcgcggctctagggccggcgcggtgacgtgcgcgtgcgcgcactggagggaaaaggcggaagcggaagtcggggggcgcgccagctcgtagcaggggagcgcccgcggcgtcgggtttgggctggaggtcgccatggggcgaggcagcggcaccttcgagcgtctcctaggtaacgcgtccccacccgacggctcggccttggtcagcccgcagcctccgcccggcgctgagtcagcgcggccccgagggcccgaggggcgcggaccggccgccctgcccgcctctccccggcccgctgtcctcccgggttcggagccgccgatcctggaccctcggcgcggccgtggggtcggcgtccgtcgggcgttggcaaatggggctctgcgagggtccgcgcagggcgccaggggcgctcggcgacctcgctcctccgcgggcccgggcattcggccgatttcctcttgaccgacgagcacccggccgagtgggccacaaggcctgagtcatgaaagtgggtgactcagtcggatgttaggctcgcacttgggcttctgacccaaaacactgggcctcgaagggtggagccggcagtgttctctctgggaccttcgagctctcttgggggctgcgggtcccagacccaccttttgttcccacactggcttcgggaagtgcctaatggtttaggaaggcgttttctcacgtttttggaggtgaaagctgatcctatctgagcctcctggaattgacgcgttttgggagggaaacgaatgttgatgtgcacgtgcccagcagcacgtggaaaatgcgtctaatgtttgggggtaggagcttgggtggtcgaatgggctgcccaagcttgcctttttgtcaagtagggttttcaaggagacttcaagtgagacaccttccttgccaagggaaccagcaagcagactgagtatctcagccacacaggtagttcagtgcttcagggatgaatccagaggttaactactgaatcagtatagaaagtggacgtggcttggcttg

SEQ ID NO: 88442 - DNA, 1022 bp, Homo sapiens
aatgaattgagcccgggaagtggaggttgcagtgagccgaggttgcaccaccacactctagcctgagcaacagagtgaaactccatctcaaaaaaaatgtagaaatgaggtctttctgtgttgcccaagctgacctcaaactcctgacctcgagtgatccgcccttctcggccttccaaagtgctgggattacaggtgtgagccaccgtgcccagccccgttactttgatgctcaaagtttcccaggtgtggccatgggaggcgtcagtggcttctctgttgcgtagggccattggtttgggttgctcctgagtttctgttgctagatactctgtgctcgtcttgtatgttctcaaccctggaagcagccatttctccaaggagcccttgttccctttagtggagggtggtctggatcttggttagaagccaagatcaagattctgggtgtgctcacagctctaggttgttagcagacagagctggaaagtgtgtatgtgaatacaagtgcacagttgtgggtgcgtctgtgtatgtgcgaatacatgcgtctttgtatatgataaaaaccgtgagtgcagccaggtgcggtggctcatgcctgtaatcccaacactttgggaggccaaggcgcgtggctcacctgaggtcaggagttggagactggcctggccaacatggtgaaaccccgtctactaaaaatacaaaaattagccaggcgtgatggtgcacacctgtaatcccagctacttgggaggctgaggcaagagaatcactggaacctgggaggtggaacttgcagtgagccaagatcatgccattgccctccagcctgggtgacagagcgagactccgtctcaaaaaaaaaaaaaaaatccatgagttaattccagtacttgcaattttaatccaatagcacagttttcttttgcattgttttcaatatactcaattgctcagccctagaatacacaaaaagtagttttaagaatgctaacctggcccactgtggagacgatgcc

SEQ ID NO: 88443 - DNA, 1078 bp, Homo sapiens
gccgtggaaagcgccggggtcggccccagatgaccttggacgattccctgctcctcccttggcctcagccttttccgcagcaaaggcccatccgtgggtgcggcgttttgcggccaggggcccccatgttttgggaggctttgcgcaggaagatgcacctaagtaatagtttcgccaccgctgggttgatgtagttcattcaaaccagaaacttgaggtttgagtggtatggctgcaaataaacacgtggctttctaaggctctttgaagaatttaaagtaacttgcaaatcttatcaatacggaccccttgaggtctgagaaccctggactgggaccaaggagctaggtaatttccggccctagtgattaccagcctgagcttatggcacccaccagtcccccagttgtcctgcccctctggtttctgcagccccttccattccaggactgacaagtctgttttaattgggggtgggggctaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaaggtatcgtgagagggtggcacagacccaggggctggaagtttcagggcccctgtgttttgttcctggtgtattttgggagtttggtaaattgtcaaaagtgtgtttgtccaggtgcaaggtccatgccaggctagttgcccctcctcagtaggttccggctggtgtgagggccagctgtggacactgttctctatctctgcagaaaacgttgaagatccaggatgtcgggcttgtgccgatgggtggtgtgatgtctggggctgtccctgctgcagcagcccaggaggtgagtcctgggcagaatgaggcatttctggggtgcccagttcgcctgtggcctcatgtgccgtggtcccgtatctcaggttctgcagctaccgtcattgtctgcagcctgcacacctgtg

SEQ ID NO: 88444 - DNA, 1115 bp, Homo sapiens
gggtggcccagcagtggaggcgttagctccccccagccctttgtcacctggctccccttctttcctgctccctaaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggtctgtgccgcggtgggggttccgaggcaggttccgttgtggtggccagggcccccagtccctgactttgctctctctggcaggcaaagaagctggtggagtccctgccccaggaaatcaaagccaatgtcgccaaagctgaggcggagaagatcaaggcggccctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcagtgtgtggagtgccgtgctcaggccgggctgccgggccagtgcggggatccgggcagcgtgtggagtgcggtgctcaggccgagctgcggggccagtgcggggatcgaggctggtacgggatgggaggcttgttccctgcctcctcagcagacatctgagagtctacagacattcatcaggtccccggtgtgcagggccctgtcctgagaccccacagtgggcctggtggacggcagtggtgtggaggacctgggcagcgggaaccctccctgttttcagtgttggccctctttaaggcaacaggaagttcagcactcgcctgagaaaccgaggcagccttggagccggcgatgccacccctagcttaggctgcaagtacccctgaacctaaacccggccacggggctgcgcagggggattggggag

SEQ ID NO: 88445 - DNA, 1008 bp, Homo sapiens
catccatgctagcagcactggaggagtttgctggggaaagggaggggcctttgaagacagacaggcacgcatccagccatgaacgggcgtgttgcagaagtggccgggaggtggttgtctgggattaggggagtgtgccgtgtgctggggccggggaggtgcgtggatgaggtgggaaagatagaggcctagctgaggaggatgcgctgcctccgaggcgcagggaagcctggggtagggtcataggggtccctctgaccacagtcctggtcatcttgcggggaagggacaggcctgccagaggagcggggacggggtctgcaggtgagtgaggctggggtgggcagagggctgtgggggagcatggaggacacttctgagggagaagaggatctgggagggcaggagctgagggcaggcactctcgtgacgtggatgccaccccctggggcagggggccctgagcacaccactctctgcctctgcagcctggcagggtgtggagcgagacctgcgaggccaggtgccgggtggcgagcggggcctggtggaggagtatgtggagaaggtccctaaccccagcctgaagagtgagtgggggctgacctgggggcagggctgggccggcaggccgggcctcatgggcaggaggggcctgtgcccaccacctaccgcgttgtcccctggcagccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctgg

SEQ ID NO: 88446 - DNA, 1861 bp, Homo sapiens
gatggagggccggcccctggtgctgcctgtggcctgtcattggccagagcccaagggttggaagtagaatggtcacaccccagtggtgactgtgcctggacttcatgctggggctgttgtccctgccgagatgtggaccctctgtagactccatggtgccaagctgggagacacacatacgccttccatgcccagtggaagggtccaaggctgagctgggattcccagggttcctgacacagtgggggctctgattcatcctgctataggcagaaatcccccaggcgtcactcttcctgggaagacccctgtgtagctcgtaaagaccagggttggctgctccagtggccggtggccatgtccgccgtggccggctagtccccggtgtgagcagtgtggggtgctgggggccggcagcctcagctgttgcagccaacctgcccgccccgccccttttcctgtatcccaggatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacctgtccttgcctcgggtttatgatctcaccaagcccggagagctgggctggaatgcggacgccaaggccatctgccaggccttagtggggttactggtgctgagaggcctcgcccctgggacgaggtgcagatgcagaaacaggccccagtctccccagcagagctgtgcaggcttgcgattcccggggaggatgccttccctgcctgtaggctgctttacctggactctgatggggcttctgtgattctggaccctggatgtggacacgggtggagccacccagccccatgtgatgctcagactcctggtcattccctcccatccccgccgtggagtgacgagaaatcaggtggactcaggcttcaaggatgggtgagaggaacagggggccctgcttatcactaacccttcacacgataaagggcagggctgggcgcagggacgcgcgcctggaatccc

SEQ ID NO: 88447 - DNA, 2703 bp, Homo sapiens
atcacttgaacctgggaggcagaggttgcagtgagccaagatcatgccactgcactccagcctgggcaacagagcgagactgtctcaaaaacaaataaaaaagaaaatagctttgaccacatgggtgccctgaaaaggctaggggccctggggatgggccacacttcaaggttgctggaggaccacgtgcgccaggcttgcattgtggatgtgaagccagctgttgaattcacgggcagccataaggccgtgaccagagccagtcttactgtcgaggaacagccatgtcctgtacccattgctggacctgtggctcgaaaccccacgggagggcagggctgctggctgctgtgacttcccacgtccagggagacccgggcccaggggctgtgctcccagcagcaatgctcagtcagggccctctttctgtccacagtttgatgaaggccggaacaactttgaaggggaggtcaccaaggagaacctgctggactttatcaaacacaaccagctgccccttgtcatcgagttcaccgagcaggtgcggctgccctgcagcccccaggctggggatggggaggagtgggttgggggtggcatgaggctcccggtcaccactgctgtccagcgtctgacattggaggccattgggagaatcttctgcattaatagtgtgtgactcagacccagtaacttaagtttataacacagacagccccgaagatttttggaggtgaaatcaagactcacatcctgctgttcttgcccaagagtgtgtctgactatgacggcaaactgagcaacttcaaaacagcagccgagagcttcaagggcaaggtgagctgctcttctgggtggctcgtggggcggtgccagggagcagtacaactcttcccgaggtgacaagtgtggggccttcctgaggctgcctgctggactggatcgggcacctgattcaggacagcctggatgtaggcgaggggccagccaggccagacctctgctcccagtcacctgctggtctggttgggcaaccccggaatccaggttggaggaaaaaggcaccggagcacggtctgcttccgagcaaagtcagggctggaggcagaggccagccgtctcccgcacctgtgcaacctccttttctcccccagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaaggtgcaggcgcgtccccgggccagggctgcctcccgggtagagccgccaccttggggtctctgggctctcagtgtcctgggcttcgtcctcaaagtaagatcttcagagtaagaggacggagcccaagatggtgtgaagaccaccattcttgtcacacctttggggacctgtaggagccctcttgtccacacggctggcccagatgctcctcagggaaacctcctggccggcgagggtgcggcctgcgtgggctcattgggcccagcccactggcccagccttctctttctggattcttggcactgttggtgtctgcggctgccaccctggtgtgcccagggcagccacgcacctcagtcccgggcagggtgagggttggggagctctgtggtcccccaggcatcgccgcccctcaccgtgccctgcctgccctccagccccacctgatgagccaggagctgccggaggactgggacaagcagcctgtcaaggtgcttgttgggaagaactttgaagacgtggcttttgatgagaaaaaaaacgtctttgtggagttctgtaagtgttgccctttcagctccccaggtccgtgccaccagggcacgcgcaaggtaggcagactcctggggaagcgtctgccagtggctttgtgtccaggacacaccctagaactgctttcttttcagatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtgcgccttccctccagacggggctggggcgggctctgggaagagcagtggtccccacgccagcctgggtgcctctctggaaggagcctggggctagtcaggtgggagaagagctgtgggagctccttcagaagcacccacctttgtttttcgagagagatgggatctcactatattgcctaggctgtttttgaactcccaatgtgctggattccgggtgtgagccaccggaccgggcctgctctgcctttctctagggaggaggagccaatgccaggagattggctctgggccgggaccagcccctgcactcatccctgtcttccacaggtcattgattacaacggggaacgcacgctggatggttttaagaaattcctggagagcggtggccaggatggggcaggggatgatgacgtgagtggggtcacagccctgggctggtctctgggattcagccccttggccccacgggacatg

SEQ ID NO: 88448 - DNA, 1393 bp, Homo sapiens
aaaaccccgtctctacaataaatacaaaaatgagctgggtgtggtagcgtgcatctgtaccccagatactcaggaggctgaggttgggaagattgcttgagcccagtgggtggaggctgcagtgagccaagattctgccactaccctccagctgggtaacagagtgagcccctgtgtcaaaagaaaaaagaaaatgcagagagatcagagaaaaaaaatgggtttgtgatcctgttattcagagacagaatcaccctcttccctctccactccccataaacacaaccacagtctcacgtacactggggtttaggaggcgggcggacggcaccgggcctcttccatggtgggagaacatcttacttaggttgattcaggtgtcctcagcctggctggcagagagcagagacgggagcaggcgcggcagggcaggcggcactccctgtttgagagtagaacctacatttgtttggggttagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggtagagaccagagcattccagtcttccttccttccgtcatccattgaggaggggtccacagcctgcagctggcagttctgcacgtgtcccccctggcctgggctctacagggtctgccctactgcttggtgctgcgggatcatgacgacctctgcttctccctcctcattcaggacgtggagtcggactctgccaagcagtttttgcaggcagcagaggccatcgatgacataccatttgggatcacttccaacagtgacgtgttctccaaataccagctcgacaaagatggggttgtcctctttaagaaggtgagtggccccaggcagctctgcccaggttagttctggggttggtctgcagagggtggcgttgctctccttatcgttaagggaaccttgctcctggcacctttggcccaataggtatgttctgcagctttgccaagttggggtgttgcgctgatgcctgtggcctggtcttcgcattcagctgtgggctttctggccactctcctgccacagccgcctcagaactgcttttgactgttagcttttttttttttttcaattatgataaaacatgtaacaacatttgccctttttttttttttgggagagtcttgctctgtcacccatgctggagtgcagttgcgtgatctcggctcactgcaccctccgcctcctgggttcaagtgattctcctgcctcggcctcccgagtagctgggactacaggcatgcactaccatgcccagctaatctttgttttagtagagatg

SEQ ID NO: 88449 - DNA, 1057 bp, Homo sapiens
cagccgcagctccgcccctaaactgggaactcctccccactgccacgttcgacgaaggaacgcgcagagtgcgcgcatcccttggccaatcaggaggcgcagagtccgtgctaccgaaaggggcagccattccagacccgtggaaggtgcaggcgaaagccaccaattagaagccaaggcagaaaaagttcttgtcgggagccaatgagaggctaagaaagacagcgagcgcgaggtcctcggccaatcccgaacgaaggccagggagcactcaggagcgtttccgaatccggggccaggcctggtgtgagtgtccaatccgagagcggcaaagacgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctgtgagcgccgggcctggcgggcgggcggggctcggggccgctgagccaggctcttgggacgcaggcacggcccggcagcccccggggtcgggacccccggcgcgcccggaactgaagggctcccttgctgcccgccttgggggccatgtcaggggctccctgggggtgagagccgggctgggagccggggggccgtcccgatgcccgccctgcgcacggcaggatcttcctgttagtgcgagaagaacaggatcgacctgtgtgagcaaacagagcaagccagtgtccagccttgccgagtcctccccgggggccgacccggaaggcgccccgctcctgcccaccccaccttcagcttgccacagcagtccttccgatg

SEQ ID NO: 88450 - DNA, 2952 bp, Homo sapiens
cgctgagccgaccacacacgtttacatgtgactaccacggccagaggagcaaccctactgagggataccgagccccgttaccccgtagggcgagggcctgggcagctcaagagcggcaagaccctaagagagggtttagtgtgggccccgccggttgattctggggcctgctagccccgccccacacatacagggggctgctgcctcctccatcgtggagggggaggtgtgtcctctctccccatgatcggctgcagttcccattttgtcttagatgttatacctggggtgggggcacctcacactgccccagaggatgcccctgagcaggaatcgcgggggtggagaggagcgaaggtggcccccttggagcccttttggagctccggctgcagcccacactcctgctcagaagtgcgcctccgttggggatccaggtccaaggcctgtcaccgtcccgcccacaggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcaggtgagtctgggctgcgggagccgggtggccgcccgttcactccagctgtcttgccgctccccagcccctacttccactggtgggggtggggccctcacctgctgtcactccccagaccccaacgtccccaacgtcgtggtgactggcctgaccctggtgtgcagctcggccccgggccccctggagctggacctgacgggtgagtgccctgcggccgcgggggtccgggcggcccctggtggggatctcgggaagtgcagccagggggccgcgcagggctggggcttcgcgcagggctgctgggcagtcattgagggggaggtccccccaacaggcgacctggagagcttcaagaagcagtcgtttgtgctgaaggagggtgtggagtaccggataaaaatctctttccgggtaagctacaggctgctgtggccagggaatggaggcggggctggggctggggtccggaccgaccttccctgatcctcgcttcgggtcctgcaggttaaccgagagatagtgtccggcatgaagtacatccagcatacgtacaggaaaggcgtcaagagtgagtggggccccgggcagggcagagggggccgcttgggtgcgtgctgccaggcggggaagcggggccgctgaccgccctcttccttgtgccgcagttgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcactcaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggagctgggggtgtctgctgcttggcttctccagggtgtggcaggggagggcctggctcctctactgcctcacgggctttaggagacaaaggggaagatggggaccctggtggggtggtgggaggggaagggcagggcccccttgaagtgctgtggctgctgggccccttgcaactatctggggagaaaggaatgtgactcccagctacagtagccctaggcagcaacagtctagaacagtgcagaaggcc

SEQ ID NO: 88451 - DNA, 2428 bp, Homo sapiens
ggaggggctggggtcagggctcccgaatctacaggcccttcaagctggtctgatatcggactgcttcccttgctcttgattttggcctttaccgtttcttggaacagcccttgggtgtgttgtacattttcctttgttgaagaggatagtggcttaattttgtgcccgttgctagtgggctttgcagcttcctctacctgcatcgtggtacacgtgtcaggtccccacaatggcaggagccctcagacccaggtgctcttggaagttgctgtccctcctgccccgcccttccctcatttcccgttaaccactgtcctgcctcccagagaaccacccccaaagcaactcacgcttccagggcctgtccctgggccaccagaaggaacgcagttttgttgcttttctgacaactgctctctgcaactcccaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggtgagtctgggggtggacccacgctgactgtggggcttgtggagtttggggctggcacctgtccaggtaggaatatggggtacccctgtggctgaggacactttgcatttgcccctttgtctctctcttccatctgccacctctcatgctgccccacacatctggaccaacctcttgtgaacccccatccagcaagctacatccctcccctccttcagctccttccggaagattcacttctgtgaagccttctcagaaccgccatagtacacctctgagtgcggggctgtagtcgtaaagacaaaggtaccggttcttcttcgtcaggtcacccacacctctccacccacgagcaccccgatacctcagcgagcagcccacctagtctggactgagaaggagtgaggaggtgttggtggggttgcttccttgccattttgttctcccaccagtatctccaggccatttcccttgtcgggggcatttgagacgcacagaggccctttccagtgtttgcatggagaccagggtgtggcgccagctgggtgggtttcagagcctctcaatagaacgtgccttctcgtattctttgccgcaggccgccccatgaacattcagcttgtcacgtcacagattgacgcacagcggaggcctgcacagaggtgacttccggggcctctggggaaggggattggccgagggtgaggctgcgtcgctcttagggtccttccgggtgtgtgaacggtttcgtcttccttgctagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagagtgagtcccgggggagccagctgggggcctggtcaaagccgcagtggggagcaggccgcctgtgaatgcaagcctctttctcctctgtgtttcagatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgtagaactggaactgtttgattcgtcccactgttggagtccaggcctgggccaggattttggtgtctgtccagctgggagggggtgggagaacctgagttggggatggagggagcagccccatctggtgttggacacctgaagttggcatgggttgtgggggtggcggggggtccccgctcctggagggccgaagctgcctgtcttctttcttatcttctttcctgcctcacacctaacaccttcctctctaactcaccaggtgggaggacacctttgcccgggagccacctgttgacccttgtgcctgtgcctccaggtgaggggaggttggggtgggatggctgccctgtgtgccgtccacaggcttcccacagccagaacatctctgggctgttcctttccttcttgtactctggttttcagagaaacgtggattcagcagttttgactttgtagtgtaattcctttttctgtttgtttttttgttgttgtttttaaccttgccacggagca

SEQ ID NO: 88452 - DNA, 1031 bp, Homo sapiens
gctcatagcagggcataggggttcacgcctgtaatcccagcactttgggaggccgcagtggcagatcgcttgaggccaggagttcaagaccagcctggcctacatggtgaaacctcgactactaaaaatacaaaaattagtcgggcgtggagtcacgtgcctatagcctcagctactcaggaggccgaagcacaagaaatgagctgagatcatgccactgcactacagcctgggtgacagagtgagactctgtctcaaaaaaaaaaaattaataaaaataaaagtaaaataaaatagaaacagggctcacgatgtttcccaggctgggttcggactcctgggccggtatgatcttcctgccttggccccctgagtagctgggactgcactgtggcaggcttatacctgtgttggtgcctaaacgttctagctctgcagactcaatttagccagtcgtcctgttccctccgccgcaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcctcccgggttcaaacggttctcctgcctcagccttccaagcagctgggattacaggcatgtgccaccatgctgggctaatttttttatttttagtagagacggggttttgccttgttggctaggctggccttgaactcctgacctcaggtgacctgcccgcttcagccttccaaagtgctgggattacaggtgtgagccactttgcctggcccaca

SEQ ID NO: 88453 - DNA, 1114 bp, Homo sapiens
gcaccccagcccgcccgccgcccctcccggccctccgcagcctcggcccgccctcgccgcagatataaggcggcccaggcggtggctgctccgagcccggacgccgccgcccaccagtcagccggcgtccccatggcccggtccgcgacactggcggccgccgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgtgagtccggcgtgccggggactgatggggggcggcggcaggacgtgggtgggggtgcggcggcccctcagcctttgcttgcctgccccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccccaccgtcccactcggtgaccccaggcccctccggcgcgggatggcgccccaggtctcccctactccgctcaccccgcagttaatggcaaacgaataaataaatgaggcggcctcggagtgaggggtgctggaggactggcagccaggccacgaggggaacgggacctggaaatccccaagcctgggtatgagaaggcagccgagtgtgcggcggcagggcaaggttggcctgggccgcccagaggtcttcagacccaggggcgaagctggccacgacccagccccgcggtgaagccgcgcctagccttggtgctccctgggggaagtgcagggccacggctggcccggttcccagtgtcctcccccagcccttcgctccccaactcgagagccaaatctgtgagggcatgggctggagcccctggctgccttcctcttgcccccatcccttctggccaggccaagtccgag

SEQ ID NO: 88454 - DNA, 1110 bp, Homo sapiens
agcaacctccccgacttcttcccatgagggacagccgggaggggcacaccctgtccccccaaaaagtctccgggctgagctagccgcactctggccgcaggaggtcaatcactacaaggggaagaactaccccatcatgaatctgcatgaacggactctgagcgtgctggcctgccgggtgagtgggggccaggagccagcccaaggatggggagacattcccacaacatcccccctactaagggcctccctgagccagggcaggggggcttgggtcactggcagagctgcacccagcaccccgagttctgtggcacctgcccatacctgtttgttgaggcatgaggaggggtggtcaggtctccagatgctgttccttcttgtctcatggaggagccccaggggtccccagcctgcccagcccatccctgctactcactggcagccccgccccatgtctgagccgtctctcaccaccctgtggccctggcttaccagtagcagggaccgagcaagtctttctgcccccactgtccccacagtacgtgtcagaagtggtgattggagccccgtacgcggtcacagcagagctcctaagtcacttcaaggtgaggctccgcatgggctcacctcgttccctctgttcacctctgttcctgcatgggctgggaatgcaggctggctgtgggctcctaggcggggcccaggaggtacctgggctgaggaaagggcagggtcagctctcccaacccccggggcctgtgctgggctgtgggtggcgacggccgctgcctccccggggagggctcctgaccccactccttctccaggtggacctggtgtgtcacggcaagacagaaattatccctgacagggatggctccgacccataccaggtgggtcatgctggcccttgctgggcacaggggttgccattggcacctcccagccatttaatgactcactgtgcctgcctgggaaacgggcatggtggcgcagctgctccgactgcaccactcccatgggaccctgggcgctggtctccctctggggcagggcatcagatgggtcttggggaggtcagcagggaccttcatcccgctcctcctc

SEQ ID NO: 88455 - DNA, 2165 bp, Homo sapiens
cttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtg

SEQ ID NO: 88456 - DNA, 4304 bp, Homo sapiens
gttgcggagccgtgaccatctgtgcctcctgcgtgaggtgggcttattagcctctgggagcagagggtgcatgacaggccccagctctgcccagccttgagggctggaggagggcgggggcagcttctcctcagtccagctcctgggatccctgcatggtccctctcagcccaggtccagaggccaggccaggagcctggaacgcactggctgtgctcagggctgcccctcccccaccccccggcgcacctttgataggaggcgatggcttgcacttgtgctgagttcaggccttctgcggagggcaaaatctgtcgaggaggcacttttccgtgtgatctcttcaggaagtcaccactgtcattgtgcttagcagcaggggtgggggcgatgggggtgggagaagctggtgccagggcagtgtctctgcaccctgacttgcactcaaggctggggggcccctccatgcttggctgagggcctgtctcctggggcagtgttgtgccggacgtgtaggaaagggctcctgtgggccttctgacctccagctcaggtcttccccatcctttatctggaagaatccagtggctggagcctcgggaccttgcctctgagctggcttggctgtggggaggggtctctggcctcccctccctgctctgtgcttgcagcctcacctcctggtcccaggctgggtgaggtggagtcttgagcctggtgaggatgtgtgcatccgcctggccacacttcagctcccctgatgagagtaagaagccccccagcccataatttcctgaagtgatcctagctcctctggaggagtctcccatctgtctgcatcaaacctggaaagtgggggatggagcatgaggcgggggtccatgcccaagggtctggtgggagctgggctgagctgggaatcccagaaacatccttagcaagaaagtgagagcagagtgctggagggaccccgagtggggaagagttggttgttaagtccggccaccccagcacttttgtttttgctccctggccctgtgggcactcacccggggcagggaccagagagcaggctgcagctcggaggggctgactccgccagccttcacgttgggcaggcccggggtggctcactgtgggagcccttgtgaaataccctggatggggtggggcaggggctgcttcctgcaacccaaagccacaggatggttactccatcagtggaggaggccgactgggaggtctagaggggcctcgggccaggctcctcccagctgatggcctgccacctggaaggtgggggaactccctggtcagtcctgccaacagaccagagctagatggacggcccacccccagcttttcaaagttaggaggctgggagactcggggttccctgtagcctcctctctggccaggtcccccgtggggcccctgtgcacccagggagcagggggctttgtccgaggccggctcaggggaggtggctgtagaaggtaggaccctggaagatgcacacacagggtcactggctggccctcacctgctattggccaggctgggggctgcggctctcgtggggcgctgttggctggcgggccagggagtgcgggcgcggcggggaggcagaggcaatgtgctgagtcagcgtgactcgccaggaacagccgcgctctgggcagtgccggggttatttttaaagctcccggcttccttctaggcctgcctctcccgcgtcttattccttctaatctctcccctgccccttgtcttgcgcctgccttcctaacagccttcagttccccttctcccgtcagaccttcctgacctcccacctggttctctaggggcagggtggacaggaagcagctcagcccagcctgggagaggccaagggctgcctcctatcaggtattgggggctgggcacctggacagcaggctggggcgggctgtgcggcaagggctcttgtgaactgggccgggggcgggggggggggggtgcggcgagggtggtctccagggtactgacctgctccgtgtcttgcagagagcgcctgctcgctgtgcccccgggttatgacgacccccaataaaggaaacaaggccttgaaggtgagtgggcagggacaggagcctgtgggctggggtcggggggcacagtgggcgtgcccgcttggcctgtgaccacctgcactgtgccccaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccctttgatctcgtcattgtcgtcgtgtgttttgtatgttgggattggtcagttcggcggtgacgtggggtcgccccaaccccttttgtaccagggccatgcaggcttggagtccagagttggtgctgtgggaacggactagagagagttgcgggagagagaaggagcaggcacgctgggcctcgcgtgtccccgagcagtgagggtcccagtgttccctccactcccgagtggccacaggctcgcgggctgggaaggattcactctctttagccccaggggagcagctcagcttagcccagcatgaagagatgggctctgctctgagagtagggcgggcttgaaggccctgatgggtggaccaccagcctgggcgcagtggtgctgggggcgtgcagctgggcccaggggctgtgcactcaggcctgacccgttgcactgaacaagaccaaatctctggttgtgcgcttaacgtgagggtgggtccagtgtgccctgcgatgggtcccgtgtcactgtttacatgacctatttgtgtggttatatagccctttatttaaaagagagaagttccttttacaaagttattaaattaattatatgtttaaaagttaaagaaaaaagagctgcagagtatttataaaactgtcttttagaaaaaaaacaagcaagaagaccatttgaccatatgaatggaaaagggaagaaagtataatagaaactttgctagttaaaaaaaaaagaaaaaaaaagaaaaaaaatccctttcttgtaaacttacggacacctctttgtggctgttggagtttagtttttatatacacagagttatcagacattatttataaaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgccc

SEQ ID NO: 88457 - DNA, 1359 bp, Homo sapiens
cccttcccaggcggctcttttccggcagctggtcctggtcccaagtctggagcagttttccaaactgggaaatagttccctgagtgagggaggggaggagcttcggtgggccgagctagccaaaggggaagtcggctttccctgggactggcctggttggacagcccctggccagagatcgaggtcctgggagaaagaggggtgtgtgtaccaagccctgggtgacagtgggctgggcagggaggaagcaggggcagctctaccaggaaacggcaaaggggaggaagcagcccagcctctctccccagttggccctggagtctgggttgagactgtaggtggtgggagcttcagggtgcctagccttggggtgcagcagatgggctggtgtggatggcacagggtggcagaacgcagcacccagccaccctaaagttgtcgctacctgaagtggggtctcagcgttgtgtgaagttagcaaagggagtggccctgttgggtgtctggcctggcagcccaggacgcttagaaagtggcagcttgggagtgatgtggccagagccacctttccttgggtatgtggagattcacgaaggttgacttcctttgcccaggagttcatttcatggctgggttaggctactttgtggtttgccctcagggatgccccccgccccccgccacacacacacacacacacacacacacacacaggtccattctcagtgagcaccccccacacatacacacagaacacaggtccactctcagtgagccccggggcttatagattccagatgtttcaatgttttagctgaccgttggcctggagtttgatgccctgggaaaattttggggtcctggagggacatttatgtacatctttttttttttttttttttgagacggagtctcactcttttgcccaggctggagtgcagtggcgcgatctcagctcactgcaagctctgcctcccaggttcacgccgttctcctgcctcagcctcccgagtagctgggactacaggcgcccaccacgacgcccggctatttttttgtatttttagtagagacggggtttcaccgtgttagccaggatggtctcgatctcctgacctcgtaatccacccacctcggcctcccaaagtgttgggattacaggtgtgagccaccgcgcggcccatttatgtacatcttctcagtcacttatgcatcagtggaaactaagttttaggttctgttcaaagagtgactttcaggagctgagagcttatggagcagaggccatgactgccggggagtttcggccgctgggctttgcagccaggtggggctgtctgtgttcaggcacgggagttt

SEQ ID NO: 88458 - DNA, 1024 bp, Homo sapiens
cgctgtccccagttcaggtctgcagggtgggtgaggacgtctttctcgccacactgcccactctccagtccagacaccctcagactctgcgagtgccaccctgtaacagtgaggggaacacgaggggcctggcctcacctccagcctgcaggggagacaggtgtaaacccacatcccgtggtggggccacgagaactcaggtctggggggcactgcggggagatttggtgatgctgagctgattcgaatgaggtgagaaggagcccagcagctgtgtgggggcgtgtcgctggcagaggggaataaaggtgctgaggtgagggtgacagcatcgcccagggctgactggcactgggagctgtgggcttcactccctcttcctgggtgcacgcttgtgctccaaagccaacctctccctgcctctctagggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctct

SEQ ID NO: 88459 - DNA, 1044 bp, Homo sapiens
gctctgattggccagcgcctggcggccgcgcccggattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggtaggcccccaggtgggggacggtgaggcccagtgggagagactggcctctttccacttctgcagggctgggggctgaaggtgggtgctgggtcacaaggcctgagtcctgcgggaactggcaacttctgtgtgtttggggctttacctgtgctgtctcactcttcttcctgggaatggggagggagggaagccaaagctagccatgaagaggaactgtttccggccgggcgcggtggctcacgcctgtaatcccagcactttgggaggccgaggcgggcggatcacgaggtcaggagatcgagaccatcctggctaacacagtgaaaccccgtctctactaaaaataccaaaaattagccgggtgtggtggcgggcgcctgtagtcccagctactcgggaggctgaggcaggagcatggcgtgaacccg

SEQ ID NO: 88460 - DNA, 1062 bp, Homo sapiens
ggggcctatgactgacacccctggggagagttgggccaaggctagctggcctgtgagcctcagcagcactgcagggggcctgggagggtgctgagctctgcctggggtcgggggcagcagcggggacctgggggtgctgagctctgagcctgggatagggggcactgcaggggcctggggggtgctgagctctgagcctgggatggggggcactgcaggggcctgggggtgctgagctctgagcctggggtgggggacactgcaggggcctgggggtgctgaactctgagcctggggtggggggcactgcaggggcctgggggtgctgagctctgagcctggggtggggggcactgcaggggcctgggggtgctgagctctgagcctggggtgggggcactgcaggggcctgggggtgctgagctgtgagcctggggtgggggcagcagcgggggtcaggggaggccgaactgagccccgccgcccgcaggccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccgtgagtgtgtgggccccgggagccccacgccgggtagctccctccttatttaaaaatagaggtcctgagaaaacaaaagaagaaaaaccagaacaaaaaaaaatagaggtcttgtaggccgggcgcagtgactcacacctataatcccagcactttgggaggcccatgcaggtggatcacctgaggtcaggagtgcgagaccagcctggccaacatggcaaaaccctatctccacaaaatatgcaaaaaattagtccggtgtagtggcaggcgcctgtaatcccagctactcaagaggctgaggcaggagaatcacttgaactgggaggtggaggttgcagtgagctgagattgtgccactgcactccagcctgggtgacggagtaagactctgtctcaaaaaatacatatatagagagagaga

SEQ ID NO: 88461 - DNA, 1082 bp, Homo sapiens
gcccggcggcgggtcacgtgagcggaaaatggcggccccggcaggcggcggaggctccgcggtgtcggtgctggccccgaacggccggcgccacacggtgaaggtgacgccgagcaccgtgctgcttcaggtgcggccgcccgcccggggcggacgggtaggcgggcggggggcgctgcgccgaggccccgcccattgcggtcggcgtcccggtgttcgggggcggggcctcggcggccaatgagcggcctcctgagcggcggccccgccccctgctcgccgtcacctgcgcttccgctggggtcccgggggtcccgggggtcccgagtgggggcggggcggtggcgagccttcccaggggtgaggtagaacggcgccgcgtgtcacccgcatcgagtactcggcgcccggccgagcccagctcgcgagggcgccgggaagagggaggagtggagccctagacccgcgttcccattccggggcgtcccccggagcgggagcccgggttgcgcggtggcagatgtcccggccgtggggcctggaagcgatttttgccgagtcactcactgcacttttacttgggcaccttgtgaccgcgaatcaattaaatgtaaaagtattggctgggcgcggtggctcacgcctgtaaatcccagcactgtgggatgccgaggcgggtggatcacgaggtcaagagatcaagaccatcctggctaaaacggtgaaaccccgtctgtactaaaaaaatacaaaaaaatttagccgggcgtggtggcgggcgcctgtagtcccagctactcgggaggctgaggcaggagaatggcgtgaacctgggaggcagagcttgcagtgagccgagatcgcgctactgcactccagcctgggagacagagcgagactccatatcaaaaaaaaaaaaaaaaagtatttattgagcctctgctgcgtgggggaccgtgaggatccgaaggtgcacacgactcggagtttgcgggagcagcccacggcgtggggtccccaggcctgggcaggtggagggcgcagccaggaggctgttggtgccaggcgtgcagagtgcggaa

SEQ ID NO: 88462 - DNA, 1050 bp, Homo sapiens
gtcatggggatggaagccaccccagtggctgtcggggtgaatggaggcccctggagatggcagcgggttaagcacgagcacggaattctccctcccaaaacggaactcagacaacagtgacggagcctaagagcaaagccaaagccacgggcaggggtgagcgggacccgaggcaggagatgacggagcctaagagcaaagcgaagccacgggcaggggtgagcgggacccgaggcaggaggtgacagagcctaagagcaaagcgaagccacgggcaggggtgagcgggacccgaggcaggagatgacggagcctgagagcaaagcgaagccacgggcaggggtgagcgggacccgagccaggagtggcgccgggcagggaggcaggcagccccaggcgctgtgtgggcactgggtgagaagcagggatcccggcgccctggctctgtgctgcttcctgagacgagagtggcagagggcaagaagaaaaccaaacagcgcggggaacagaagtcaggaaagatgaacgtctggaaggaaatgcccctgggccgggcggtgcccccgggcgtgaacagaatccagtgctcccacaggcacaggtgcttggtgagggccgtcctccctggctgtgctgtcagtcctcagatggggatggaggtaaggaaatggcccagagtggcctggggctgccactggggaggggccgagggtgtctggagaggtggggccggcattgtggtagcataagcctcttcaacagactttgtaaacctcgtgtgaaacttagtttaagaaacaacaggcttggccaggcgtggtggttctggaagtggctttggagctggctttggtggtggctgtgggggtgggtttgggcgctttggaggaggttgcagtgagccgagatcgcaccattgcactctagcctgggtgacaagagcaaaactccatctcaaaaaaacaaaaaaacaaaagaaacaacaaggctgggcacggtggctcacacctgtaatcgcagcactttgggaggctgaggcgggtggatcac

SEQ ID NO: 88463 - DNA, 1022 bp, Homo sapiens
aggtaaagccgtggctccgggaaagctgggtgatttctgcagccctctgggtgtgctggggtgtagggatgggctgctggtgaggacagggctctgccaggtggagcactggcctgtggccacactcagggtgggtctgtgcatgctgctgggccagctcagagctctgcggcccgtccctgtccatccctgcccgtccctgttcatccctgtccgtccttgtccattcctgtccatccctgtccatccttgtccatccctgtctggacctggctgggttgagaaggccggagcctgccccaggctctcccaggctctgtctagccgcttggcggctgggctgtcatgtggtgggtgatgccctctgcgggcctccctgagcccagtggctcctggcctgcagccacagcttctgttcccggcagggcgcatgctgctgcctgggctctcgtcagcacctgtgtttgcgcccggctttgtcatacccagacaggacatgaacacagagagctctagactcactgccttgtccccagcacacagccgcgccttgccggagcggggccccagcggggcggggtttgtggtgcataaagaatatgccctcgaagccagcagcagaggcgtgtctgccctcctggccgtcccgctggcttctggccctggccgggtggggagctctgctggctggagagtgtgtgagagtgtgccagtaccctgctgcgagcaggcacccgcggaagcgccccaaagcacttcttgcatttctggcttcggagcatggtgtctggtggcttggcctggcctggggtccccgggaggccctgggtcttgcccctgcggacattgggacttgcagaggtctgcgtgggggagggggagtaggggctgtgtctcctcgggcgctggaatttcccccgggccctggcgtcctgcacactgggccggcgtagaaggtctggaaccgattgcccaccacccctccctgagatcccgcatgagggagggaatctgatccctct

SEQ ID NO: 88464 - DNA, 1060 bp, Homo sapiens
tggcgtggcgcaagcaaagcccgccgtggcgggaccctcctagcgctcgtccctggcctcacaggggccttttgtttccacgctggctgagtgccctttgctggggtgggggggcactggcccggaggggccctggggggccaggacattccccgcatttatccccatttggaagctccctggctggggctgtgacggggaggttcaggtctacgtcctcccttgaggggatgagccacggggctcaggacccaggcccagcactgtcctgaggctgtggccctcagggacccttacaccctttggcttttgtgctgggccattgactgtgccctcgctagaggcagcttctccaccccttcctcacaggtcagagttagcgtatgggacgtggccagccaggcccgatccctgcccaccccgagctgagcaccaggaatggccacccccgtgggtgacagcacgttcctgcctctctcgctccgggcagtgggtcctggcaccagggcttcctccttgcagcccagctctgccagcccaggcctcagtgagcttgggtcccagctgcggagaccaggctgggggagacacggtcaggcatgggcagcaggtcctgccccggctgcagaccagactcaagctgggccttgtggagggtgtggaccggcaggggccagatgtggggggtgggtaggatggaggccagagagggcacgtggcctgtggtcctggtggtgccggtgcccggagggcttccctgggctctggggtcccggtgcaaggcgcacctgtcctggctgctcctcctgcaggtgacgggtgaagctgccctgcggggcacgacgctgcagtcgctgggcctgaccgggggcagcgccaccatcaggtaagggcagtgctgctggggccgaggagtctatttagctaaaaaaaaaagtggtctcaaaggaaaggagaaaggacacgtggcaagtggggagtaggtgtacccaggccctcatcatggagagcgcctggtggcctctgcctgcctgtgggcgtgggggctgggctgccccga

SEQ ID NO: 88465 - DNA, 1097 bp, Homo sapiens
ctaccccgggaggagggcagtggtgctgtgacattcaggggcttgtgacctgtacccagacggccgggcggcagcagcccaaggtcacaggggcctcccccagggaaagggaagcgcttaggctggggcgggggtggggctggggggcagcgggtggcagtgggagtgctctccagcagggcgggggtcccaagtgtggcccgcacggtggcccagccacgccgagcacctggagtgctgtgggaggaacagggctgaattcccacccctcggggaaaggcccaggagggtgggagcagtggcccaggtgctggggcagcccggggctggcgtggtggaagagctgtctgtatgttctttttctcctctgcagtgggggacttgcgagacttcgtgaggagccacctggggaaccccgagctgtcattttacctgtgtacgttttttctcctgagcccactcctgcctccagtgctcggggccttggtgctgtgggcacaccgcccgtcccagctggggctcgtggcagcttctccacaggagcagcatctgtggcctcccgcccaggtgcctcctgcagcccatggtgtctgtgtggagacctaggagggcccttctccccgagccaggcggtgggagccaggcttcctgccttctctctcagcgccctgctcccctctggagccctgctgcaccccagcctggtccccacccctggggctcaggccactcctgcccgagggctgtgggaagggtgggtggacagggagtggctggcctcccttggagggtgtctaggtggcaaagggttaggctgcccactgcaaggggagccgggctgcacgggtggtgtcccctgcaggtgggcctgccccccaccggcccttccgagccctcagctggagtttctgcagcaggagtgtgggcacagggcgtgctcgtgaggggctcttctgccccacttgaggcgtcacccccatctgcaggcctgtcttccttcgggcgcatggatgggcgaggtccacggtgcttcctaacacgtaggtgccttctctcctcagtcatcacccctccaaaaacagtcctggacgaccaca

SEQ ID NO: 88466 - DNA, 1003 bp, Homo sapiens
tcagctggaggcggccgccttgggcttcagctgccccttccccctgcccggcctctcccgctggccccccggtccctgctaggaacgccctggtgcccatagctgtccgctgcttctgtgggtccctgccacctccctgagggctcctgagggtggggccagggtgagggtgccgggttcccagccctgctgggccgccctccagagccagaagcaatgaatgtcctgtccttggcctgtgggagagctgcctggggccttccgaagccctctggcctaatggtttcctcttcaaagcctcttcagatattttaattagccacagaggcgggtttttttttaagtggccacaggcctctacagaggcctgggttggaggtgagaagcttgctcactgcctggggctgcagccgcttactgagctggggcaagaaggctggcagctgccaggggtgatcaggagcaggactgagcgggattccctgcagcggaggcaggggaggggtgagacagtcccctctcagcccccgagctgccgggcggactccgggcctccttcctccgtctccatcccctcccttgctggccagccagttgataaacattgaatttggaagatgccttgggatggaggaggaccagtgcccaggcctgcagcccaccctcccgctgggaggcccctgagagcactggggtgctgctgccctgtttctggggacgcttggcttccctaccagccaccgtctcctgccctccatcagctcggctctagcctcggggcctctcggggtggtgtccccggtgacgtgcctgcctgcctgcctgccgtcagagagctggcggggctgagggaaggaagcctgcctccctggcaggcaagcaggcggcgggcgcggaagcaccagctttcacgtctctggcagagccccactccggctgcctgctgcctgggggatgtccaggggccggcccccggcttccgagagggacagcgtgcgtgggt

SEQ ID NO: 88467 - DNA, 1113 bp, Homo sapiens
ggctgcctggctcagtgctccctgcacagaggcgcagacagggagcccaggtgccccaggcctggctgccaagcctacttccctctcctggtgttcccgagtcctgcccgcccctttctgtgcgtcccgtggggcagtgctggttgggggtcctggcctgtgggggctatgatgagaaccaggtgcctctctgcatcggtggcctctgagggagccctctcgcccggcagcaggtgggatgcagatggggctggccagggctcctgtgcccacagcagcctctgggcagtgtaccctgggcttctgtgagcagccgcagcctgggtgtgaatcttggaggcccggtggtggcggagcatgctctccatctgggagaggctgagaccatggcagctcctggcgctgtcctccccgtgcccccttcctggctccccagcttccggcgcctctccagggccactcgggcagcccctgcccaccccacaggcccttctctgctcacaaggctttgatcccaggcggcacaattgggttttcaaagcattcacggcccttgtttgtgtccctgggcccccggctggaggctgaggtttcggcgttcctgggcctggcctttgaagcttcctcttattaatcttttaacatcccccagccccactcccacccccagcctgtggccctgagcagcctggagccgggagggggaatctggagctgggagggggataccccagcctggcagctgcacccctccacggtggtcccggcgcatccgccaggacccgccacgcctggccccaccttcctcgggtgcagaggccagaggagggaggacggtgatgctgcatggcttgaggaccctcgaggccccagccttcagctggcttggggcttggggtggtcccatggagggcgctggtcccaggacgccctggccttgcttacaggggtagggctggtgtcagacaggaagctgggcgatgggctcatgggggccgggcaggcagagcctgtctgagggtggagctggggcctggccctgggggtgtagctgccttcacagcaggggggtgctctgcccacacccggcccctgagccccccgccctccctg

SEQ ID NO: 88468 - DNA, 1060 bp, Homo sapiens
gcacttcaaggatgacaagaccaaaggtgcgggtgggggtgcgggcgggaggtgggtccccgtgtctgtcctcagggaccctttcctgcaactctgcagggccaaggcctcgggagggcgggggtatgtctggagcacccagccagagcggtgggtgagggtcccgcataacctccccctgccttgcagtgagcggggacgcgctgcagctcatggtggagttgctgaaggtcttcgttgtgggtgagcccagggcccacgctccctccgggcacagcatccggaattttgcgtttttccagcgggaaaaccaagacgtgttttcccgtttcccacaagggcctaaacttgggtctcctgagcctgtttgtcaggtgctgtggcctggttctgggggctgcccgtgggtgttggggggggcaccggcccaggctgaggccctcactgggctcgggtttaagatccccccagcatcccccacctctcgcgtttctcaccgcagaagcagcagtccgcggcgtgcggcaggcccaggcagaagacgcgctccgtgtggacgtggaccagctggagaaggtgcttccgcagctggtgcgtgagcgtgggtcggggcgcaagtgggggtgcccggctggctggccctaagtgcttctcttccccacagctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccac

SEQ ID NO: 88469 - DNA, 1088 bp, Homo sapiens
cctgacagggctgcggctgtctctgtccccagttcctcgacttgatggagactattgataagcagcgagaagagatggccaagagcagcaggtgagcgggcccagggcaggggcagggtgaggcttcagggatcaggtcctggctcagactcagatgggaccaacctgagcccacgagtgaggccacgaggaggtcgctggaggctcagtgcccaggcgaccatagatgcttaaggaacagcagcagctaccgaggccagaggggtatgggagcgctctggggtttgggttactctctgcaccctcctctctgcccacagggcgtcggcagcccgtgtagggcagcttcaggaagccctgaatgagaggcactccatcatcaacgctctcaaggccaagtaagtggggggtggcctcaggatacttcagagacgtgcccacagggcagagaaaggtggtgtgaacctgtgtgcaagtcctgtttgcaaagcagaggtgggaaatggtgaggctggggcagtaacccagaagccttcctggaggaggcgggtgctggctggggttgactaggtgcccagcaacagtgaaagcagcgaggcctttataaggcaagtgaaactccaaccggggcgggggtgctgcccctcctttctgcaggctgcagatgacagaggccgccctggctctgtcggagcagaaggcccaggacctgggggagctcctggccacagcggagcaggagcagctgagcctgtcacagaggcaggccaaggagctcaagctggagcagcaggtgggtgggcagggcttgagaggggtgggccaaggggtgcgtggcggcttcgtgaccctcactacccataccccgttcccctcccaggaagctgcagagcgggagtctaaactcctcagagacttgtctgctgccaatgaaaagaacctgcttctgcaaaaccaggtagctgtggtggatggagccagggagcccagggtgggcgcggcagggctgggctgcagcttccctccctggtgccggctttcaggtagacgagttggagcggaagttcaggtgtcagcaggagcagctg

SEQ ID NO: 88470 - DNA, 1061 bp, Homo sapiens
ttgggggcggcggggggaccccggcaatgtctgagccgtagtacaggctgccgttgaagagacaccaaggcccactcgttcagggtgtgcatgctgcggtagtttcctgctaggccatctgaggcagtgctttctcagaatgaacaaggttctcaagagacacctgcctttcagggtggggagtccgtgaggagaaggtagggaggcccgctctccactctggccccacaatccctgcccctgagcaggtggagcatatgacccgtcacctggaggagagtgagaaggccatgcaggagcgggtgcagaggctggaggcggcgcggctgtccctggaggaggtgagtgcccaccaggcagggccaagctctgccttagtcctgggctgaacaaggcaggggcccctggtgttcgccgcctcaggaccagagacctcttcctgttcccagaggctcataggccccaccttggggacccacccaccagtgtgcccaagaagctaaagggacttaggtggcattcggacttccttggccttaggaaccttgcccagcgagctaggtggcagagcagctgcgtggccctcaggaggctggcagagaggagcccccctggctggggttggctggatgggccagagagagaagggccctgggccagggacaggagaacgggctggcaggtggccatctgtgcaggagctgagccgagtgaaagcagcggcactcagcgagcgtggccaggctgaggaggagctgatcaaggccaagagccaggcccgcctggaggaggtgagccacacatgtccgccaccctccgggggagccaggctgcccggcattgcggcccgcatgcagactccagagcttcggtctgagtggggaggcgggagtgtggtgttgaggtcagatgagcacaccctggacactggtgggtccgcttcagccttggatcagggcctgagacggtggagaggtttggcccatctctgcagcctgtgactacacgcatggatggatgggaggggtggtgtgaccgaagagggaggaggagagcccaga

SEQ ID NO: 88471 - DNA, 1073 bp, Homo sapiens
agccttcgtgcctggcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaaggtgagccagacccttgtcctcccgccgcccactggtgggacgtgaggccagccagagagcggggctggccaggtctcccgtgctgaggccgtgccacggtgcgctggggctgcgtccgctcactgcgctccttgccctgcagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgatacattctggccccgcctctccctccaaacgcgcgaccgtccgtgcctctccaaacgcgcggccctctgcccccagccctgcagggagggcctgccggggtgcggctgttcgcccctcctcgccgctgccttgaagggacgggagggccgcgggggctgtccgtctgggggttcgggcggctgcagaccccggagttcccagctggctcccggcggcagggggc

SEQ ID NO: 88472 - DNA, 1042 bp, Homo sapiens
ggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggtgggtaggcgctggcggcctgcaggggaggggtggggaggcgcagtaagggcctccctgtaccccaccctcactgtctcccctcctcactgccgctaggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctacacctcttgcctctcactacctgcccttctgtcctggggcggtttgctcctaattcccctctgtgatggtgcagagcgggtccatcacaccccagccgaccccagccgcacttcagagctgagttcccaaaggcagcactaagcttcctccaccctaccccaggggaagagggggcctgctgagctgctcagccccccaaaggagccgacccagatcaaagcaatagctagtgcattgagccctagggatgattacttggctgtgtacaaggcctccctcaggctga

SEQ ID NO: 88473 - DNA, 1555 bp, Homo sapiens
gctgtgccctcagccccaccccagccccagcctcgccctcatcaccgaccccagccccagccagcttgggttcctcttcgtaggctccaccaagggtgccctggacatgctgaccaaggtgatggccctagagctcgggccccacaaggtgagcagggctggggtacctcccccaacctaggacaccccacttgccctgctgaccccagctgtcccggtgtagatccgagtgaatgcagtaaaccccacagtggtgatgacgtccatgggccaggccacctggagtgacccccacaaggccaagactatgctgaaccgaatcccacttggcaagtttgctggtgagtcaggtgggagcccagccagcgtggtgccagcagtccctgtgtgtgccctgggtaggggtgggagggaaagatgggcggcagcctccttcctctatgcccctgacccccgccctgcccacagaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccagactatgtgctattcctaggctgccagcaggtagctgggggcttggggccaggtgtggaacgcgggcagagacccatgacattcacattccaatccaagggggagcgtggctcccactcctgaggttttcaggcctggccagttctctgtcagggaggtgggaggtggtgaaaggtcacctcccaaagagggtggtgaatttcagcaaggttggccttcgggcctgtccagaacctctggggtgagacggtgtgtgcatgtgagtgttgatggccccctctgtgagtgtacagttggctcctcttccttcaagctaatgagtaagacaaaagggaaacaaggagaacgtcaagcttctccacttcgtcggtgatctgagccactttgttgaatcagatgatggttttcggaaactagaagagcgtttcctcaacttgtgctattcacaatgtaatgagcatagacacagcaccctgaagtctaatctgcattttatcatctgaagtctagacaagtaaccataagtcaagcctcctcccaccacggctgatttcaagctaccagttagatgtcatttaacgtggagctggaggagatgccctcagcaccctgttatgtggtgtttgtgtccataggtcccacagatgtacataaccgaggggcagagaaaacagtcgtgtatgcagaaataagtaggaagtgacgtttgccgattttgcttttaataacacaaattgtaagcttctataatttgttaatgatcattaacaactggctagcaaaattgttgagaattcagcagttggctttcctgagccagtaggagctgcccccacacagcacaaggcggaagcagacagtggccctcatggcaccccccaatcccgagtgactctaatcccgg

SEQ ID NO: 88474 - DNA, 1027 bp, Homo sapiens
accacatcgtctttttgcaataatcttggcagggaaaaatatgctagccagggtccactacgtcgatttcaagcacggaagatgggtcacaccaggcacttcaaaagacccgtccctgaggcagcggagaccccgccccgccccggcgcgcccactcctttcggccaatcactgcagcggggagcagctatttgaatgtccccaccgcctatctgaaggccgccctgccattggccccgccgcgccccgcccatcgtggccagagcttcaagttccgcagccccagtgcggagggcggagactgcgccgacatggagctgttcctcgcgggccgccgggtgctggtcaccggggcaggcaaaggtgggcggcggggaaaggtgggcaaaggccggcggcgggcagaggcgggcaggggacgccttcactgagcccgctcccggcaggtatagggcgcggcacggtccaggcgctgcacgcgacgggcgcgcgggtggtggctgtgagccggactcaggcggatcttgacagccttgtccgcgaggtaggtcccgccgggtcccagcgctgcgaggcggcgagccaggagggggcggcagcgagcgggggcggtacctctgtgcgcgactccgcctcccctcgcgggcgctgcgcttctcaccgcggcctgggcgcccgcgcaccctctctcggggctggtggcctgcgtgggcggccgggtggtcggcagagccgccggggcccccgggctcagaaagaggccgaaatggctgcgaagcaggccccgggcaggagtcgctcgggcgcagggaggaagtgaaccggccggaggtagcgcccggctgctggccccacagtcccgacaccttcggaactcctaactcctttacttgtccggctgaaaggtcaccagccccagtccccagctgtgccgcttgctgggcacagagcctctggtaactgccccctgatacacacagtgcccggggatagaacccgtgtgcgtggacctgggtgactgggaggc

SEQ ID NO: 88475 - DNA, 1151 bp, Homo sapiens
cccggggaggccccgacgctgcccaggtcacgcggcctgcggagggcccaccctgccagccaagctctgctccccaccagcctctcacactagccgcttcccggggcgtggggctagtgccacgtcccctgaagaagcgccagcagggaatccgcccttccaggccaggtcagggcgagctgcctccgtcctgtttccactcaagagatcccaaccgatggccgcctgcttcagcctcggtggcaccagcagggtcagcgcgtgagggctagggctgtggttggacccaggcaaggtgtccaggcatgtcagacagccacgttgtgccctggcccttgggggcaggtggggcacaggccttaccccaaccccagtgccatcctctacgtgcgtgcttcccgtctctgattcgcaggcgaccgtgtcatcaacaccaactgctcggcggtgcgcactcgtcaggccctctgctgcaagatgtccgtggagtatgacaagttcattgagtccgggcgcaagtacgcggcgctgacccgacccgcagagagctcagagccaagctgggtgggggcctcctgtccagccatgccaggccctcgtgcccaggactcccctcgcccacaggtggttttgccacgtggatgatgacaattatgtgaacgccaggagcctcctgcacctgctctccagcttctcacccagccaggacgtctacctggggcggcccagcctggaccaccccattgaggccaccgagagggtccagggtggcagaactgtgagtgtcggagcagacgccatcggagcagacgccttccttgacaccagcccgggaggcacagcagagggcgtggaaagctggcttgagaagggcatagggttgggggcccaagctgatccacccaggtggtttgcatgtggtgtttcaggagcaggccaggaggccctcaccgtactgggcagagagggggtgtctgggccaggtggggagggtctggaggctacgggtcaatggcctgcagaagcccccggctctttttgctccaagaagcttctgttacctgggtgggatctcctaaggggcagcttaagaaagatgcctggggagtcccatgaagagtcaggggtgagaagccctgtcctgggcagct

SEQ ID NO: 88476 - DNA, 1130 bp, Homo sapiens
cgcaagctctcagaggccaccaggtgaggccaggggcttggcgagaggaagcagaggccaccaagggagcgcgggtgtctgggactgggcccccttcctgtgccctgcatctcccacccctgtgctgggaagtcgggcgggtagagctctcgctctcttttggccagcagtggaagtgccctgtgtgtgtgtggcttctgtgtgtgtgcatgcagggctttgattccaaggggagctgttggagactgtggctcaggggccgcctccctgctggtttccccacccggctgtaggctcctggggcagcagttctctctgtggccctggtgcagactggtccctagaggtggggtttgaggccagcgggaggtgcccacctgtgtgccggttgggcctttgagggcagcctgagattggcggcttcctcccctcctccctggcccccgtgaccgccgccatcctgatggccaggtcctctctcagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcggcctgcctcggcgggcgggggtgggcagcatggctgggccattggggcgcccgggctcacttggctctgcgcccccccgccaggtcagcgtctacttgcagaattggtctcatgtgctcagctacgtcagcaaggctgagtccaccccagagattgccgaggtacgggccacctcctcagagaccttgcccccaggattcctgaccactgctggcccctcctgtcctcccccacctcattctcccccagatctgaatctgccttcatcccctctcagtctgggggctgggcatcgagctctaggaaatgtggagcatgggcctcacgcatgtggcttcctcc

SEQ ID NO: 88477 - DNA, 1038 bp, Homo sapiens
gctcaaggtggcatggatgcctcaggacggccccttgcttccagccaagcccctgcccaggcctggaggggaagagagtctgggtgggtgggggtgagggagaggcatctggcttgggagcagttcccagggctgcatccaggccgtgggcatctggcagaggcttccccagtggggctgctcccctgctggccagcctggccccgggagtggtgctggccacaggctcccgagatttcctgtgcccagggcaacagatgtgtgttcagcctgtgccgcggctgctgcaagaagcgagcctccaaagagactgcagactgcccaggtgagggcgcctaccacccgccccgcagcaggcaaacagaccccctccgcctcctgacccccgactcctctcactcgctctgccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatgcgagagcccacagcctgtgaccactgccctctcagacccagggaggcatgagccggggcaggtgcggttggggccagtgggggcttctgaacaacaggatacatctaaatgaaggcagcatctgggtagacaaaagtgggggcttaggtcccctccccacctcccctaggcgcctccataggcaagtggccaaagcctccgggagcttcgtgatgcctcacagccttggaagcaccgcctgcgaggccacag

SEQ ID NO: 88478 - DNA, 1051 bp, Homo sapiens
cacacaccttccacgtgcccctcggtgtccttggtggaggatgctggtggctcagctgtgtcctccctcagtggacgctcggattttaaatcttttcttccataacatacttctctgagctcctctgatcctggtggatttgcccgtgggtcaagaggttgaccccagcttctgctgggttctcagaggtgaggccatccgtggccacagccctccctggagctggtggttcagagcttggggctgcccgagctgcggactccatctcagaggccccggactccctagtgacgagtcctgaatgggctgcccgagggaaaggagggcactcctcacagcagcggcactcgccacggccgcctggcccctcacccagactcagacccgtgtggctgtggctgctgggcccctctcacagtgtccttgggctctgcccgctgccctcccctcaggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagcgtaagtgctgcttccgctgatgggcccgagagagcctcttcatcacccccatcctccctgttgccagtaacaggaacccagacttgtggtcagcaaggctcaaggcccagagctggaagcagacacctggagggcttggcggagtagtcagccagacttggggtcagaacggggaccctgtgcaggccacagcccgtgcatgtgggacatgggctcagtgaatcagatgaggctatgggacaagcttttcagccaggtgaagctcgtctacagctcagggcctcgggtccctgcggctgcccctgcccagcctcacacaggacacctgagcagctgctgagagggaggctggggtccccgggagtgtgtgcatgggtcttgttgctgggccaaaggcacgggacgaggctgctcgcccctctcttagccaccagtggcaaggcctcagcctag

SEQ ID NO: 88479 - DNA, 1610 bp, Homo sapiens
actacaagctgcgtgccgctgagcagtacacacccaaggccaagtaccatggcaacgtgatgctactgcgcgccaagacgggtggcgcctacggcgaggacctgggcgcggactacaacctctcccaggtgcgcaaggggcctgacgggaacggggacagggacaggagtggggtgggacggcagctgatcgcatcccctgcaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaccaccgtcctttcttccctcctccctgacctggcagctgcaagctctccagctccaccccacccagtcacggggccgtgaaggggatgccctctgtcctctggtccccagttcccacacacccctaggccatgtcccagagccggggctgggccggggagtgaggaaggagcccgcgtggcagccccgggcttcccgggaaagcgctgggactggcgggggggggggtaccgaggctctggccaagaaacaccaccagtgagaaacgtgtaggaggtacagacactgggaagttggcttcagctgaggagaggcccctcgtggagaatagtatttgcttgaagtcagtggattgcaggcattcgccctgccaaagatgccgtcacagcctcaccaagacggtgtcaatagcgccactggctggccaggttgacccagaagacttgggtttaggcaaaggagtg

SEQ ID NO: 88480 - DNA, 1048 bp, Homo sapiens
gcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggtgagcactcccagtaggagccgcgccaggtgtttcccctgctggcatcagggtcttgggacatagcagtcgtgcccctgtgcgcctcagtttccccatctgcagagccagggtgcgggcgcaggtgtcactgtggtggtggtgctttgggagatgcacagcccacgcacccctgggtgtcagccctgccgcatacaggccgtccccatgccccctctggagttgccgacccggcgcatcccttccaggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcggtgcgtgtgggtggccaggcgggagtggggtccccgggcctccccagcccttcctccttgttgtctggaccgtgtcccggcaggcataccgcccttcgtcacgggtgccattctgagcgttcccaccccgactcccacctgacgtagcaccgtggggacctgcgtgcgtgtctgtgtgtccttgcgtgggtgccagggctctgcacccagaccagcctggcatctgcccctgtcttcacagagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaat

SEQ ID NO: 88481 - DNA, 1547 bp, Homo sapiens
ttcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggtgcggccgccgggcagggggacagggtgggggccgggtgagggccaggcgggcagggtgctgaccaccgcccccacaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaaggtcaggccctgccccacctccaggccccaccccacctcccaacttgccgagtgtggcctgaccctccccgacccgctgtagggcatcctggctgacgaagactcttcccggcctgtgtggctgaaggccatcaactgtgccacctcgggcgtggtgggcttggtgaactgtctccgccgagagcccggcgggaaccgcctccggtaggagcacggcccctcaccacttccccttccccaccagcctccccatccccagcctgagctccccgcctctgcccccaggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggagggtgagcccccgacactgccctgcccctcccgggagactgcacccgaaggccccgcagcagccccacctccctgtttccctagacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccaggtatgggtggcatggggccgtgggagtggactgggccggggagcagagaccccagcagctaggacctgcctgggagcccctcgggagggaagggcaggcggtgaggggctcagtgccgtctcccccagggaagtggacctcccaggacagcctgctaggtatggagttctcgggccgagacgccagcggcaagcgtgtgatgggactggtgcct

SEQ ID NO: 88482 - DNA, 1050 bp, Homo sapiens
ggaccacagagggcacccacagctaggcatgcagcttgggagggagcagaggggcccggtgggctctgggaggtggccccagggacctgggagttccacagcaccaaccaggccctgtgtgcaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaaggtagccccgccccagccccagcccagtgcccccacccaagtatgccgcactcacccagcctgtccccacagtggctgacgtggtggtgagcaggtggctgagggtcacagtggccggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaagggtgaggtcccagccctgctggcttcggacacctctggcgatgaggagcgatcgcctcccctcacgttgaccccagacttgcttctccacggggccccctttggggtcagcaaccctagcccaaccctccggccggagctcacgatggcggcctccctccctcccccagcccccagccttcctcgtccctggtcactgttcctcagtcttgaaagggtacttgggggcaaagatgacagattcagcctaaggtcacaccttggctaggcacagagtagcccctgcagctgaatgcggcccctcactgcgtccacagtgggcaggagtcagcctcccagtggtgggcagccccttcctcaaccctcagctatttctcatcctgtgggcagagcggggtggtggccccagaaggacagagtgggtctgagagcccatgccaggcagatgccctggggctttgggaacaccaggc

SEQ ID NO: 88483 - DNA, 1902 bp, Homo sapiens
atggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccaggtagggcccagcctgccagcgtgtgagcaacgccagccccagggctctggctttccctggagcccaggagctgcagtgttgagtccggggcccctgacagcccctttgctaggcagagccttgtgctgggggcaggacgggaggggaggaggggtctcagtggggctgtgtgggggccataggggcttctttcctatcaggagacctgggagggtcgatggggcgcgggggtggagatggcctagtggggccgggggccgcccccaacagctgcacctgctggaggttgcaacctgagtgtcctgttcccaccccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggtaggtctcccggaggggcccccagcacctccaagaaaggaggctgccttctcgctgtggggtcctcacctgcagccctggcctggcccccgtaggatagagtggcccccgctggcccggggacacccagctcggacacagccgtgcgcgagtcccctgcagctgccccactggccccacacctggcagccttgggcctaggcacgtgtccatgggcatcaggcctgcgtggagcccccgtgtgatgagcacacagctgcagcatagcaagaacccaggggctctggtgaagccaacacacgggtcatcagggttccctcagactggtgccctctgttggcacccatctctgagccccatgggccacatgtgggcaggacctggaaagaaccttggctgcagaggactgagggggccaccatctggggactgggctcccaggagctgcccctggagtggcagctctgtaatgacacctccacccacgggtcaaacacagcagggggcgaacctttctcatgaaggctccaaggctgccattaccacacttgtcattactgcccccagctgcaggcagtgtctgggtgggtgggtggctgggagcggctcggtgtccacgctaagcctctgaggctggctctgccataggcttgtcctgggaggagtgtaaacagcgctgccccccgggcgtggtgcccgcctgccacaactccaaggacacagtcaccatctcgggacctcaggtgggtgctgcggcctgggcgggctcctctgtcccctgcgcctgccattgcaagtctggcagggacacgcggccacggtctacgccccaccaagctctgacgggcctggggcatggggcaggtttgtcctcaggtcccttgcccattccctctcggttcccttggggtgaggtgggtgcgccctacctctccgagcctgaggtgggtgcccagccaggatgcttatccaggctcccacgatgtccaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtggactaatacggcctggggggtgcggggcgggccaggggacccacaacccagcactgacctggcccctcatgcaggtgatccgggagccgaagccacgttcag

SEQ ID NO: 88484 - DNA, 1120 bp, Homo sapiens
cgtgcagtgtgtgtccagcctggtggcaggaggtgtgctcaggggtctcgtgtgctcacagccccacctgagccgcagcacccttccttgcagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcgggtgagtgtgcggctgcgcggccagggcaggcgggacagtggcacaggacggccccccgcacagtccccacgctgagcaggatcctgccagctccggggatcccccacccaagcacccaccccacaccccagagctcctcctggtggggtgggggccggcgtggggctgagccccgggcctgaggtgctgctctacccagggaatgggtactgccgctcggagggtgtggtggccgtcctgctgaccaagaagtccctggcccggcgggtgtacgccaccatcctgaacgccggcaccaatacagatggcttcaaggagcaaggtgggctctgccggggttccggggtgctggggggcaggtgggagccggggctggggctgcagcactgagccgagccctccgcaggcgtgaccttcccctcaggggatatccaggagcagctcatccgctcgttgtaccagtcggccggagtggcccctgagtcatttgaatacatcgaagcccacggcacaggcaccaaggtgatgccccccccccccgccccactcaccaccccatgagcctaacctacgcccatgcctggagaggtgacctggccagagcccctcaccccccatgtttcccacaggtgggcgacccccaggagctgaatggcatcacccgagccctgtgcgccacccgccaggagccgctgctcatcggctccaccaagtccaacatggggcacccggagccagcctcggggctggcagccctggccaaggtaggtggggctgggcttgggggtccctcaggctcctgctccctgggactgggttgcgccat

SEQ ID NO: 88485 - DNA, 1089 bp, Homo sapiens
ccggggaaagccaccaacagccgccttcgcttcccgtgggggaggccgcggaccctgaagggcctggaggagcccccggctcggcctccccgcgcccacaaaggcgccgccgcatcctcctcccggagccgccccggagccgaggcccagcccgaaggggacgccgcgagggaggaacgggggggcgcaggggccgcgccgggaccggcctccccatcacgtggcgcagcccggccgaagcgcaggggtcccgagcagcccccgcccggggcgaagggaggccgggcgcgccgcggtgttcccaccccctgcctggccgtcgaccccgcgtgaatagcaagcggcgaggacccagcgtgcgggcctggagctggcccggggcagccaagcctctgtgaatcgcagcgggtgggaaggcggccgcctccctgccgggacggcccaagggaggccgcactgccgaggggcggcgcgcgtatcaggccctggggcctcgtgcaagtggccagaccagcgctggcctccgccccctccccccagggccgcaccagccctcatgctggaggaggagccggcggcctgggcacccgttccgggtcttagggacctgggctccagggagggcctcctgtggtgtgtgggttggtatggggaggcaagcgtctgtgggttcacccgcgcaggtgaagggtgccaggcaacacctgcgtgtcctggccaggagtggttctccaggttggaccctgctggaggggttggactggctgggtcggtccacagtggggcaggggccacctttcccccagagcataggctatccccatttcgtccctccccagccctggtggctcttgggctggcctggacagcgggcccccaccccaacacgggtgagcatgggtgctgagtacccccctctagggctcccagccacctccatgccccggctttgggaccctgcctctccatttctttgatggcccttagcaggctggccacctgaggccttgtccccatctcaggtgaccctgcctgctcctcactgtgagccccctggtgccctagggatggcctgggacaagctccagg

SEQ ID NO: 88486 - DNA, 1040 bp, Homo sapiens
tcttctgcctcagcctcccgagtagctgggattacaggtgcccaccaccacgcccagctaatttttgtatttttagtagagacggagtttcaccatgttggccaggctgatctcgaactcctggcctcaagtgagcaacctgcctcagcctcccaaagtgctgggattacagacgtgagcctccgcacctggcaagtttttgcttcttctttgtgcctgccacagaaagggcgtctgggtgcttctgttagcgaatgtgcttgctgcccccgctgtgaggacagcaagggctgtgtgtggcaggggcgtggcattgtgtgtgcaagagctctaccgaaatgctgtgtgtcacagttcactgttgtccggccctccccaagttctcgatgtaatggaagttactttggttttgaaaaggaacatgctgttctttctgagtgtttgcattcaacacaagaggaatccagaagtgatgcacagagaacaaactctgtccccatcccattcccagggtggctgttgcaccacgccctccctcctgcccctgaggcccggaagccaggcgaggagcccaggaggcctttggatcgcagcccacctttgggacaggtgcagccccattttacatctcaggtaacaccccttcatctaagacatgcatttttaaaaatatttccctaattgtgtcgttttcattacagaaacttcagattacaataaacacaatataaaaagcctccaattttcaggatccagatatagttattagtaacatttcaatgtgttttctgctgggtttttgttttgttttggtttggttttggttctcatttgtttgtttgttttttgagacagtcttgctctgttgcccaggcttgagtgcagtggtgcaatctcggctcactacaacctccccctcccggttcaagcaattctcctgagtcagccttccgagttgctgggattacaggcatgcaccaacacgcctgactaatttttgtatttttagtagagatggggttttaccatattggccaggc

SEQ ID NO: 88487 - DNA, 1089 bp, Homo sapiens
gctgggccgacccgaaagtgagtccgggaagtggaggccatggcctgagtgtgggtcaggttctgggtgtgcacctggttctgggtgtgcgccaggttctggatgtgggtcagattctgggggtgcaccaggttctggatgtgggtcagattctgggggtgcgccaggttctgggtgtgggtcaggttctgggtgtgtgccaggttctgggtgtgtgccaggttctgggtgtgcacctggttctgggtgtgcatctggttctgggtgcgggtcaggttctgggtatgcgcctggttctgggtgcgggtcaggttctgggtgtgtgccaggttctgggtgtgtgccaggttctgggtgtgggtcaggttctggatgtgcgcctggttctgggtgtgcgcctggttctgggtgtgcgcctggttctaggtgcgggtcaggttctgggtgtgcgcctggttctgggtgtgggtcaggttctgggtgtgcaccaggttctgagtgtgcgcctggttctgggtgcgggtcaggttctgggtgtgcgccaggttctgggtgtgtgccaggttctgggtgtgtgcctggttctgggtgtgtgcctggttctaggtgcaggtcaggttctgggtgtgcgcctggttctgggtgtgcgcctggttctgggtgcgggtcaggttctgggtgtgggtcaggttctgggtgtgcaccaggttctgggtgtgcgcctggttctgggtgcgggtcaggttctgagtgtgcgcctggttctgggtgtgggtcaggttctgggtgtgcaccaggttctgagtgtgcgcctggttctgggtgcgggtcaggttctgggtgtgtgccaggttctaggtgtgcgcctggttctgagtgtgtgcctggttctaggtgcgggtcaggttctgggtgtgcgcctggttctgggtgtgctcctggttctgggtgtgcaccaggttctgggtgtgcgcttggttctgggtgcgggtcaggttctgagtgtgcgcctggttctgggtgtgggtcaggttctggatgtgcaccaggttctgagtgtgcgcctggttctgggtgcgggtcaggttc

SEQ ID NO: 88488 - DNA, 1052 bp, Homo sapiens
cgcacacccagaaccaggcgcacacccagaacctgacctgcacctagaaccaggcacacacccagaaccaggcacacacccagaacctggcacacacccagaacctggcgcacacccagaacctgacccgcacccagaaccaggcgcacactcagaacctggtgcacacccagaacctgacccacacccagaaccaggcgcacacccagaacctgacccgcacctagaaccaggcgcacacccagaaccaggcgcacacccagaaccaggcgcacatccagaacctgacccacacccagaacctggcacacacccagaacctggcacacacccagaacctgacccgcacccagaaccaggcgcatacccagaacctgacccgcacccagaaccagatgcacacccagaaccaggtgcacacccagaacctggcacacacccagaacctggcacacacccagaacctgacccacacccagaacctggcgcacccccagaatctgacccacatccagaacctggtgcacccccagaatctgacccacatccagaacctggcgcacacccagaaccaggtgcacacccagaacctgacccacactcaggccatggcctccacttcccggactcactttcgggtcggcccagctctgcacggagcctgttccccatctcgatgagctgctctttctccaggcggaggctgatgatttttctggctgcctccttcagctttctctggagtcggtgcatagataaggtctggggggcacgtgccactgaccggaggtgcaggaaaagctccccctggtcctcggcctccataggccctctcttggtgaggccctgtaacaaaactcacaggcagacacccctgtgaggctgccctcatgggaggacgccaggggtgcccacccaaggagcctcttcacctgctcttccagggtgggcactgctggctgtcactgggtgacatccttccaaaagaaagacaaaaagagtcgctgctcccagtgcttcagtgggttccttctcttccacaaatagaataa

SEQ ID NO: 88489 - DNA, 1030 bp, Homo sapiens
gtggctgggtccaccctgctctgcacttgctctgggggctctcccagccctgcccaccccgtggctgggtccaccctggtctgcttgtttgctttcatagctccgttcctttgtgcataaccgcgtttatgatcttttaaggttgttgctttcctccctctccctgcatgctggctcttctggttttgtgggcatcaccctcatccatggtgttgggttttctccggcatctgggcatccttggcgcctgctcgtctttgtattgggcgtcccagtgtgcccatccacaggagctcgggagcatgtcagcccagcgcaggccatgcgagagcaggagggacagcggcagccctgcctttcccatcgtgcctctgcttttcctgtggaagggacctcaggaagcattaatgctgagcggttggacgtgtccttaggtacaagcaacagctgtccctggcagtggaaagggagcggagcctggagcgtgatcaggtgcagctgggcctggactggcagcgccgctgtgatgacattgaaagggaccagatccaaaagtcagaggccctgattcagggtctgagcatggcaaaaagtcaggtgtgtgcggccaccagggcctggggccttctcggcgtctctgcagaggtggggctgggcaggacgggtctggttcttaccaaatggttctttaaatttgaaaacactaaacctcactgagtaattagagtaataaattagagtaataaaaatgcaccccgcctgtccacccgccttgactttcttgcataagctgtttctgtagttgaccagccgcgtggtttgagtagcgctgcatgatccccgctggcctgcaagggcagcctggggtatgcatgggcaggaagggtttggcggcctggccacagtggggagcctggtgctctgagcatctcccacctatgtgtgccattggagcctcagcaggcatgggagctgcccggtcatccacacagggactgagtcccagcgtttttcccaggttgctgccaag

SEQ ID NO: 88490 - DNA, 1126 bp, Homo sapiens
cggtttttggttgtcaggttttttttttaattgtatcctggacattttgggttttatgttgtgagactctgggccctatttaatttcctcttttatagatgggtgtagcatgctggtccaggtggggctggaagttctgctaccccgtgggtcctgctgaagccaccccttcataaaagcaaagcaccaactttcacatgtcaagtgcaccttgaaaatgtattacctttgctgaatatttggtatggcttttcttaatgctgttttattaccatagtgacaagaatggtgagattgaccaccaccgggaacagtatgaaaatctaaaatggacactggagagaaaacttgaggagctcgacggtgagcttgctctgcagagacaggtagagcctctgggtcggccccttcctgggtgctttccctgcctgcccactgtgaaactgaaatcatatagggctgaggaaaagacaaccatttggttcattgcctgcattctccttgggagtaaaatggggtctttggggcagatgccactctgggatggtctgcagggaaacaggatgggatgtctacatgcagccacctccacagtgtttccttgttttctttcctcatggattagtcagggttctccagggaaacaggcaataggagacgtgtagatatataggagataaattgtaggaattcactcgtgcagttacggaggccatgaagtcccacagtttgtcatctgcaagctggaaaacctgggaagctggtggtgtaattcagcccaggggcaaaggcctgagcaccagggagccactgatgtgagtcctggtccagctctgaaggcccaagatgcaggagcccaatgtccaagggcaggagaaggcgagtgtctcagctcaagcagagagagcgagttcacccttccttgcatttcgttctattcaggccctcagtggattgaatgacgcccatccacaggaggagggctagtctcttctggaaacacccttgcagacactcccagaaataattttttaccagctatccgggcagcccgtagcccagtcatttgacacatggaattaaccagcacacctcagaaatgatgaaacttttaaatttattttta

SEQ ID NO: 88491 - DNA, 1073 bp, Homo sapiens
tctgcaccccactctgggtggtgttgggagcacccaccccacacctggctccaacgcttgctcccccacagtggccctgggtcagaccccaggcccaggccgcccttttctgcaggaaaggaggtgggggtgtggacaggtggcaccatccctggccagtgagcagcttcacaggacgcccccctctgaccccacagcccccagtcttgacttctcccccagacccaggtgcctccacctgcccctggctgccccaacttccttttgttcccagttccagctacagggccctccaggccctggaatgtcctcctaggggcctggcccccaggtccttcccaccctgctccctggcaggcttaagctccctggggtgcgcagtcccaccttttccaagagcaacctttgtgggaggggggcgggcaggaaggggaggctgggatctgcttcctccccatgggctgccccgagagtccctacctctgtgtcctgaaatgacttaggaaatgcggagaggcttttctccaagggtcaccacagccgctgccccagggagggtggcagaacaggcccccggacctatcagggccagatctcaggtcccagggaaccttccagggtcgggggagccacacagcccacatcctgcgtccttgggaaccccgcacaccattttccagatcccagcagggccaccccgtcctgacccagtcttggccgtaccacccagcaccagttgccgccccatggacaggactggggccaggactggccgggtcaggggaagaaagccgagtcacggggaaggacattccggccgagccacagccccgcctccctggggtcctgggctgcccagctcctgaccctgcctgccttacagctccctgcccagaggatctggtgacacaactgtcacagcctgtcattccacacctgtggccacaccgtccccagactccagacccacgcggggcgtgtggcgggacgtgcccaggctggatgggggatgcagccaggacggtgccaggggaggctggtgccctccaccacacagagcctagacccaggac

SEQ ID NO: 88492 - DNA, 1121 bp, Homo sapiens
atacgaaaagtgggttggtcaggagcctccctgggtgttgggccagtcaagagacaggagccgcagagtggaagggaagcccttagctctggccggggcctccaggggtggctggagtcggtgagggacgatggggggagccgaggggcggctgtcctcctctctgtcccagaggcatgggctgaaagggtccctctcctggtgatggccagagtcaggcctgctgggcgggaaatggcagttggcccaccccaaggcccaggggcttgtccatgctgagcacaagggtgggaggtcttgtgtctgttggggccggggagtccaaggtcccagcttcactgcacaggcctggaagtcaggtgggtgctggcctgaccctgctgaaggagggtctattccgccagcgtggtgtggaggcggctgggctcgactccctcatggagggaaggaactgaggaggtgctaggaggccgtgggggggtgtctgcccccagagaggctttgagtgcatgggggctctgccgtggcacgtgcagcgtctgtcccccagggccccatggtgtggacagagtctggggtgggcacctggaggcctggtctcaaggcaggcttggtaacgaccccatgtgaccttgggcagggcccgccatccaggccacccagaaagccatgtggcctgcacgatcaggccagaccccactgactggagcggggcactttactttggaggggcagctaccagagggctctatggatcccagcccagccgtcaggccggacgggtcccccctactggcctgcagtgacccttatgccaggctcggctggctcagcggtgggtcctggggtgacctggccacgtgggacagaagggcctgtgccgctccctccagtgaggtgccaaatgtgggccacactctgggccccagcgggggccttccgggcagtggcgcagagccattggaggtgcccgggccctggggcaggggcggggcgggagcagacagagctcagggcgtcctcctagcgtcacctgcccgagtcaggcccatctgtgaaatgggccacgccgggcagccgcacgcaacggaaccgaaccgccgggctcctgctccgagacc

SEQ ID NO: 88493 - DNA, 2299 bp, Homo sapiens
gggggctgcttgtcccaggaggtaatctgagtcctggccgagcccaaaaaagccactgccctttagagccagctgtgagggtgcaggaggcagtgcagagggagtgggacccacagctgctagcctccctccaaaccctcctgcctccaccagacaccaggtcagggggccacaagtgtgggtgccgggcagctgcccctcagctgagctgccgggccacccagctcgtgtccctcccctgccaggctgcagctgggatggtcacccgggcagcctgagtcagcctgctttctctctcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtgagggtggcctcacaccgggccccctgtccggggctctgctggcggatcctgctgggcgcgtgtagctgggctcagcaacagggccttccgcctgctccccagggaaccctggagggaagcccttggggccaggatcctgctgggcagcaacatgctctccacggggccaacccaggcagggcgcgaagtccatcctggcccctgtccaaacgggtcggctgtatttatagaccgtctcagaggacaggctcctgagagccgttcctgaaaaggtggctgttcctgagctgcagggacccaaggggcccagcaggcggcgctcacgtgtcatcatggcctgcgctcggggagcctgcccacggggtgcccctggtgccccgcggggggaggggtggtgtgggaaggggaggccggctccaggctgtgagctcagtcggctggcgggggtagagctggctgcaggcccggcccctctcagctgctgccctctccaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctcgagtgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggc

SEQ ID NO: 88494 - DNA, 1028 bp, Homo sapiens
tgggccgtgaccaccaggggcctcatgagtgcggcacacacgcagcagttgagcagcaggccgcccaggatgaggaagccgccccgccagccgtagcggtcctgcagcagctgccccagcgggctcagggcacacaggaagacagggctacctgctgccgccagcccgttggccatggggcgccgcttgctgaagtagcggttcagcatgatgagcgagggctggaagttgagtgccaaacccaaccctggaggaaagggaatgtggtgagagccccccaaggctgccccaaagcccgagaccctcatctctgcccccaggttcccacaggctcaggctcccagggtgcagagcccctgccacccacccactcgagagggggacaacgaggtggggccgggacaccccgcagccacccgccctgctgtcctccagaggcctggacccaggagcagaagtgcacggcccctgcccctcctggcacgtgcggcccaccggccggccccactcacccgtgatgaccccagtggtgaggtagacctggatgatgctccggcaaaaggacgcagccaccatgcccagcgacgcaaagagaccccccacaagcatgacgggccggcagccaaagcggttcacgcacacactgcagagcggacctggagagggcagcagctgagaggggccgggcctgcagccagctctacccccgccagccgactgagctcacagcctggagccggcctccccttcccacaccacccctccccccgcggggcaccaggggcaccccgtgggcaggctccccgagcgcaggccatgatgacacgtgagcgccgcctgctgggccccttgggtccctgcagctcaggaacagccaccttttcaggaacggctctcaggagcctgtcctctgagacggtctataaatacagccgacccgtttggacaggggccaggatggacttcgcgccctgcctgggttggccccgtggagagcatgttgctgcccagcaggatcctggccccaa

SEQ ID NO: 88495 - DNA, 1677 bp, Homo sapiens
gaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagtatgtggttttgctgtgtggcctgtgtcctgactcgcacgtctgctgatggcctggctgttcctaccgtggctctgtcctcgccagctttccctgcagcggcatagcattcgtagcaggggcaggcgctgcatggagggggctgcggggcaggtgcctggaggccgctgtgccagggtggcctctgaaatgtgccagggagcccctacgtggtggttagatgggagctgaggtggaacaagccactttattcactgctgtgtttaagaaacaggaccctcctgccttccctttttcgcccctctgcctggctggcagtgtgcgtggtgtggtcagtgcccagggctggtctttgcaccctgtcctccatccagcccggcccagcgcttgggcttgtcctggacacctaacacccacctgccctcgtggccagcagtggcctgcgtggctgggagcccggtcagaggccgccggggccctcagtaggtgcgtcgtgggcgctggggacggcagcgggtgccctggcgggccgcgtgcagccggagagatgccatgtccctgctcctctgcaatgaaaagcaagcgaaaagtgcacatctcaggtccagctgtccccatctgcccctggccttgcgccagctgggcttgagctcttgcagcccaggctcctgcctgcagcctcagggctgtggaggcctctagcagggctcaggctggcgggcagtgccagcagttgcagggatcaaggtcagactctgcacagctaggcccatgtgtctcggcagagtccaccagtcccacccagcagctgaagggagaaagacgaggaggcagggagcagacgaggaggtggggagcaggcagcccgggcctcagaggacacatggccttcccccgctggcacccccacatcagggccaccaggggactgctcacacccaggggttgccgcctctggacctggctgtccctggttctgctgacctcaggagtgacctgggcttacagaggtactggcagggaggtcatgggccgggtgaggggtgctcgctcctggaaccctgtttccaggtatctcgggccctcaccctcccctaggcaggaagcagtctctctagctcaactgtcacccctcgtctgcc

SEQ ID NO: 88496 - DNA, 3367 bp, Homo sapiens
atctcacaggaaggctttggccgtgtgtccttcctgccagactctgccagcaccagcacacgtggtggctgtgagcagcagctcccgttttgaatcccaagggggaatacaggaggctcaattgctctgagcgcctcacctgtttgctcgggtgagctggagacacagtcaccgtgggcagtgactcatccccggccagtcttcctcctcgggccgtcgctcttccctgttctttctgctcctctcaggagaccttgcgccctgtggagatgggaggaggcagcaggaaggtctcccagggcttgctggccgtggctgggtgtggatgggtggaagaccacgtggcagcctgcctgtaggtcacagaggcccccatagttgtagggccccgccccagcccggactccgcctgggtctgttccctcttcgccccctctcttttcgggctgttggtgttcggccagggctctttggctacagtagcctgggccctaaaggccatctagttgctgagtctgtttggggtttttacttggtgagaagaaggccttgtcattccaacagtcgatgactcgctttgatcaactcctgcccaggactaggcctgagccctgtcgtcgtaccggcgaggatgtgcgtctcccctgccttcaggctgtgccctgagacccagttgtggggctgcccagcacctgccatcctgctgggatcaggttttcttagtgcttgagaagactcaggagggcctgtcccatgccattgttggccttaagagcaagtgattccagaagaggagtgggcaccactctcatccagaggcccgtcctgagaggcaagtgaggctgtgctctgtgcctgggctcccccaggtggcacctgtcggtctgtggacctggttgaggcaaggatgcccatctggacatggagccgacacaggtagtcagggggccagcgggacgcttaccaacagctgtcttttccccacctcagaatagcattcctttcgaacaccacggcaagtagctgctcgtctcccatcggaaggcagcactgggtgagtgtgcgcgtggcgggcgccaggcagcagcgccaggtgggtgggagccaccatgccccacccatgggagcttgcaggtgggctgggcttgcatgccaggtgctggaggtagagtgaggcttcttctgctctgttcttcttgtggggtgcagagcggcggcagtccgctgcccagtcttggggggaggctgtccacagagagctttggaacagagtgaccccaggagaccatcctgttggcctgtggcctccccgtgactgcgttccgtgtgccgttgctctcctcctgtcctgggtgcccacccgtgaggcaggagtggcaaggcgggtgccccgagcacttgagttgccttgtctgcggtcggccgtgcctggaggggcgtctgtgtcctgctcagctgggtggctccacgcttggtgttgggggctcctaagctcttgctgcgccacactctgggcagtctctgccatgccagcttttctagtcgcctctctcttcctgtctcatttatctctgtccttgttttgtgtttcttttcacacttggtctctgcccagccgtcttgtccacgcagcttcgtctgtattaactcctccagccgcagcccactcactccccgccgtcggtgcatggccggcgtccacgctgtgctccctcctcggcggccacgcgcgctcggcggctccttccagcaggggcttgcgcttctgtcgggtctgtgccgctgggagacccgctgcagttttcacactgtgcacactctggaaatgtgttgacaggaactgcttttcatgtcttccctgagaggggtacccattttcaaacaccaggttcctttccaggaagggaggcaggagcacccgtctccgctccactcggatccttcgaccctgccgagcccggctccgcgggcaccttgcttgcatgcctcttcctccttcccgtcttcctgtcactcgttctgctgagcacgtgtcccagccacagaggcccctgtgcgtggcgggggacgcaggcgtctagactggggctaggcggtggcggtgcgtcccctccctgcccagcaccgtcactgtggtatctgcctggccggctcccccagccccatgctgaccttctcctgtgctttggctccgacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggca

SEQ ID NO: 88497 - DNA, 1051 bp, Homo sapiens
agcggactgccgccgctctgcaccccacaagaagaacagagcagaagaagcctcactctacctccagcacctggcatgcaagcccagcccacctgcaagctcccatgggtggggcatggtggctcccacccacctggcgctgctgcctggcgcccgccacgcgcacactcacccagtgctgccttccgatgggagacgagcagctacttgccgtggtgttcgaaaggaatgctattctgaggtggggaaaagacagctgttggtaagcgtcccgctggccccctgactacctgtgtcggctccatgtccagatgggcatccttgcctcaaccaggtccacagaccgacaggtgccacctgggggagcccaggcacagagcacagcctcacttgcctctcaggacgggcctctggatgagagtggtgcccactcctcttctggaatcacttgctcttaaggccaacaatggcatgggacaggccctcctgagtcttctcaagcactaagaaaacctgatcccagcaggatggcaggtgctgggcagccccacaactgggtctcagggcacagcctgaaggcaggggagacgcacatcctcgccggtacgacgacagggctcaggcctagtcctgggcaggagttgatcaaagcgagtcatcgactgttggaatgacaaggccttcttctcaccaagtaaaaaccccaaacagactcagcaactagatggcctttagggcccaggctactgtagccaaagagccctggccgaacaccaacagcccgaaaagagagggggcgaagagggaacagacccaggcggagtccgggctggggcggggccctacaactatgggggcctctgtgacctacaggcaggctgccacgtggtcttccacccatccacacccagccacggccagcaagccctgggagaccttcctgctgcctcctcccatctccacagggcgcaaggtctcctgagaggagcagaaagaacagggaagagcgacggcccgaggaggaagactggccggggatgagtcactgccc

SEQ ID NO: 88498 - DNA, 1397 bp, Homo sapiens
cggaacccggctacccgcggcctcccttccacagcctccggccgcctgcgggggacgcaggaagtggctccccccacacccctcacccctacctcacacacgggtgagtgcccccctcccagcgctctggggctggctctggggtgacttcttgtgtcttggggttggtggggacaacagggtacttggtggtggacactaagtgccctgtgtcaggcgatgctcgctcctgagggtggatgagccaggctgcccaggcgcctttagaaatgccggcacctgctggtgtgcgtgattcctcccgcatctcacgttcctcccctgtgagccccttgacctcgctcccatgtccctttgtgtccctccggccggatctgagtgttggtggccatcggccacagccaggtcctgactgtccaggcagcccagggtcctctctggccacagcctctcatagaaagccccgagtgagaggcagcagacgggggcggcccactccgtttctctccctgtcctcagctaacacctccccccggcccgtctccggcatggagagagagcggaaagtgagtatgcggctgcaccgcggggcccccgtcaacatctcctcgtccgacctcacaggccgacaagatacctctcgcatgtccacctcacaggtaggtgcagagctcccgggcgggcgctgggcctcgggctaccccgtccgagtcaagagcgggctgtggtttctccagggcttcttctttcctttcttccccccatttttgagagtttttaatctcgccagggtgtggcgtcttggttgcagatgaggcttctcgggagggcctgggagacatgctgggccgtcatggggcttgtctcctggttgcaggtggccagtctcaggtctcaggtccctgaggccagcaaaccgtgggggctttctcctgctgtttgagtgccccgctgcccgcagccgtccccaggcagctgacaccgctcgcctgcttgcgccccattgtgggtgcccccagcccgagggagccttcctcattcttcctcattcttgccactggccagggatggaggcccgtagggacctccacgggcttcttgtgagaccctccctggtggcatgccctgcaacgaggctttccttcttttgacggcctcacctgtcttcccttggacgagaagtaccctgttgcgcagcccaggcctagccacggccaccgcctcttcagcatcctgcagcggtctctcctctcctcgctctggcttttgttgtcttttgcgtttgctaacgtgctctttgaactagaacagctttctccatatggatccattatatttcttcaaatagttttctgggttgttcgccaacaggggcagggttagtggggcagggctgt

SEQ ID NO: 88499 - DNA, 1218 bp, Homo sapiens
ggggcctctctctgcagtggctgccctctctggccccctccaggagctcgggagatttcctttgcatttgtaggattgccccaggatacacacctcaaatgaaactaaattgtgctttatgacttcttttttttttttaagacacagtctcactctgtcgccaaggctagagtgcagtggcgtgatctcggctcactgcaagctccgcctcccgggttcataccattctcctgcgtcagcctccccggtagctgggactacaggcgcccgccaccacgctctagaactttttttttttttttttcagtagagatggggtttcactgtgttagccaggatggtcttgatctcctgacctcgtgatccgccctcctcagcctcctagagtgctggggtgacaggcgtgagccgccgcacccggccgtgacttgaatacttttcgatgctttctcaaggcttcaggtcttagaaatctgacaggtgttttgcatctgtccttctccccttgagtgtgcagcagcaggaggtagacagcgacgttggcagagacaccttgagtcgcagttgggtttcatgagttagctttgagtttcttgttttgtagccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttgtaagtcgcactgccagcacgttcgctgagtgtggtgtgcgggggatggcttgtcagtgagaggccggcggccgtcttgttgaggggctgtaccatatagggagtgtctctggttgtgaagggcaagtgtgtagtgggcaggacctggactgagtgggtgtctgcctgccagaaaggggtgccaagaagtaagacgccattagggaacgcagaggggtccatggaattcctgggtgtggacagcaggaggccccttccctccctgtcaccaagcggagctagggcccagagcatgccctgggggcagagggtgggggctgggggtgcgcattcccattcgctgtgccacatggtcgtggtgcccacgagatgagtggggttggggcctggtgaggtgctacccgtctagcctgactgaccctgtcatgagctgattttccctgtggctttcttgatgcggtgtga

SEQ ID NO: 88500 - DNA, 1089 bp, Homo sapiens
aagatctgcattttagaaaacaaatgatgtccgagaaggcaaaaggcctaattctggtggtggttcttgaattcactttgagactaaaccggggagttgacaaataatgggaagaaattgtttcatccagaagccaccagatcttgccactgccattcttgtgcagtgtctgctatggatgatgcagattgtccccttgtgcagattgtcctgttatgggtggtacagattgtccccttgtgcagtgtttgctgtgggtggtccagattgtcctgctatctctgaaaaaaagggcagcaagcaccactcattgcggttttccttcctttcacgtgaaagtcaagtggtggtgccaggttctgatctttacgtttgcttgatggatgctgccttccaggagaaagctccacagcgagtgcattctgttctctgcagcttgggaagaatgagccttaaaaacacactggtcactgcccatagcagccctgggcagtgggtactgagctcttcagccttatgttgcaaatgaggaaactgggtttagaaggctgtgtaacttcacagaggacagacttgaacttgggcattctagccccccaggctactgctgaagcagctgtctgctcccagagaaggaaatggcggccaccctacgtggccttcagctgtcaggaatgtgccccagatgctcccacctgtcccaaatctggttgggacaatagattcaatacctgaaatagtagaaagaaactaaaagtagctatgttggtggaagatttggatagacacctagtttttatgaaaacctactggactggtgggcaaaacctggggacagttgtaactgctctttccaatcctaacatcccccaaaagcagccttagctcactccctccttggggaacccctcagcaaaggacatttacttagttcacagctgcttttcgtcaaggctgagatggtaggcatggtttgagggagggaagaggggagtacgtgtgtagaacccgggccagtgggtgacggttctgtggctgagggtgggcgactgtcttccatcatctttttcttgtgaaatattgtacaac

SEQ ID NO: 88501 - DNA, 1258 bp, Homo sapiens
tttaaattttgcttcatattgggtcatggtttctgaaatcaagagtgtgtgtgaataggccagacgcagtggctcacacctgtaatcccagcactttgggaggccgaggcaggcggatcacgaggtcaggagctcgagaccatcctggctaacacagtgaaaccccgtctctactaaaaatacaaaaaaagttagccgttcgtggtggcgggcgcctgtagtcccagctacttgggaggctgaggcaggagaatggcgtgaacccgggaggcagagcttgcagtgagcccagatagcgccactgcagtccagcctggatgaaagagcgagactccgtctcaaaaaaaaaaaaaaaaaagattttgtgtgaatttcaatgcatgctccccgtggtgtcgtgtgcccctcagtggtcactggagctgttgccagtggcacgtgtgttgctcagtggggccttcctgatgtgtgatccctgagtgaggcctctgctccttcgcatgctttgcttatagcttgggggaagtcccttcatactctctgggctcgttttctccgagcaaaacaagggttttgaacttggcgaccatcatgacctcttccagctcagttactgtcccagttctgcgagccctcagcccagggccttaggtacctggtgttccacggtgggccaggtgtggagcagagcgctcctgtcctcccctcagagtccagctcttgcgagttccctggactttcaaacagttgggctgatggagcaggagggtattctctgcggggatttcagagccatgaagcgtgtgtctcaacagcagagcttcggtctggcaggagccctctttgggaacagagctttttgtctgaagagtggctgtgccacgtctgtggagccctcccagtgagaaggctccgcggcacatttgtaggtggatggttgggtgagtccccttgggcaactggccaaaggaaaacctgttcagggcctctgttagcccttttgtcacgggaaagggaggactgttgatttgattctttgacatcttttctcagcacaagcacgtaatctgtgctactacaagaaaccgacgtttctaagtttatgtgacacaaaatatctttggcagcacctgtggtcctggggaacccgttacagagaggggcacccagtgtgtcccatcacgggcctcacgtgaccagaggaggccacaggaatgaaaaatcccatcaccaacccagggaaagctcagcagagact

SEQ ID NO: 88502 - DNA, 1231 bp, Homo sapiens
ttgaatttgttttgttgacagaatgtcttttgtataaacagacaacccagacaacctggtgatctgcgtgtcaccaggttttggtttgttttgaatctgacacccagggctcagggtctttcaaattctcattccccttctagtagtgcttctcggatttaacctgtggtgaagaaccaggcttgtaattttcaacctgttgcatgccaaaacttgtgtataaggtcaaaatgctgcagcgatgccagattgcagccacagttactgagcgcctctgtgctgccttgtgcactgatggcagcttgaggatctgactttcagcagcatggctggtagagtgtgggggtgcccccggtgggcgaggtgggacagggctgcaggccagggggtctgagcagtgctcagcgaccttgaggcaggtggtgcctttggaatgcacagaccttggtgttctgcttcttgatgcttctgcccagcaggtgacgaggtccctgctgcaggccccagagagttgccatcctcacatctgtgtacaggacctgcatccagctactcccctgtagagactcggggcgaccttggtgtcggttccacaggagggctggctctgtgtgcttgcacatctgtgtgcttgcacagcgagaggtcccggccccatgatagggtgtgattcgtgttgtgtgccagagcggctggtgatgacttttgccccacgacagtcagtgctgcaggtgtgactggcagacattagctttatcagctacagagaagtggagtgagagatgctagtcagcagactgtgtggccccaagccatcggccccaggccatggggtcactgggctgccagctggcgagggtggcggtactgtccgaggctgcactgcgcctgcttgggggtgcagggagctgctgacataactagtgggatgagtcaccctccctcccggctggcgagttgagttcagagtccaggtccttagaggaactcagagtggtttttcatttacacagtacatttttcgatgaagtcatttctcttgtaattggatagactgtcccaactgtaggcaggaagaacaaaatttgttacctcgagtactctgaagagtctctgttgatagtaagtgacgttcttaaatctagaatggtcactggcggtgacccggtggtggcgattcctgtggaacgcagcagtggcaaggggtttggggcccaggctggaagtggca

SEQ ID NO: 88503 - DNA, 1583 bp, Homo sapiens
tgagccaagatcacaccactgcactgcagcctgggcgatggagtgagactctgtctcaaaaaataaataaataagaagtactttgaaactatctgttctctgatctgagaccttgtcaaacaactttgtgctttccaaagatagattaagacaaattttggtgtggttgtcaccaagtaattccagaggtggagggtggaaggctgtctcctcactcagcattctaccctccaggcctcacctcgcgctgggcatacagtcatgctggatacgggattgcgggcggctgtggctctgacaccctggggttggagcccccagacagccgtcccagacagccacccatcagggtacacgtccagttacttgagtggggttaggcacagctgatttttttttttcccatcagcattggctcctagcctacactgtggtcctttcagacgaccccacggaggaaaggcgaggtggtcacgttagccggagtaaggcagtttgaaagaagcgtgggtctgagcagaatggcagttagagtcaaagatggctgatctgaagactatgagatggatcggtcatccccaccatagttttgtttgggcagccagttacacataaatcgaggaactaggtcttcatcttgacctctgtgtgtcgtgtatattctagtatgagtatcgttaagaccattcctactgttgtcactttggtatcctccaggtggggttcaccttgctttgagcttggcttttgggttcttgtttttctaccggggactttctgtgctttcagatgtttgagaccaggaaggggggaaggctgtgcttcagtggagtgcctgtgggctagaagcgtggtgtgggcctgcctgccccgaccctgctgtgacagttggagggcgggtgctcactgcagggccctgccaggttgtcgtgttccaaaattgccccttcaaagggggcagtattttggggctatttcttgaatgcccaggctttggaaagtgggaccccaaaaagaacaatctgtcttcagtctgagattgccagatccgcaaggcccttcaggagggcaggttgggaaggtgacacagcccacacacacctgtggagcgcacaccttggcagcctgttgtgtgacctggccccggccctgtgccgccctccgcatccgtgtccatgtggtgtggccataaaccagaagttctttcacttatgctggcagagtaccactggaaataaacttggtaacatttgaaaacagccagtgtccttaatgtggaccatgagttcccagccccagaaccacaggggtgtctggcggaagaggactgttcagctgggctaggctagagggagaggcctgctgtgttcaccccgcaggcggcccatgcagagaggcagtgagagcccagctggtcctgcctctgttctcacctgtagtgtgttctggaggttagtggcaggactggattacctggctggtgggctggacagatgaatctgttggcatctgtacttgatcccatcgcaccatcagcttgtcagggcctccatttgtccacctgttacctggatggactgact

SEQ ID NO: 88504 - DNA, 1066 bp, Homo sapiens
agtctcaaggtagatttcaaaaacaatgggattagaaggttttgggttgtgtcatatttacaatggaaaaatatgcacgtgaacacaagtgtgatgaaaggttggcttaaatcttcaagtttgtaatttttttttttttcctgagacggagtttcgctcttgttgcccaggttggagtgcaatggcgtgatctcggctcaccgcaacctctgcctcccaggttcaagcgattctcctgcctcagcctcccgaaaagctgggatcacaggcgtgcgccaccacgcctggctaatttcgtatttttagtagagacggggtttcttcatgttggtcaaggctggtctcgaactccggacctcaagtgatccgcccagttcggcctcccgaagtgctgggaagccaccgcgcctggcccaagtttgtaattttaaagtaacttaattttccgcacttgttagtgggattgtgcaatgcacgagttattccaagatcccctgaatttgaggatatgtagcctgaggcggtgtgcctgcagaggggctgctgcagacctttgaggggagctgttttctgttccagcagccctagctttggggtgtgttttaactggggcacctgtcagctagggtcaggaatcccctgggatgtcagtaatgcctctggtcataccttttagatgaagccacatgtggacagtctccagttctcacacccttcccacttgtcaccagagagaggactcaggacccggtgggctgacagcgttaggacgaatccacacatatgggtggctcatactttcggtgcctggttaacctgccaggtgaccctgtcacatgccatattgttgcttttgaacctgtacatatgccttagtggactgctgagtaagcaggctttagacatttgggtttggctattaaacatttataccaggtggtcagctggatgtgttcttggcagtgtttgggaagtcagagtgcttggtcaatggaagtcgtttggcttatttatagaacaatggattttggcgaaagttttaaccccaggatctgagttacactgc

SEQ ID NO: 88505 - DNA, 1809 bp, Homo sapiens
gagggcatgtcctacctctacgcctcctggatgtatcagcttcaacatggagatcagctaagcatttgcttcacctgcttcaaggctgcctttctagactttaaagacttgctggagtcagaggactgggaagaagacaactgggaccctgagctgatggagcacactgaggcagagtcagagcaggaggggtcctcagggatggagctgagctgggggcagagcccaggacagcctgtgcaggggggctctgaggcatgggggccagggaccctggcagcagccccagaagggttggaagatgcaggtctggacccccactttgtccccactgaactatggcctcaggaggctgtgcccctgggcctgggccttgaggatgctgactggacccagggtcttccctggagatttgaggagcttcttacctgctcacactggccaagcttctttccttcatagcaggggtttctcaaagtggacctgcccccaggggagcccgtggtgttgaagctgggcattacctgggcagtggaccctgccgaggctgaggcctagttactggccctgcagcttgtctccatggtgggctgctatgataccatctacctacagaagatgaccccagacagggccctgaggaccccagggcagcactggaaattgctgctggagcctggtgaagtgtgggtggtgagactccaagatgcaccccaagagcaggacctgcactggtggatgctgagcattctagaaacatcgttaacaggacacagggcagagctggtccctgcagcctcagccctgcagaagaggattcaccatagtctcttattcaccctggaccaacagggagagcaagaagggagactcagcctgtaagccacagtcctccagccaagaacaggatctcagcacccctgagacacagagcaggggtcctgaggaaagcctggctgttgcaggagcctcggccatgggggagctgccctgtttccagcctcagtccagggccccagaactgagagactaaggctcatgtagctgccattgtcctgggcacaccaggacatcagagactgggaagggccagcaattgctgttccacaacagccaggggagcagttggcaaaggaaacatggggagcaactttaggggctgggagatagggcctgttgtggcctcagagggaagcattacaaatattcataacctggaaacaagttcttaccagttgattgtcacatagttctggatgtgttggcctgaatggctgttgtgctgcttgtgacatggggggcagggcacagaacttgtgcctatttcaccttggccatggggagggacattgcttgtaaaacacatgctctgcagaacacaccagaatctgtggtgacctggatgtgttctcgactttgccaggacaatctcaggggtgccacaagaccctgtcagcagcactaggatctctggtctacagtggagggagagctggttttaaatgttggccgttgatgcaatttaaccatttaattcctgttgctctatatgttgtttttaattttaaaaagtcataaaagctttcaaacaagctcctgtgtaagtcattcctcagcaagttttgttgattggccttatccttgtcctctcagtatctgggctaagccactttgctggcttgaaatcccaccaaatggtgggaacagaggatagaagggaagaggagcacgggagagatgagggttctggtcggtttccaggctcatcatgggagtttgtttcacattatttataaagaaatacagggc

SEQ ID NO: 88506 - DNA, 1037 bp, Homo sapiens
ctaacaataaaaaaagttagctgggtgtggtggcatgcacatgtagtcccatctactcaggaggctgaggcaggaggattgcttgagtccaggaggtcaagaccgcagtgagctgtgattgtaccactgcacttcagcctgggcgacagagcaagaccctgtatcaaaaaataaaataggccaggcgaggtggcacatgcctgtaatcccggcactttgggaggccgaggcgggtggatcacgagctcaggggtttgagaccaacctgggcaacgtggcaaaacactatctctacaaaaaatacaaaaatgatccaggcgtggtggtgtgtgcctgtagtcccagctacttggaaggctgaggtgggaggattgcttgagcctgggagttcacgctgcagtgagccaagatcatgccattacactccagcctgggcaacagtgagaccctatatcaaaaaataaaaataaataaataaaaatacatacttaaagaacagccatgttttgaacaataaaaatgtgttgtcaaacatataattaatatagatatgtgccccaaaattttttttaagtctatagaccaaaccacatgtaaaggttgctaatgttggccaggcacggtggctcacgcctgtaatcccagcactttgggaggccgaggtgggtggatcacgaggtcaggaagtcgagaccatcctggccaacatggtgaaatcccgtctctactaaaaatacaaaaattagctgggcgtggtggcgcgtgcctgtaatcccagccacttggaaggctgaggcaagagaatcgcttgaacctgggaggcggaggttgcagtgagccaagatcgtgccattgaactccatcctaggtgagagagtgagactccatctaaaaaaaaaaaaagtttgctaatgttgaggagacagatgatgccaatgatgatgatggctatgacggtggtgatggttatagtggtggtggtaataatggtgatggagatagtgaagatagtaaagaaggcccacaggaagagacct

SEQ ID NO: 88507 - DNA, 1016 bp, Homo sapiens
gggagacagagaggtgtttgcgagttggatgttttatcttgtctttcctgattctttgttagaacacccccagggcttggtttttgttctcaacctgtgattagaaataagatcctaaagtgtcagatctggaaggcccatgagagctgaggagatcaaatgcccggagctcgggagatcagatgacctggggtgtctggagccagtggtggcctcatctgcagcatcttcctctgtcctgcccaccacagagtccctgctggccccggggggcccctcctccgccacagggcccctgagcattgctgcgtttgtttctccagctcctccttcctgcagaagcagttcccagaggggcaatttctccagcctgcctggttggttgtgttgattggttatagttgctctttcaggtgaccgcagaccctctgaaggctgtggccgtgggtgtggctctatggccacctctctctcttctcctctcccaggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaa

SEQ ID NO: 88508 - DNA, 1062 bp, Homo sapiens
tagcagggactacaggcatgtgccaccacacccggttaattttttttttttttgtatttagtagagacagggtttcaccatgttggtcaggctcgtctcgataccctgacctcaggtgatctgcccgccttggcctccccaggtgctgggattacaggcataagccactgcgccgggcctgaagtggcttttataaggagcatgtctggctttttttttttttttcttttgcttaaaacccatgagtctctattgcaatatttctcaaactcccgggctcagaaggcagttagtgtgtattggagatccctgaagggaaagggagggaagagtccgtgtttcctgagtggacagcgctggccccaggcaggaagccctcgtttcaggggtgacgtgtgagtgaaggccgggtcatggtgcatgcactttgatgatcggggagcgttttctctggcctcactccgtgtttgggtgacgtggcctgttttctgttctcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggtagttcaggaaagcaacactttaaaatgagactcagtgtggttaaaggacattggctgcgacgaaggggtgggaattgggttggatgtggtatgcttgggggtagcagacaacctctcccctcctgcaggctggctagtccacgtctgactgggagtgcaggtgtttcgcgccctgcccatcactgcccggccacggttggcgttttagtaagctgtgcggtccagcggaggagatggtttgccttggaaagatagggatgagaaagtcaaaaccagaaagattttttgactggagaatgtggtagagtcagagaatgttggggaaaatgtaa

SEQ ID NO: 88509 - DNA, 1050 bp, Homo sapiens
cactttcagtttgtacatacgaccagttacacacaatttacacccacaggctctgtgcgagcctctctcagcagccccgcatcgccgctgcgggacagccacgctgggaggcgtcgctcgggagcccggccgtccctcttcaggtactggcgcgggggaaacgcttccagccaggagccgcccggcctagcgcgcagagccagagccgcacccgcacctcacctgcgccgccgcggtcccgcgaggtccgggggcgcagccaggcccggccgccccgccctcgcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcaggtagcggtgaggaggggaagggcgcgcgctgcggcggcggacagggccatggagtgggcgggactggggctgatggggcggggcctggcccgacccgggtgggggggtgggggggggcaggtgggcgtggtctgccgcggggggcggggtctaccgcagcccatgctgggagcagggcaggtgcgggcgggagccgcggtagccgacggcagaggcccacctatcccagaggggcaggagaaagagaagggggctttgctcccagcctgatgagctgctgctgctgctccgggaacctgccgtttggctgtcgctgtcccgtggaataacccacccagcagcctggaaagtccgcctgagccaggagcgtgcctccgccttcacttttaaaccacgaaacctgctttccccgtggaattctagaggatcgggtgccatggaggaatggcttagttttaggattttaaaatgttacgggtgatcattggtttgcaggtat

SEQ ID NO: 88510 - DNA, 1070 bp, Homo sapiens
ggccggccctcccacctcggagcccctcatgagtcctttcagcctggcccagtgctgccctctgacctccatgccctcgtttgctggttccactgcctccctgcacttgttttgcctgcagggtggagcaagcgcctgctgcacctgcccacctctccatttcccaacaggagtcgggttggctgccgatatccggctctgacagagcagcacctgtggcttcaggggtttgggttctgactgggagggtccccagccccccttcttgagtgtccaccctggtgagggtgggggtgaggccccagcggccacggggcccccgttcctggaggttcatggtggtcagtgcatgtcggtttccaggaagccatcttcgacaagagcacagggaaggttgttttgaagacgttcagcctctacaagaagctgctgactcttttcagagctggccacgaccagggtgagtcgtggggagcgtggggacatgggacacggccacagaggcggcgcacttgggcgtctgggtgactcacggggcctagaggggggcctggaagtgcctttggtccaagctcacctgcttggtgaccagggttgtgtcctgcccgctggaagcaggatcccacggatacgccccacctgctcacctgctcagcagggtcctagagcctcctgggttctttagaggtttggcccctggggagagtgggaggagcaggggtctgaggagcaggggtctggcagagcaggggtctgaggagcaggggtctggcccacccgggctcgggcagcctctgtttagctgcattctcccgtctgcctggcagccacttgtccgcaggtgcagtctggccccagcggcaggtcacaggacggggcagggagagccatggcagcccgtgggcgttctggagtggggccacctggcttcttgcgggccttggcgctgctccagctttcctgtgggttctactgggcctgcagtaggggctggatggtccgaggaactccccacccttgagcctgggcactggcccagctgtggtcagtaccagtttcctgtagatgct

SEQ ID NO: 88511 - DNA, 1044 bp, Homo sapiens
gggtggcctcagggagccgtgggatggtaagagggggcacagagctagaggagcagtcagagggctggatcacaggcaccaaagaggaaggggtctaggaggaaggggtctagcagtggggtgagcttccagaacacaggggtcatttacttcctaccacgtgacagtgctagggctgggttccacccttgtcatctgcatggttccctagtgtcattgtgggctgggccctgtgtcctgtgtcccttcaccaccttgagctgctcagtggcagagactgtcctgcttccagccccttgagcaccaggcctggaccctggtattatctccaatgtttactgtgaattctgtatatgggtgttaccctctctaaagaagcacattaaagagtatttgttgaataatcatgctgaaacgtcatctttcatagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaaggtaaggcattcggggcatttgctgatgctggggagctgacctggaggaagtggaggtgaggcctggcttcctgcacagaagcctctgctgggacatcggatgcacatctcagccttttcctggtgttgctaacatcctgctttgaccttccaaacctctccatcaagagcaaaatccccgcacaatttcctgctcccttaataatgctcaggcagtggtggggggctggcatcacccctcaggctcctgtggcttaagcggggcctctgcctggtgaggtcaggtaacacgggtgttggtgatcatgcgggcagcacagagccggagctcctgctgttctgcctcggctgcacgttttcggacacgagagttatgttctaatagaccgatcagcttggggcaaggcagagacactccaaggaagtaaaaattcccaaagctccttccttcagctcatccctgcagacctc

SEQ ID NO: 88512 - DNA, 1027 bp, Homo sapiens
tttatgaagttatcgtttactctgcttgaaacacaaacttgctgtctaggaaatgctaattattcctcaggggctcacttctagatcattgcaagtacagcctttgtccacacaaactggaatttttttgttttttgttttttgagacggaggctcactttgtcgctcaggctggagtgtagtggcgcgatcttggctcactgcaatctccgccctttgagttcaagtggttctcctgccccagcctcccgagtagctgggattacaggcgcctgccaccgcgcccggctaattttttgtatttttagtagagacggggtttcaccatcttggccaggctggtattgaactcctgacctcgtgatccacccgcctcggcctcccaaagtgctgggattacaggcgtgagccaccgcgcccggcctacaaattggaatttttaacgctttcggttgttggagatgctggtaagagctgttgcttttcttcttgacttgcgtgttgtgtgtgtgtgcatgcgctgttctgtttcttagcatggaaaggtgcaccagcatattccttaaactttggtagtagcattttaaagaatgttattttcaggccgggcgcggtggctcacgcctgtaatcccagcactttgggaggccgaggcgggtggatcacgaggtcaggaggtcgagaccattctggctaacacggtgaaacccgtctctactaaaaatacaaaaaaaaaaaaaaaattagccgggcgcggtggcgggcgcctgtagtcccagctactcaggaggctgaggcaggagaatgtgaaccctggaggtggagcttgcagccagcgagatcgcaccactgcactccagcctgggggacagaggaagactccgcctcaaaaaaaaaaaagaaattttcaaatgaaaatgctatttatgtgtgtttatactgtagacggtatgaaatcaatggtagggtcctaatggctaccctttaatctgacttttttttttttttttttttttttacaaaatac

SEQ ID NO: 88513 - DNA, 1140 bp, Homo sapiens
gttgcccaggtgggagtgcagtgacgcagtctcagctcactgcagcctccgcctcctgggttctgggttcaagcaattcttctgtctcagcctcccaagtagctgggactacaggtacgtgccaccatgcctggctaactttttttgcatttttagtagagacggggtttcaccatgttggtcaggctggtcagaactcctgacctcaggtcatctgcccacctcggcctcccaaagtgctgggattacaggcgtgagctactgcgcccggtcgaggacaaggttcttatttgtccaagggcctggtctggaggctatgattagtaaagtgttttttaggaagatcaattggacaggacagtttgggtttgttgttgctatttttgttgccatggtaacaaactaagtataatttatgaataaaaataggcaactctttaacagttgtttatactttgaaaatgtcaaatgaatttgacacattctgatcagtaagatcccagaatatctaatagtcaaatataaatagaacaagttgaatttactattgcctacaactatttaacgtgctaaattaaaactctgtttatttagaagagtgacccctgtcctatgccaaatgaactctatcagttctacccagtggtaattccacactttctttcttacgtggcctgaatcccacactttctttcttacgtggcatgaatcccacactttctttcttacgtggcatgaatcccacacttactttcttatgtggcctgaatcccacactttcttatgtggcatgaatccctcactttatgtggcatgaatccctcactttctttcttatgtggcagattgtgtttggtaatgtcagatttgaagacttgtttattaaatcagagacagtatcttccaaggtgaagactggagagagatgagccgacagtcagtggcttctggagctttccaggtggagactccaataaatgaattgagggaactcacagtgattctgtcctactcagaatgcagatgggcagaactgagcttcccggagaatcccagtaccagaaagaagaagtaagaaggagggggtcctgggaaggagatggccaagggacatggcttggcaatcaggaagtcttgggc

SEQ ID NO: 88514 - DNA, 1039 bp, Homo sapiens
actgatgtgttttttttttttttttttgagacagagtctcgctctgtcacccaggctggagtgcagtggcgccatctcagctcactgcaacgtcctcctcccgggttcaaacaattctcctgcctcagtctcccgagtagctgggattacaggcgccaccaccacgctctgctaatttttgtatttttagtagagacggggtttcaccatgtgggccaggctggtctcaaactcctgactgcaggtgattcccctgtcttggcctcccaaagtgttgggatcacaggccaaagtgtgagtcactgtgcccggtctactgttgtgttttcaaagtggcttttttggtcttgtatttttcagaatacgatagcattttgagtatatagagaatgttttaaaaattctgtgtttttgccatttctgagctgttggaggatgttaggataatgaacatcattttgatagccatttgagctgggtggaagaagatgtggtttaaatataaaatgtctgttctgggtcctccttgaggacctgttcccactttgccaagcttccccctggacttgtccacacgtgattaaacacagctgaaatcctgtacacttgagtgaactgcatgtaagtgttctgtgggctgggctgattcatctttacattgtacacttcctggggttgtagcctttgacccctgggtgacctcctccaggaattctgggtactcgataggactcaaatgtttattgctgaattggttggatgtgggcttctgagtttggattgggtgactactgtaccataggaaaccatgtaaaacagttataaatgtaagtcagattaaattcacttctgattctacagttgctcccacttttttttgtttttgttgatggtagactccccaaagtgacttttttggccttgtacagtcatgcatcacttaactgtggaaatcattctgagaaatgcattgttaggtgatttcattgttgtgcgaacatcatagagcatacttgtacaagcctagatgacacagcct

SEQ ID NO: 88515 - DNA, 1091 bp, Homo sapiens
atagccagatgttgtggcaagggcctctagtcctagctacttgggaggccgaggtgggaggatcacttgaccctcggaggttgaggctgctgtggactgtgattgcactattgcactcaagtctgggcagcagagcaaaacctcgactcgaaaaaaaaagaaaagatggctgatatgtagaggggtaacctgtggaagcctggctgcacatggacaaaatttcttgtgattgaataaaaatgttctaataatgtgtgtcagggcacatgacttgtcgtactgcttgatagttgttgcggctctaatataggaacaagtcagaccatgaagttggtggcttgttgttcccgagtctttgcaccgggtgctgctcttctgcttctcctgcagagcatgtgcacagacctggctctaggtcgtcatgcctcaggctagaggaggggccaggctccttcttgctgagaactttagcagagctctggaggagaccctcctgggactgcgctactggagcacatccttatcgcacatgagatggtctctagctctgatccttctcaccacacacttcagcccatccaggtttgactttagtgactgggtgcctcagcactcactcctgttcctgtctcctcttacagatggtaacgaactcgttgaaacatgtccccagaagtaatatttattttccatggatcttttatcttgttctctcttaaaagttgtttttcaggctatgccttttcttgttgacacaaatctacctgttaattattgagtgctgaaaaacacacattttttgggggcaggttcttgctctgtcgcccagctggagtgcagtggcaccatcttggctcactgcaacctccacctcccaggtttaagcgattctcctgcctcagccttaggagtagctgggattacagatgcctgccaccacacctggctgatttttgtattttttgtacagatggggtttccacatgttggttaggctggtctcgaactcctgacctcagcttatccacctgcctcagcctcctaaagtgctgggattacaggtgtaagccaccgtgcccggccttggcctt

SEQ ID NO: 88516 - DNA, 1100 bp, Homo sapiens
catgttttcgaattgtattactttcatagtaagaaaaatgaggtatcaggctgggcgcagtggctcacacccgtaatcccagcacgttgggaggccgaggcaggcggatcacctgaggtcaggagtttgagaccggcctggccaacatggtgaaaccccgtctctactaaaaccacaaaaattagccgggcgcggtggcaggcgcctgtgatcccagctactcgggaggctgaggcaggagaaccgcttgaactcagagggcggagactgcagtgagccaagatcgcgtcactgtactccagcctgggcgacacagcgagactctgtctcaaaaaaaagacaaatgaggtatcagaggaacacttaaaagcactgagaatctttaaatctagtaaatttaatacaaaatatggtaacttcaatattcgttttgtgtttgttttttaaatacaggatgattcaaagccgccttactcctacgcgcagctgatagttcaggcgattacgatggctcccgacaaacagctcaccctgaacgggatttatacacacatcactaaaaattatccctactacaggactgcggacaagggctggcaggtaaatgccttcagtttgttgttaaatagaggctgatggataccgagaagaaagtggagcggctgctgtctggaacacaggcacaggataggaaggtagaagggggggttggagcctcccgtgctgagaggaagaggagttgggggccggtgctgccatgctctgcctcaccttctttgtgtggagcagaaggaagcgtggttctggaggagcgtctaggcctgcatgctttactgttgtggaaattcatgtgtctgcataggatttgtgaagtgtggattgtttgagatatttccctttgaccaatgcagttcatatttgaaatgtaggagaaatttaaaacccagcctatccttccctttggcattctcctgtcttcctcatctaatcctgctaatggacagaagttttgaagtttgcagagacagttttcaaaccgcattttaccaaggaacacttagaagacatcttaaccagttggccggggtaaaaaacagatg

SEQ ID NO: 88517 - DNA, 1089 bp, Homo sapiens
atttattgaaggggaaaaaccttttttgttttaaccacagatgtataaacatgttatgttaaaaaatagcctaccggccgggcacagtaactcatgcctataattctagcactttgagagccgaggcaggtggatcgcgtgactctaggatttcgagagcagcctgggcaacatggcgagaccctgtctctacaaaaaataaaaaaaaattagctgagtgtggtggcttacgcttgtagtcccagctactccagaggctgaggtgggaggatcacctgagcccaggaagcagaggttacagatatctgtgatcacaccactgcactccagcctgggtgacagagcaagaccctgtctcaaaaaggaaaaaaaaagcctaccagccacgtcttccatatttcctttgtggaggggcttgggggtctttaatcatggaaggtacagaatgagacccagcctcccctctggcccaccttgtgcccaccccccatacctggagtgtctataccctgtcctgcctgccttcctgtctacagcaagggggtatctcttaattgaccattaggaaaatgctggatttggagagtagttccatattcagttacatgtcagggtctcttaacatattgcatgctaaattctggccgtatttactctataaaactgaggctgtgcttcaaactatatacatacacacacacactctctctctctctctctctctctctcacacacacacacacacacacacacacacacacacacaaccagataataacttctacccatgttccagtgaccatggctttatggctttgtcaaggagagaaactccacatggggtccagcttgctctgtgggagtgtgtgagggtccctcagagtttacagcttattctgatggtttgagataccagttacctggggctttgtcagtgtgtttctaagaagctttattagactctaatgtgtttctcttaagtggtatttctgtgtgttttttctaacatccatttatttgagaactacctatgaacaggacaaggctttcttgctaaagagggtggctggataaaggcctggcctcagt

SEQ ID NO: 88518 - DNA, 1060 bp, Homo sapiens
acatggcccagccctcctctccatgtcacccgtgaagtagctccatccacagggcccagatccctcccacacatagcccacccctcctctccatgtcacccgtgaagtagctccatccacagggcccagatccctcccacacatggcctagccctcctctccatgtcacccatgaagtagctccatccacagggcccagatccctcccacacatggcctagccctcctctccatgtcacccgtgaagtagctccatccacagggcccagaggcattaggatggcacttggacaacccctgagatgggttgtaaagtgttattttatattttgtatgttggatttcttagtcacctttgacgatttgaaattcaggctgaggcttgcaattctaataaggttaattggggaatttagaaatgatttttggatagctccagattttgttttgagtgatcaccattttaacactttaatagcttaattttaaatctacacattaatgtaaattcacgaaatgtttctatgaacccatgacgttcgtccggctttggcctgagtcaggtcccagcgggggctttcttcagggtgtctgtcaactcttagctgggcttttttctgagatggagtcttgcttctattgcccaggctggagtgcagtggtgcgatctgggctcactgcaacctcctcctctcggcttcaagcaattcttcagcttcagcatccttagtagctgggactacaggtgtgggccactgtgcccggatgatttttgtgtgggtttttttttttttttgagatggagtcttactctgtcgcccaggctggagtgcagtggcgcaatctcggctcactgcaagctctgcctcccgggttcacaccattctcccgcctcagcctcccgagcaactgggactacaggtgcccgccactacgccccgctaatttttcgtatttttagtagagacagggtttcaccgtgtttgccaggatggtctcgatctcctgacctcgtgatccgcccgcctcggcctcccaaagtgctgggattacaggcgtg

SEQ ID NO: 88519 - DNA, 1092 bp, Homo sapiens
ctgccggctccaccgtcagtgcacgggagctgcttagagagggcagctggctccgccccacagccgtgccgcgtatgtgggtgagggcccgtgacggccctgtcccacacaggctgagtctgtctacccgagtgtcccgctcagttcacaggcgtaggcgtgcagagacgtagaacttacacaacagtacttggttgtcaggagacaaatgacaccccctttgcaaagtgcacttattaaaacagcaagtgctttctgagtgcgtcagctgtaaccatgcaatgtcttcttctcggtgacacaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccaggtgagacagcgggagaggaagcgagggccccaacagcgtgagccagacgcggacgcctgggctccacagagaagaaacagccggactggaggcctgcctgtccctctgtaccttatactagtacctgattttataggccttggaaaactaatagcactgggagtgttttttaaaaatcaatgaaggttctttaaacgacactgagtagatgcctgaaataacttagaattaacctgtttcttagtttgtcattcaaaaatccatgaaacagcccccgcacccccaccccccgcaaaaaaatcaaaacaaaacaaaaacccatgaagtagacaaactagacactggaagcaaaaacatgtcctttttttttttttttttttttttttgagacagagtctcactttgtcaccaggctggaatcttggctcgttgcaacctctgcctcccaggttcaaagaattctcctgcctcagcttcccgagtagctgggactacaggcacacaccaccacacccagctgctaatttttgtatttttagtagagacagggtttcaccatgttggccaggatggtctcaatctcttgacctcgtgacctcatgatccacctgc

SEQ ID NO: 88520 - DNA, 1023 bp, Homo sapiens
cagtctccaccttccaggctcaagcaatccgccctcctcagtctcctaaatagctggggctgtaggcgcacagtaacatgcccggttaatatttgtcgtagagacagggtctccctatgcccaggctgatctcaaactcctcccacctcagcctcccaaagtgctgggattacaggcgtgagccactgcgcccggcccagtttcctcttttattgagtattgacattttcttttttataaagaactgtgggaagaggggttaccagatatctaaatagagccaaaattgcatttttagcagttagagataggaattaaataccccttttaaaatactacacctccctcattattagtaactttactattgtgaggtgaaatagggccatatcctatattttaaattaaagtttgtatgttgcttgtcagtgctgagtgtgagaacctttgtttgtagaagtcagtatctgtaagtgtcagtcctgctgtgtctttcaccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaaggtaggcggaggggaaaggaggagaggggagaccacagggaggtgaaaggtgggccggggggggaaaggaggagaggggagaccacagggaggtcaaaggtgggccgggggggaaaggaggagaggggagaccacagggaggtcaaaggtaggcggaggggaaaggaggagaggggagaccacagggaggtgaaaggtgggcgggggggaaaggaggagaggggag

SEQ ID NO: 88521 - DNA, 1013 bp, Homo sapiens
gcggtgacgcccattgaaaggtatgaaatgactgcacactagctggattatcactcagccgtttaagaaataaaagcaaaaccatcacgtgactgagaccgtgtgtgtgaccgcagcaaagcgcagcgtgtggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctcttgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgttttttttttttttttttgccgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgct

SEQ ID NO: 88522 - DNA, 1046 bp, Homo sapiens
ttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaatgggaagtagaattgtgtgttatgaagccaaacactcttccccttgctgtgagaatctggttggagtgtaggcttcagaacagcctgtgggcctgaagaggcgccggcctgtgacaggacaaggtggaagccagggtcactgggtgcggagcctggagcttcactccctgtgtcgggacaggacagcctgccctcctcattccctgtgtcgggacaggacagcctgccctcctcactccctgtgtcgggacggggcggcctgccctcctcactccctgtggcgggacggggcggcctgccctcctcactccctgtggcgggacggggcggcctgccctcctcactccctgtggcgggacggggcggcctgccctcctctctccctgtgtcggggatgggacggcctgccctcctctctccctgtgtcgggacggggcggcctgccctcctc

SEQ ID NO: 88523 - DNA, 1244 bp, Homo sapiens
ccagcaccgcgctgtggcaccgatggccgcccagttccccttatttctcctgtgggctcagtgtgtcccgcttacggtctgcacggccatttgggatgtcttcagcccccatccctccagtttcccccaggaaatcacagggacaggtcttccaatgtttgtatagatgaccaagaatgtttcttaaccctgtagccaacaccgggtgattagatgctcacaccaagacagtcaggattcccggccacggtgccgaccgaacgcattcagtggggaccctggggcctttcagggctttcagagcagctgcctggctccaagaggccctttgcagttcagctcagtgggactcgttgcttttaacttgagggaaagaaacacacaggtaaaatggtctccttctatcccagcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtg

SEQ ID NO: 88524 - DNA, 1430 bp, Homo sapiens
ggagtttgagatcagcctggccagcatagtgaaaccccatctctactaaaaatacaaaaattagctgggcatggtggcacatgcttgtaatcccaactacctggggaggctgaggcaggagagtggcttgaacccaggaggtggaggttgcagtaagccgagatcgcgcgactgcactctagcctgggtgacagagcaagactccttctcaaaaaaaaaaaaaaaaaaaaaaaatgagtcctgtattcccagctacttgggaagctgaggcaggaggatcatgtgagcccaggagttcaaggctgcagtgagctgtgattgtacctgtgaatagctactgcattccagcctgggcaacacagtgagatcttgtctcttacaaaaaatagaaaattgctgcgttacctgtcttgactttctcttttcttttttattgtaaaatatacatattaacttgtaacattggtctttttaaaactatcatttcagaatttctagaaggaggagttggccatgttgaaatgttatttcgctgcaactatttagctttagttggtggtggaaaaaagccgaaataccctcccaacaaaggtactgtaattgtgtattgaagaatcatgcctcacgtgtcccacccagtctttttttgaatgcgtttatgtttgtggccatgtgtgattttccctagtagttctgtgaaatatccaggactggtcactggggaggaagcaggcgaagagggcaccaggtctctattcccagatggagcacctaaagagcatcactcgcttgcattgtcatagaacacgtgcgtttcagtcagtaaacggaaaacgggcctgctgcaccttaggttgacgtcgtaaatgtcatgaattcattttaaagcaaggtagaaggattttttttcttacagagagccattgacttaaaggaacattagtttcatagccacgtggaacaaaacaccacttgggctctgggtttcgggatatgtttgtcggagtgggagtacgtgtgtgtatgcagatgatgtggcgtaagagctctggcccttttaagtagagggaggagtagatagctttcctgacagccgtgtgcctcgtgccagcttaacctcgctgttggttgaggaaagagggctcaaggcgaaagatccaggaatggagggcagaacacagggaagaggtgggaggcgggaggtaggctgggtgggggaggtgggaggcagatctgggggaggcttgaatgccaggtaacgtgtggccaggaaggagatgccgtcagatctgtgttttgggaaagttctggtctagatgcagtgcatgaggtgagtgaagagacaccagaggatggggcaggtgtgggaagcccccgtttatggggagaggcaggaaaagtggagcaagcatcctcgtctgagcccagtg

SEQ ID NO: 88525 - DNA, 1033 bp, Homo sapiens
acagcttctcagaagcctgtgttaccagccagagccaagcctgaactggtgtggtgtgggggcccttctcccagggcctcgggtggagttgcttttcttggcctagatttggcagtgcctgaagggagcctcaaaccagcatctcctgcttggcagcgggtgagcttgctcccgagtagctcgacagcctgtgatttactgggcttggagaacatgccccaggggggggaagctggctcgcacgttgcagagaagccagcttgggtgggtagccatcgaaaggtggggcgggttaggatgattgctgagaaactccttttgtttgcagcttgtgctgtgctggtttctagaacaacaaaaacagacctgcagtcattcctcatttaccatgcagggctgttttcctctaatccctggtgtcatcacctctgtctagtgtatgcttttcagcaggtggttttaatttggttcccattatgcttccatgaaagtgggctgtgccccccattttatggcctagcttatgagcactcaagaccattgatgactagagtgcgctctctctggccgcgtcctcctgctgacaggtaccccatcccaccgccacgctgagcactggccactgcacactgcacactttctctggtgaagatggccttacttttcagtgaaataaatggaaacaaagccctgtcttcattgactcgttccttccctgtcgtctcttttgccctcctgcacccatgcctgggaaagtggataacttttggggcttttctctgtgtgtgctgaatgcccaggaggctgcctgtgtaattcagctggaaactgtccccagggtagagagaagtgtgaggagaaaaagacccttcgccctgtaaatgtgtggggttctggtttctcccttactgcagatggtggcgggccctggccttggtgctgtctcctgtgtgtagctggggacggtggaagctgggctgggcctttccaggtgtggggcatccaggccagttacaagagatgatgcttgctt

SEQ ID NO: 88526 - DNA, 1014 bp, Homo sapiens
ctgtcggcgggaggagcgtccttggtgacgtgaacacagacctccctcttgggctgtcgtgcttgtcacccacgctcattgtgcccactgtcagagccttctgagaagttactcagatgctctttcagctgacctggttttataggcaagcattatgagttaaacggcacctctgcccgaggtcacggcacccacataaaactggtgaacgttcactttctgtcatttcccagcctcaaggcagagcttcctgcagggcactgcagctccagcccccatccccctgctctgtccccgccccactgccccttcctccatctccttgtcttccatcacctcacctaactctcagctctgtcttcagcttctcttcttttctcctgtcccctgtcagttggttgcagtcttgtccatttcacttccagcccatctctgaagccgccatgcacttccaccccagcccttgtctgtcccgggaatgctgtcctcctggcctcagcttgccctcgtcgcagcacccgggcgtctcctgctcgcaggctctccctgtcgtgctgtgcccagtgctaccttgagcctccccttggctcagcctcctgtcctgctattgtcatcactgcatgacaccgagtgattccccctgaaaaacagagcaagccacaggaaccccgtggcctgtgtgttctccccagccgcagtgtgctccatggcttctggggttgctgcagtgtgccctgtggcctgtgtgttctccccggccacagcatgcccgtggcctgcgtggtctctgtggccgcaggatgcccgtggcctgtggggtctccgtggctgcagtgtgcctgtggtcggttgggcctttgtgtgtgctgccccccttcagattggctccctgccctctgagtacttgctctcctgacctccactgatgttgcttcacagcaaggaagtcgagtaggttcaactccagcagctcttggttcatgatttgggatgatgggggtcttggtgatgtct

SEQ ID NO: 88527 - DNA, 1066 bp, Homo sapiens
cgaatccttgtaatgtctgattttcttactccccaaaaccggttttcattcttgagggacattgtcgccccttaaggacacatgcagtggcacctgcttcagttgtagaaccaggtacccctggcagcatcctgggtcacctggagtgacgtggtgctccctggagatgaggctcacgccagcgtgaaaccagggtgggaactggggtggagggccaggggagctctgcagtggccagcagtggggtggggacagagggcacagcatggcagatgcaggggcactgccccagaccagctcttgtgccgtggccacacgcagccctgtctgtgtttggtggggagagtccctgggtgtggctggcagtgccctctgagggcaggaaggaaaggatgtctgtacaggatagagtgggggcccatcctgagagggcctcaccacagagacttgattctgtccaaaataaagacacctgagatgtggtggcctcacgtcttcccagtgtggagctgtggtggcgtctgaagtgaccgctttgcacttggcattttgatgtatggggagagcttttagagcctgcagttcttttttttaatgtctctgcttatttttttccagacttctttaatgtttagacctctttattgcgatctaatttacatgccataaaatgcactcatttaagtgtacggttaagtggtttttatatatttacagagttgcgcaactattgccataatttaatttccgaacattttcattgcctccaaaggaaccctgtgtttaagaactcactctttactctccccagcacccccgccctggcagccatgtctccagtgtctctgtgaatttgtcttttatagacatttcctaacagtggaacctacgacatgtgatctttggcgtccgaattcttcggctgagtttctctgtgtcgtagcctgtggagtgcctccttccttcctgtggcagagccttgtcctgctgtgtaaatgcaccacacgccacgttttgtccatccttttcatcagctgatgtacatctgggttgtttccacctttca

SEQ ID NO: 88528 - DNA, 1176 bp, Homo sapiens
cctcagcctcccaaagtgctgggattgtaggctgtacctggtgtgttttcaatttctttgatggtgatatttgacccaggttttaaattttaattaagtccagctcatcagtctttttctttcttgtgtttctggtgtcatagctaagaaatcattgctgaccccagaaccatgaagttgtggtttcatttaacgttttgttccatccgaagtaagtgactcgtaatgtttatttgtgacactagatgtgtgtgagggtgtgtgtgtgaatgtgtagctgggatggaatgaagtccctgcctgtggggagccagctccaggttcactcaaaggagacaagagactctactggcttgtgtgtgtgctctgtcatgtcttatggcaacatgcactgaccccaggcagctggggcgagaggatatgggtgttggcatcataaacgaaaagggtaaagctatggttcagaaactgacacgtgatgtggaatacactggcccatgaccttcgcatggttggttggccccttctgcctggcggtgccctccatgtgagctgaaccctctttgcagcccccattctgttcctggtgggacatggagaagctgtgctgtctctgcacagggcaagggttctttcaggcaggggtgaaagagatcccatcttggggctgactcaggaggtgacagggctgacatttgatgagcatttgcagcatgctttttatgtttttgttttagacctcacaccattcctctgagagccgtcttgtttatataaagctatagttgggagccacgtgtggtggcggtgcctttaatcctagcctcttgggaggccaaggcaggaggatcacttgagcctaggaatttgataccagcctggacatcatagtgagacaccctctctgaacaaacaaacacacacacacaaacactgcagctgtgggagccaggaagtctttctggtgtcacagctcatgctcagcccttcggcctcctccatgtcacacggctgagctgtccctgcacctccttgtctccttggagagttactgtggttctctgtcagtttggtttgaaaagtgaaaacaggctgggcacggcggctcatgcctataatcccagcactttgggaggccaaggcggggggatcacctgaggccaggagttcgagacc

SEQ ID NO: 88529 - DNA, 1047 bp, Homo sapiens
acacacccgcaggtatgtacacatgcacacctacacagtcgagtgtgcatgccccccacggatatgcacacgtgcatacccacacaatcccatatacccacccccacaatcacgtgtacacacccccgcagatatgcacacacgcacacccacaggatcgaatgcgcacacacccacagatagcacacacgcacacccacacaattgaatgcgcaccccccacagatatgcacacgtgcacacccacacaatagaatgtgcacacacccgcagagatgcacaagcgcatacccacacccgcagacgtgcacatgcacacatccacacgatcaaatgtgcacgtgcatctgcagacatgcacaagcagacacctacacgcactcgcagacatgcacacccacatgggcgaatgtgcacaccccccccacacagatagcacacgtgtacacccacacaattgaatgtgcatacacgcacccgttcacaggttaatcgctgccacagctatcagctctttttcattgactgttacggcaaaatattctaaaggataacatagatttatgtttatttgcattttatgtttccttatggttcatatgagtttattggaaaattagcaacatacacatcattttggggaatggaaagtgaggcagagtaagccagaacattcactgtaacattataagcaagtagaataaattgataataccttcaccagtaatgcactttccctagtggaaataaattatttgtataaatagcctcttgatgtttgtgtgttatttagttatacaaatcacatttttcttttttacatatggcactttaatgttagtactgaaaatgttttttctgacattttttcagtaattgtcatttacatcaaatatgcagctagagctaatagaaaaacagttaaaacaatttgttgtaatggtgagatatttataaggaaacatttataaaagatcttctgtaagacagcttagacttgaaaatacatatcagtcttagagtcattcaggtgtttttacaaccaaa

SEQ ID NO: 88530 - DNA, 1087 bp, Homo sapiens
aaacctgtagtgatcgtatgtggctggagatggagccaggtgcttagggatcggccccgggtgaggcaggaagtgtctcgggtcttgggttccgtagactgacagcaggggtgcgtcacactcaggcgagctcccagccagcaggtaaggcgagtagatggtggccagcccgtgctctgtgtaaaagtgaggcgggtactctgggattgtggggtgcatgtaaggggaaatggccccaagcccctttgtagatgagattttatgtggaaactctggtggaaggaaaggtgagccggctttccaggggtagccaggagtgtggaaggccgacttggtgtggaaagacacggccttggcagtggggttgtgtaaagccagtgtctcgggcgcctcggcgttgtctggccccttgagtctgtgctcgccgactggaacaaatgcagaaggccgagctgcgccttccagagcaggctgggcaccgagggcggcttccggagctgggctcttgcagggtgatgccctgtggagggctggcttctgtcccaggcacctgtgggttccccgggcttgcagctccaggttttccttgatgtcttccctggcagagctgtgctgaagcttcgagtcgaaggcagagagtccatttgcgacagacttggaagaggctggcttcgccgtggcatcgggctggttggtttgcttggggtctagtgagttagatttagggcacttgggaactcgatcctgctctgatactaaagtaatcgagtttttacaaagaccatacttcatgtgattaaaaagatgtgacttctcattgcaagtaaagggacattggaaacatttatacttgaagggctttcctggaggcctggggatgtaatgtggcttttttggcttccgctctttgaggagactcattttcctccttatgccttggactctggctgtccaggtggcgtgatcactgtcgacgccgcgtgcacttcgtggtttctaaagaggcacctcccgctttgctttctttcccgatcacttctatcagaagccagctctgcgtgctgagggtctggcgagagcctccgtc

SEQ ID NO: 88531 - DNA, 1038 bp, Homo sapiens
agtgtggtgtgtggtgcgttgagtgtctgttctgagaatgcctgtaagcctttgagttttgggaactttcatcctgtgacctggacctttcctcgaaagcgccctgccgggggctgaggacaccgagccccctcccagggtctggacagagtcctgtcccagggctgcccgactctgcttgggggttacacgcttgaagcagtgggtgtgtgatcggccacactctcacgtgaaatacgaaggggtttgtggctgtttccccttaacatgtacccacagtcacagagtgcccctcacttttacacagagcgtgggctggccaccgtctacttgctcctacctgctggctgggagctctcccaagtgctgtgcgcccctgccgtcggcctgtagaacccaagaccatggatgctgctgcctcccctggggccgatccctaagcactcgtggcagtttctgcccactttagccacgtcgttggtgtattctagtgtgcttgtttaaaaatgaagaacattcgaacacaagactctaccctactgcttctaaagtcagctttatcattaagtagcatttatgttgtctcagatatgaatacaaatgctatatttatgttgacttaaatggttgaaatactgttggtgaatttgtacatcctgtgagtgacagcagcattgtgagacatgctttcacggtcacccggttcctgctggccaggaggcatggccagcagcgcctgcccgtccagatgcaccaccaaatggaagaaccaaagctttgccacactcctgcccgagaggagaccagagtgagtagtatccgctttagagatggttgggtcatgggaggaagctgtcctggcccttaacctttagggagtgggttcagccctctggccacacccactcaggtcctgggacccaccagaggctgtgtgtgtgatgtcagagctggcctgctcttttggattcttccagagggtctctgtgtcccccttaccagcctcaggtttccttcagaggctgtgccgcacgccca

SEQ ID NO: 88532 - DNA, 1052 bp, Homo sapiens
gggctgcaggcttgaagaaggatgtgagtttctggagtagcctggactgcacagccagggcctccccggcatgtggcggggccagcgttggcctgggtcccacttggctttgatctcgtggggctttggtttttggaggtcctgggtgcgtctccaccatggctcccgggttcccttgcgcacaccgagccagcagctgctggggcctcagggctcgcagctcacaggcttctgacgcctcagcctggagctggcgttgtgcccctcgcccctttacctgtgccatcccggccgcagacccaagggtgcccttggagccgtgcccgccggcctgggtgtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaactttcacaagttcttcggtgggtcctgtaacagtgggtgcttgggatcagagcatcagagtggaattttcgcagggaaatggaaatgcctgatcgagctgggcggtggcagcagccgctcctcactcttcaggtgcctggctcttctgagagtcagttcgggggtttagtggctcactttttctaattggttcctagctttttgctaaagaaacttggattaactgttcttttgcctcatggtgtgaatttatactgttcctgttttataaataccagaaggagcttcgtaggtaacttttaccatgtgttgaaggtagcattggttttgaaaacctgatttcctcagtgtcgcacacgggtagcttaagaggtgggataattgttggagtagtgaatggatttccctgagaagccaagtgcaattta

SEQ ID NO: 88533 - DNA, 1024 bp, Homo sapiens
agcgtcagtggggaggccacgttcatggctgctgcccggggccacctccccgtctgcactctgcagccatgcttgtctcggtcagagggggaggccagacaccacattaaaagtgaaaaatgtaagcaaacaaaatggctttgccaaaatcataatgaaagttaatggcaaaaataggataagaatccgagctgaatcttaaagaatataaagctatctggacaacagacaagtaaaccacgtaatccctcgtgaacaatttttatattctcctgtaacaccaagatccatagttcatactttacctctgggtcacagaagcctttgagaatctctcaaagcccagaaagatgaacacactgtctccccagagaaatccgacagacgcacacacaaaattctgctttactttcaggagacatcagaccccagctgcagatgcacggctggaaaccagaggcttctgtgctcgttctgtgtgcccccaactccaccaggagagcacggggcccaatgcccccacccagagttggctgcacgctccatcgtgggaccgcagccgcgcgccccggagggaaaccacactccagctgcagccgaaacctccaccgactgcactagcttcataagccttcctcagagaccaaggacatgctggctacgtgcacagaaagtctgcactcatttcctaggagtctcttcccctcccagggcaaccctccaaggtggctgttcacaagcatgacgccagcagagagcctgttcccagagtgatcacaccgcaggtcccccactgagcccaggactgatggagcacagtggccaccaggactgcagaccctgcctggggagggtgggaggccctaagggggcaggtcctgtgatgcctcctgagggtacacccagaggctgcacacaaacctgctggtgaatctgcttcaggccctgcactgcctgctcgtccagatggtccgtgacgggcctgcagaagttcaaacacagagctgaagtcacactccccaag

SEQ ID NO: 88534 - DNA, 1038 bp, Homo sapiens
cagtttctggccacctcctcagtcagcagggcgggtggccctgtttgggctccaccccacacactgggcctggagggctccttcaggtgctccttggggtactggaggacccctgccttgggcctcagtcctgtactcttcacctcctggtgttggagccagcatttcatatgttgcattctgtccagttttctacttgcaggaggggacatccaaccctgccactctgtgtgggccagaaaccagggtctcaggagtgaatattttgccctccccagggcagcgcgcctgcccttgtgcaccagggtcccgctgtcagcgccagggctggggcaggtgtcccagatgggcagagcagcccggagctccgcctagcttcgctcatggtagaaccgcagtgcactgcttctctaggctggatagggggctctttctggcatctgagattagtttctataaagtaagagctgagcgctgcttggaattagttctgtgatgggataccagtcaggactagaatgtccagtaaaaattaaaaatcagcatcaccccagctaggatgggagacctctggaagatggctgtaccacgttttttcctttcttttcataaaaggttgctcatgctcagtaacacattcaactagttctcattttaatgctttttggagcctgaggttacattggcaagcatatttcatggtgttttatacgtcaagaggttcttctaattctgatgttttcattccttttcaggggtctgggaggacagctcatgagacaagcaggtaagtctgaaggcctttgcagccctctgcagccctttgccgcagccatcgttgagggaggtgtgctcgtggcgtgcagggcggcccattagcccccagggtgaagggctgggtgtgtttcttctgtggaggcggcatctgtgatgtgcttggtttgtccagtggttcctacgagggagagattgagagattgagattgagagagagaaagaggaagttgtgagctgggaggggttgcacccaggagccac

SEQ ID NO: 88535 - DNA, 1024 bp, Homo sapiens
tctgcgatgtggaagatgaggctcaccgatgtttgtttgttagctcacacattttaaatttcaggatttgccagactgttggtgtgaaagcaggagccccagacgaagctgtgtgcggagagaatgtttcccagatttactgtgcgctgctgggctgcatggacgactacaccacggacagcagaggggacgtgggcacctggtacgtacgtagcagtgggtgagcgcttcttctgagaagcccatctattccgtggaaactcggaggccccgggcttttctgcagggagaaatctttgtagatttgtgccgtgttttgcgttttaaaggctctggggaagatgacctgttctctgctcccgggtgagcctgcgtggcagggctttgcaggtgcttgtccagcccgtcctcaggtgttgggcctgtgtcgtcctcgttgacagggtgtgagggaggacgcgtcttcaatgaaaggctgccggctgcttacattgggttttgccaacatttcttgctgtagtgggattgataacccctgaaacgcctgtgtgtgtaggatgcctcggggccccggtgtgtgtggctgtgggtggctccctgcacacgtccctgtagcgcacagggaacctctgcaggccccgtgactccctggcagcgtgcctgggctctgtgtggggttagtcacgggtgtcgaattcacacaggctgccggcgtggtgggcagaaccagggttggaacccccctctcaagctgggtgtctctgcctctccttgtcccatcagggtccgcaaggccgccatgaccagtctgatggatctgacacttctgctggctcggagccagcctgagctgatcgaggcccatacgtgagtgtcacgtcgcagctcttctgcatcctagagggcagccccgagcttggggaggctggcggggcgggcggtcctggtgctcagtggcatttgcactgctgggcacacaccctcctcccagagagcctctctggtccctgaccccaggtttgtg

SEQ ID NO: 88536 - DNA, 1049 bp, Homo sapiens
gtcttcctctttgccctgagacctttactgctcaaaatggaatttggggcagaaccaagacccagcccaccctcccttcccctctttcccgcctgtggagaagctcggttgctcacgtctgttgtggtcgccgccccacgtccctgttgagcctctagaccggtttctttgcaacaaaagccttttccaccggttcctggttggccggctgagcgcaggtgtagtgtgcatccggggcaggcacgcgtttctggggccccagtgatgcctctgcttctcccgccctgcagggcgtcccggaggacctgctgttcttctacgagcacctcaggaagggcggcggcgtcatccgcgtggaccagagtctcctgctgtatcgccaccacccacaggcggccacgcactgcgtcctcgagtgagtcagccccgcccggccccgggacgcctgagaggccaggaacacgggaggcgcccgaggtcggggccggggttggtggggccgaccccagaggctgtggtcaggctctgccttgagacccagggtctggtgggacacggggcaacagcacatcccgagggtggcggggattcggcgtccacgaaggggcatttcccaagggcgccagggagcgccagggtgaaggccgaacgtccttccctagttcccagaggtaaaatgaccacgcgccgggtccttctgaaaccctgtgctccctttaacccgacgggagtctcatgagtggggtccggcggggaccacaggcctggggggcgcagctgccgtggagggtggcagaggcacggccagggaatcgcagcacccagtgaggacgcgcccagtgctgcggggtccgcctccctctcccgtgtcactgtgaggagcggccacgtgggcccgggtctgggggtgccgcgtggctgcgttggagccgtggcaggggtgaggcaaatcggggtgaaactgcatgtagaattccttccttagatccgggcagacagttccctccttagaactgtgaggacacagaggtctcggccacctgcctgcc

SEQ ID NO: 88537 - DNA, 1860 bp, Homo sapiens
ggctcactgcaagctccacctcccaggttctcgccattctcctgcctcagcctcccaagtagctgggactacaggagcccgccaccacgcccggctaatttttttgtagttttagtagagatggggtttcaccgtgttagccaggatggtctcgatctcctgacctcctgatccgcctgccttggcctcccacagtgctgggattacaggtgtgaaacactgcgcccggcctaatattcttttaagttaaagaatattagagagagttttgcatcttttatagttggatgaaaacaaatttaaagtattttggtgactgttgtgacactccttgtctaaaaacattcatctattttgaaaacattttgcttttcataaagtactttttatagattagctctaacttgaggcatatcccatttgtatgaattctgccaataataaaaacaatccgttgtaaagttctgaaggaccgaggtgaagggctgaaatgagccgtcctgctgcctgtctgaagtgtgggtaaggagacctcgtggggaccctattctacactttaataaaatatggttggtttggttatagctgaaagggacgtattttcctgtaatgatattttttcttgaatagggagagttatattgactattagataacatagatccaaagtgtctcttttcagaagtgctgggtatttgaaatgggctgattcacttattacgattcatgcactaacggagccccactttcctaataacgtcgccgcttgctaaaaccaaaatgaagtacaatccccactcttctctccaggaggaaggaatgttaatatctcgccgccgtgtgagtttttcctgctgagaccatggcaaccagatcccctcacaaagggactggcctccccaagcaggagccccacgcaaacatttgactttcttcaaggcaataatattaaagcaaattccttgtctctgccaaacacaggattcattgtgagaaacttccagcttccttagtgagataagtcttccttcgttacccaggctcacggatacccttctctcctgaaacctgacgctaacaagccgcattgtgagcagagcccctgttgaacagtgtgcctcgtggaaggccccttccggcccttcgtcctcacaggtgcctccgcctgtgtttctcgtgaggagcttcagggcactcacctggccctgcagcgatgatggaggcttggctgcagcggccctggagacacggcccaccatccatcccagggcagaacaggcgctcgcctccccgggtgcatttcctccctgcgcctgtttatgcccctggctttttgacatctgggatcctctggctaactgggttgagctggctaaactttagggattaatgctagaaattaaactgctacctggtatgaagaggggcactgctccgggttggagaacgcagagagggtgggagactctgtgcgtctcgcttctgtgcggctgtgcggtcccagtggtgccgtgagcttgctcgatgcccccccggaacagggcagcccccgtggggtgggagccctgccttcccctccttgtagtggagacgggagagtgccacgggtgtggccgaaatgcacacttggccactgtccctccaacagacaactttctgcagcttgtcttgatttggataccagagagatctattgcttaattctgcacacgtctgttttgctttgtatgactttcctgggtgccatgatgtctgtaactgtccggtgttgccagcctcttttctagggaaagtgggtatcctgccccttggagcctcctcagcaccctcattttgggctaaatgccacctctgatccac

SEQ ID NO: 88538 - DNA, 1017 bp, Homo sapiens
tacaatggcgcgagctcggctcaccgcaacctctgcctcccgggttcaagcgtttctcctgcctcagcctcccgagtagctgggattacaggcatgcaccaccacaccagggtaattttgtatttttagtagggacggggtttctccatgttggtcaggctggtcttgaactcccgacatcagatgatctgcccgcctcggcctcccaaactgctgtgattacaggcgtgagctaccgcgcccggccagaactcgttttattcttattaacctaagtccaggaagagacagagtgaggtttcatttgtaaagaacttgactaaattgtgttttcaacacaatttcaacttttcttttttggatataaattaagggtgaggacagactaatctcttaagtatcgctccgtatcacttaatattataatgtatgaaattaagacttaactcctgtaatcagttgttttgttggcattgaatttcctggttttactccatcccactttataaatttttgttttgggcttcatgagaaaaggacaatgagaaaaggacactagctacactagcccgaaacgaagtgtaggacaaaggaatcgagagatggacgtcaggcctcccatttgctcagctgggttctttgaacacctcctgcccgatactttgttaaaacattgttttttgtgggctgaggggttacttaaaggggttactttgttgcaggttttctaacatggtttgccgaaatgcttattccacctagaacatgaccagccagcacctgtaatcccagctactcgggaggctgaggcaggagaatggcgtgaacccgggaggcagagcttgcagtgagccgagatcgagccactgcactccagcctgggtgacagagcgagactccatctcagaaaaaaaaaaaaaaaaccaaccagttattttcatgagtgagttggaagatacccagatacttgtttcaaccaaaatgatgtttctgatcagtgattggaaaactcatgat

SEQ ID NO: 88539 - DNA, 1050 bp, Homo sapiens
gccccgccccggtcctgccgcccagtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccggtgagccctgtcctggcctcgcgcgcagcacaccggaccggcgctaggcctccgcgtaggcctggcctgcacgggcgggcacccggcatggactgggaggggccggggtggggtgcgcggggccggcggcgcggagatgacccaggcaccgtcccctctcccggctgggtcggagccctgcgtggcaggggagcgccgtccccctgagccaccgatgggtggggggagtggagatggggaagcctctcaaagtcgtgactctgcagaatagtttctgacgctgccctggtgtgcggtgaaagtgagggtgtgtcctggggcgctgggccaggctggaggtgcagggagattcctttgggcttctcagtggtcgccgtggaagggagcggggaagaaggggagggatggagcgacccttcttggggttgccaagcggcgttcgccgcccttcgtcgtccttcgcccttctcttgccccttgcctttgttcgaccgcccctttggtaccagttttagttttgtcccgaggcagattgtaaacctttttgcttcgttttcgtttcatcaaacgttgcattggatttctgtatccgaaacgtggtgtgagctttcagaagtagatgaatacacatatccccggggtgtcatttcttgattggcgtttgacaggggcttgtattgtttgcttgctgacagtccagggtactggccagggatcacttttacttagggaatggaccttgctgctccctagccttattcaaaatggcacctaaaatatgtgtggtgtctcca

SEQ ID NO: 88540 - DNA, 1288 bp, Homo sapiens
atcattttgggaaatatttcaatatgatcatattgttggagtaggattcagaagacttgggagtttattaaccaattttatgacattagcaaatcaatctacttctctgaagtctcagtttctttttttttttttgagatggagtctcgcactgtcgcccaggctggagtgcagtggcgtgatcttggctcactgcaaccttcgcctcccgggttcaagcgattctcctgtctcagcctcctgagtagctgggattacaggcgtgcgccaccacacctggctaatttttgtatttttattagagacaggctggtctcgaactcctgacctcatgatccgcccgcctcgacctcccaaagtactgggattacaggcgtgagccaccacgcccagcctgctgaagtctcagtttctttaactatgaaatgagaagttaggtttgatccagtgaaattttattcagcacctactgcatgcatgctcctcttgattaggtaagtgttatgggcatagaaagatgaatgacatgttttgactcccgataactgcctaattggtgatcttctaagggtctgtaaatcttgtcttgttattttttaattaaaaaaattgtgattttgtttgcagttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggtaaaatgtagtccaaattttcatcacattactattattgtatactttttgaaaaataacgccagaaaattatttaattttaatgtagcatttgaagtgctttttttatatgatgagagtatgtcagctatggtgttaaaactgtcttatgcctgttagagtaagggagaaatattgtagctgtttgacaacactatatggtattataaaaacatcgttttaaaactctttttacttttgtttatttttaacttttaggttctgagatacatatgcaggtttgttatataggtaaacttgtgtcacagggtttcaatgtacggatttcatcacccaggtactaagcatagtacccgataggtagtttttttttttttttagatcctcttcctcctcccactctccaccctcaagtaagttccagtgtcttttgttcctgtctatgtgtctatgtgttctcattatttagctcccacttacaaaagagaacatgcagtttgcttttctgttcctgc

SEQ ID NO: 88541 - DNA, 1026 bp, Homo sapiens
gcaaattatttgaaaccctggctttagtaccacttgtgtttaaaaaaaatttttgtttttttttgagatggagccttgttctgttgcccaggctggagtgcagtggtgagatctcggctcactgtaacctctgcctcctgggttcaagcaattatcttgtctcagcctcccgagtagctggaattacaggtgtgcaccaccatgctcagctactttttgtatttttagtagagatggagtttctttatattggtccggctggtttcgaactcctgaccgcaggtgatttgcctgcctcagcctcccaaagtgctgggattacaggcgtgagccactgtgcctggccaaaaaaaatttttttaattgccataattttaaataaaatctgcatataggataaattttattctgttttgaagtacattaaaataaattgattattagattgtgttcagcttgtacagtggtggttaaatgtcttttgtttgtctttgaaacaggatgatgattggggaaacatcaaaataaaaaatgtaagtattatcttatgaacgtttattataatgcagtaacctcattatgataccaaaatacattccagatgactttttttcatgtgtatatccagttgttccagcactatctgttgaaaatacttaccttttcccattgacttgtgttgggctctttcttgaaaagtagttataggtttgtttttgggtttttgtttcattgatctagtagattaaagttacactagtaccaaatggttttgattactaaagctttataataaaagccttgaaaaaaaaattagctgggtgtggtggtgcacgcctgtaatcctagctactcgggaggctgaggtgggaggctgaggcgggaggcagaggcaggaggcaggagaatcacttgaacctgggaggcggagattgcagtgagccgagatcgtgccactgcactccagcctggcaacagagcgagactccgtctccaaaaaaagagtcttgaaataagatagtatat

SEQ ID NO: 88542 - DNA, 1054 bp, Homo sapiens
acgtaacacctcattcctattttatggctgaatagtatttcatggttcattcatgttacagcacacgtaacacctcattcctattttatggctgaatagtatttcatggttcattcatgttacagcacacgtaacacctcattcctattttatggctgaatagtatttcattttatggatatatcacattttatttatccattcattttgttgatggaaatttgaattgtttctcctttttggctgttatgagtaatgctgcagtgaacattcatgttttttgtgtagatgaacgttttcatatagtaactctatgtttaatgttttgaggaactgccacaatgattttccaaagtgacggtaccattttacattctcaccagcaatgtgagaaaattgccaatattgtctgtctttgattaagccatctagcgctatgaagtgtggtatctcattgtggttgtcatgcacattttttttagtggctaatgatgttgggcatcttttcatgtgcttattggccatttgtatatcttctttggagaaatgtctgtttaaatcttttgcctgtgttttaattgggttatttgtctgtttaaaaattcaattgtgtttttacatatatacaagttccttacccaatggataatttgcaaatcttttcttctatactataagctgtcattttactttcttttttaaaatttatttttttcctaagtctgttgtatgcagtctccttttacttttcttgatggtacgtttgtaatgcaaatgttttttaattttgatgtagtttaatcttaattttaattttttcttttatcacatatgcttttggtttcatatgtaaaagccattgtctaattctaggttacaaagacttacttctttgttgtttttcaagagttaatatacttttagctcttctattcaggcctgtggttaatttttatgtatggtgggagggagggaggtatttgcctattattttgcatgtgtatatccagttcttccagtatcatttgttgaaggctattgtttccccactgaa

SEQ ID NO: 88543 - DNA, 1810 bp, Homo sapiens
cctctcagtatttctgtcagtttccttttattttctaagtttttctttataaacttcagtgttaatgttatttggcttaatggatggttttacatgaattaggaattacattttattgctctaatatgggaatttttttttggatattaaattacatatgaccttccttagttacaaaaaaaaggttgataattcattagtatatctttgccataaatgtagaaatagttacatattcatgttaccctataacaagaagtaaaattcagtaacagcagcgattatatagctaattacatacccaagtgatgttcagggtatgtctgctatattagtacttaattttaatttcaaaaatgccttttaagaagttgctaaaatgtcttaacagggaaatgtaatgattttcaggtttttaaaaatgaacacacataattcaggcattattgtgaattattgtgtattgaaaaattaagaaaattcgttgagtcacatcagtttccgaaagatgcaaacaaatgaaaaagggaaaaacaaaatccttcaattgagtacaatttaacacaatactctctgtgatttctttcatactacttaacataagcatagaggttttgctttttaaattgagatataattcacatctagtgaaatgcatatatcttaagtgtttggtttgatcagttttgacaaatgcaaattctctgtaatccatttgcctatcaaagtatagaacatttctatcatctcagaaaatttcttgggcatgccttttctcagttaatccttatcctctccacccccttccagcaactactgatttcatattagtttgcacattctgaaacgtaaaataaacggaatcctacaggtcatgcttttcttttgttctggcttgtttcactcagtatctagcttggagatccattcatattattactgactagatcagtaattctgattgctccacaatcttgccgatattgggtgatactagttttttttaaattttgattttagtcactctaatgggtgtgtagtatgtacacatagtttaatcatagtgtatatgcagtctccctctcacttcagtgtttgatattaactgaatgataatttctgagcttttgtaataagacattgtgtgagtaatgactatggtttgaatagtcatttgaaaaggaatttgcatggccagtttgttgtactgttgtaaattaagtgaggatcataaagctgaaagtgaatttagaaatcatttaatagaagcttctcagtttacagatgagcaaactgacctacaaccttaagtgacctatttaatgatacacagcaagctaatgctgaatgtaggtgtatgatttttgattgaatgtttttgatctaatgcttatttcttccaagttatttcagagattgtgttattttattttctttgtaattaatgaatagtgttgtttcacaatactttcagaaaatgtttgttttagctgggtacagtggctcatgcctgtaatcccagcactttgggaggccgatgtgggtggatcacctgaggtcaggagtttgagaccagcctgcccaacatggtgaaaccctgtctctactagaaatacaaaaattagctgggcatgatggtggacgcctgtaatcccagctgcttgggaggctgaggcaggagaaattgcttgaacccaggaggtagaggttgcagtgagtcaagatcatgccattgcactccaacctgggcgacaagagcaaaactctgtctcagaaaataaaaaataaaataaaatgttcgttttatatg

SEQ ID NO: 88544 - DNA, 1642 bp, Homo sapiens
tgcctcagcctcccgaatagctggggttacaggctgaagtgagcggatcatgaggtcaggagttggagaccagagcctggccagcatggtgaaaccccatctctactaaaaaaaaaaatacaaaaaattagccgggaatggtggcgtgtgcctgtaatcccagctactctggaggctgaggcaggagaattgcttgaacccagaaggcggaggttgcggtgagccgagatcgcgccactgcactccagcctgggcaacggaccaagactccatctcaaaaaaaaaaaaaattaagtaagtttttgtttgtattaattaaaattaatttacagtcgcgtgtattaaatatgtgactgttttactaaggcaatgtttgctttgtctttaagcccttagagatttgtttgattccatggataaaacttcttccagtattccacctattattctactgcagtttttgcacatggctttcccacagtttgccgagaaaggtgaacaaggacagtatcttcaacaggtaattagggcaaggtatttttcattctgtaaatgtaaaacttaggtttcctacatttaccgtacttactggaacatagttcgaaatataaacatcagtcttctctagttcatgccacggctgtctcttgcctggagccgcacagtagtcttaactgatatctggcttctgcctttgcccctttgcagtttctctacacagcccgcaatgtcctttttaaaatgacgataggattatgttggccccttgttcagtactccctagtgattttctaccgcagtcctaaatcctctagcccctggctttctctctgagttcatcactaccactctgtcccttgcttgcctctctccagctgcacaggcttccttaaacctttcaagtgccctcttcctgcagggcctttgctcttgttctttggctgtcagataagtgcaagaccagctccctcacctccttcaggtctcatggctccaaggccaaagccttaggctttccctgatgaccttattggaacagcacacttcccttcccctgatcacttactgtttccatcctgctttttttcgcttcataacccttatctctacttgaattttatatattcactgctattatgctgagtatctagtacagtgtttagcacaaattggagctcagcagatgtctgttgaatgaataagctattctagaatgctttattttttggaagatcgtatgtcttatttggcttaatatttttaaagaaggaaaccactttcttgcctaggagacagtgattattttggaagaactttgtagatcattcactgccaggattacttactttgtctttttttacattacaggatgctaatgaatgttggatacaaatgatgcgagtattgcaacagaaattggaagcaatagaggatgattctgttaaagaggtaattgaaatatatttgtgattatagactttcgttataccttgatttttttttttattttttttcccctcaaaggcttaaaataagttccatcttataggtagatgtgtatttaaatactttagatgctcaatctgtagtcagaatttggaagcttgcatacgacatttaaatttaatgtattatttattaa

SEQ ID NO: 88545 - DNA, 1592 bp, Homo sapiens
ttcattcaccttataaagaattaatttcttatatgtcaaggtgactgttaataataacttttaaaataaaaaaagaattttttaattttataaaagggtgtgtatcaactatacatgagattgaaccagttaataaaacatgaatcaggaaagtactgtcttctaggtcatggttagaaaaacttagaaacaatttatgtacctttgggcttctaagaccattataagaccatactaaataccagcttatagtttagagtttattgcagtttatcttttaatacacatttattactcattgttgtttctagaattgttggtagccaaatgaacattcttaagtatgttgaaatgaatcttgggagactaaaaggttttaaatgccaatgaatgatactattaattttaatggaattaggataatgtattatattcaagagtatataacaaattgaatacccgttggcatattccttatcttagtttacaaagcatgaaatgtacagaatctgaagaagaagaagtcaccaaaggaaaggaaaatcaacttcagcttagctgttttatcaatcaggaagtcaagtatctttttacaggacttaaattggtaaggacaatctcagtccatccttgttgtttgtgaattccatgtttgcgagtaagccaaagtcattattcactgggctttaatggtcatttgtagacatgtgcagagcaatacgcattttgagttgcccgatacacacagtcccatctgaggtcaaacaagtacttggccttcttgtttcagcttggtaaacaaataccattttagcaggaatgttagaactgttgttttaaaaaaaaatttctgctttttgttggttatttcactgtttaagatgaccccccaagcacagggctgagtgctgtctagtgtttctaggtgtgggaaggctgtgatgtgccttactgagaaaatatacttgttagagaagcttcagttgggcctgcgttgcactgttggctctgagttcaatgttaattaatcaacacaatatgtgaaataaggtgtccttaaacagaaacacacataaaacaaggttatgtattgattggttgatgaaaatgttgtgatcaaaggctggcgggaatctaatcctgtatttcccctaggagcagtggttcagtattcattgattcagtgcttgtggtgactttgtagaacataattaccgtgactaacaaaatcaactgtatagtcagaaatcaaacaaacttcaactagctcttcatttcatagacaaaagcattattgacatggttgcatatgctaacaaatattgggacatctcactttttaatcactgggtgttcctgcttcacactgtgaagaagcacctagtgctttgtgctgtaccttgctttattttaaagcactcaagaaatgtttgttgaatagtttacatgtttgttaagatttttccttagagatagttgttttcatgggccctataacttagctgaactgttaactttaaggaaaattacttaatctaagctactgttttcttacgtgaaaatgagagtaactatagggttgtttgtgggtt

SEQ ID NO: 88546 - DNA, 1015 bp, Homo sapiens
taatttggcttcgtttctccactgctttgctgctgaataaacttggttaaatgttaaaaagctactccacagtgattccttttgtaatatgattagtaattttaaaaaatcagactttaaaattatacaagtgtaacatgcttaaacattaccagtaggttattttaattctaatttcttttttgtttgttttcttaaagcagagcacataagtagtgctaattctttctgtgacattagaaatagtagtgaatgtttgttaaatgtagagtatatgccaaatattttaccaggttttctacatgtactgactgtaattctaacaataacactataacattgattaccactaccaccttttccaaatgatgcccagagggataaataccgtttccactgttacacgggctgtaagaagcagaaaggtgatcatgctggttaagatatgtgcagcagctaaaggctttcccacatctgttaggttaacagaggtttctgtgttatgacttttttcaaatttaacaataattcattggtgctgattggcttttatgcataaaacgtaaagaacaggagtttcttgggctctcttaattttcctctagagtgaatattctgataataaacaggaatgacagctttgttatataaaatacaatataaaattctctgaatctaagcatcatttggggcatagctaaaaaagagcaaacagtatttacactcggaggaatccacaacaacgtaaattatttgatgccttgtaagaattgaacagtatctaaaagtcttcccatattgtcatcaaattgtgtctcagtggtataaacccattgatgtactgtatattgcctcttaggtagtgctagtttttaaaaggcttactggtgtgattctatattgcagaaataaaatttttaaaactaatgtttggtcttctgttatgttctttcttagcgacttcaggaagaaatcaccaaacagtctccaacgttgcaaagaaatgccttgtata

SEQ ID NO: 88547 - DNA, 1150 bp, Homo sapiens
ttccagtatacttagcgttgtatgagaaggttaaatgtagttgaagtatctagtgttgtatactttaaatatatactactataagctattgaactatatcactattacttctatgtaaagttgtatttcaaataaaaaaaaaaaaccataagtttattccagtttgggaggtccattattttcacagcagcttgtccaatatttctgagatgtttcttttctcaggtaaattttggtacttcctctgtggttagttttgtgggttagagtatttaatggaaaaacatgttttagaaatttctcaccttaaaaaagttagaaccagatcattcttgaaaataggcactcttaagaggtttcaactgcagatttccaagtgattttcacagattttattttcaactgtatctgaattatgaaagcattacttcagatatgtgatactttaaataaatatctttataaatgtgtttacacatgttttttgtttgtttgtatataggatgttaaatttcctcttatgttggatatgtatgaactgtgtacaccagaacttcaagagaaaatggtgtcttttcgatccaaattcaaggatctagaagataaaaaagtgaatcagcagccaaatacagtaggttcttactgctgactttatactcttaatatcttaatctcccatcagtgctcagcaattactctgtcttttttttcctgcttcatttttccttcagaactatactttgtatagtattatttggatcaatctgtattacaattagcaggtatacacatcctccatatatcagtgcagatctttaaagttttgcatgtgttttattttcctttttttttttttgtgacaaggtcttcctttgtcactcaggctcactgcagtctcaacctcccaggcgcaaatgatcctcccacctcaccctcccaagtagctgggaccacaggcgtgcgccaccatgcccagctatttttttgtatttttggtagagacagggttttgccatgttgctgaggctagtctcgaactcctgagctcaggcgatctgcccacctaggcctcccagagtgctggggattataggcatgaggcaccacacctggcctttaggtgtattttagcatgagaaacagaactcta

SEQ ID NO: 88548 - DNA, 2289 bp, Homo sapiens
cgtggtaagtggacatggctcaggaggtttaatacaaattgcaggaattcttgttttagaggtagttgttttttccccccacctctgtggtttgacagtattttggtaacactggggaattgggtttttccttttctgccctagagcactgtttaactgtactgctgtattcactggtacgctttcactttaatggtttaaaattggtcatcacattcagggtgtctgttactgtactgtaacaagattttatattgttgaagtgtaggactgctgggtttacagttttaactgtggttatatcattttagtaatttggaaggtagactgtattttgtctctgtgcactgtagacagtaaatatttatgaaattgaacacttacagagaattcaaattttatttccaaaatcatgatttaaaattaaacatttttttctcctcagagtgacaaaaagagtagtccccagaaagaagttaagtatgaacccttttcttttgctgatggtaagtaacattctcattttaattgagttattgtatgtgggtctttttaaggtaaaatttacatcttaccccatatttacttattctgatgtgcttttcaaacaaaatgtcaggtttcttgaacaatttaccttaatgacatatagtaaatttactcattggcatacagttctatgagtaagttacttattaaaacatcaatcatgaagccttaactatgattggacagtagtatcttattggattctgataatactttcgtaatgtgaactttagagttattcttgttacttagcttgagaaggcacatgtctattcattgtctaatattaatggatttacatctttctttagatattggctccaataattgtggatactatgacttacaagcagtactaacacaccagggaaggtctagttcttcaggtcattatgtatcatgggtgaaaaggaaacaaggtaaagggtattcttttttcaactgttcaatattattttaacagttcatttattataaattttatagcagtgtggttttcaaactttgggtctcagaaccactttacattcttgaagccccaaagagctttggtttatgaggtttgcctctcttaatacttactgtattagaaattaaaactgagaaattaagaaagttagttttaaaaatgatagtaataagcccattacatattaatgtaaaaacaaaatgagtgagaaatggtactgatttacatttttatgtctttctgttgtctggcttaaataggaggcagctgggttctcctgttagtgttcgcattcagtctgttgcattatcatacattatgtagcctctggaaaattccagagtacacttgagagaatgtgggtggaaaaggcaagcagtgctctagtggtgtcattgaagtagttgtaacctggtggaacccctgcagtgcccttaagcctgtgtggtcactgggtcgcacttggaggactgttggtgtggccagtggagcactgctgtgcctccgatgacttgatactttttttgcagtggaactctgagacgaatcctgcataacattaattcatcttcttgtccctgttatttagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatca

SEQ ID NO: 88549 - DNA, 1035 bp, Homo sapiens
tattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacagacattaagatttgggaattttttctttttttttttgagacagagtctctctgtcacccaggctggagtgcagtggtgtgatctcagctcactgcaacttctgccttccaggttcaagcaattctcccacctcagcctcccaagtagctgggatcacaggtgtgcaccaccacatccagctaatttttatatctttagtagagacagggtttcaccatgtggccaggctggtctcgaactcaacctccagtgaaccacctgcctcagcctcccaaagtgctgggattacaggcgtgagccaccgtgcccagccaagatttggggaattaagaaaggaaatacaaacacaactgagccaaggaaagaatctgactgataacatcactgcattcagcatccaaagaaatccattacttttacaactttgtatttctttttaaaatacaggcaggcaaagaagataacaaatatttttaaatggatgcttaacagcacagtgttaataaccatcttcagaaattgtacagtattaaacatgtcttcagccaagctccaacactcagaagacaaaagacttgaggtcaaaagctattaatccctttttttttattattattaaatgtcctcattttctaaaaataagcaaccagagcttgtcaacattttcttaagactgattattacaaagccattccaaagttaaatgtacaatccacagtacatcagagagagacacaataataaatgtataatcaaaggtactattattgatcacaatttattttaaagtcaggaaaagcctgcaataggctggacaaatacttgattgtgcccatgtttccatgggatggacagcagcactgagtcacacaatgagagcaaca

SEQ ID NO: 88550 - DNA, 3745 bp, Homo sapiens
tttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcaagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatctcaacattagagttgtgctagattactgcttgactgactagctaggttaggcctaagagtgtttaccgaataatctgcactcactcagtagcccttcttcaggattaaaaacgatgatgacctcatcttagagccctaaagggaaatgcttatgtgggaacaagaaaagtcggtggtactgtcttctgctactactacttagtgctttgctgtgtatagggtgtgttcacatatatctcagttgaatgtcacaagaatccctgaagtgattaaaagtcttgagaggtcaggcaatttttgtaaggctagaaggaaaagtgaggttttagacttcatttcttttaaagttggcaaacaaacattttctgtaatggacaagatagatagattagatagatagatagatagatagatgatgattgattgatgattgatagtaaattatttcaggctttgcaggctataaagtgctgcagctccttagctttgctgttgttatagtgtagctggagccatagacagttagttagttagttatgagtgagcacagctgggtgccagtacaattttaatgatcaagactcgtggcaggcagaacaaaccatcatttgttgatcctctgcttgaaagcacgaataagtgagaacagagcagtcatatggtttcagaaagtgttattctgggatttcaggataaattttgtaaaactactaacaaacaacacacaggaaactaatttggtataagaaacgacatatccctaaatagtgcttatttaacttcattataaatacatctacttaacaaaaaaatatattttgtgatcttgaggtcacttcgtttaggtcattatctcaacccaacctccccaaactctggtttgagccaatatgtgttctattgttctcagagcaccagccgactgtacaacaattgttataaaaatgtttattgtttaccaaaaccagtggacctcttatcaaatgctgcttggtaacaaaatctatcacagttttaataaaaagaaaaaaaaaagaagctaactatttgtctcattgtcattagttagactttctgcaaggtcacttaatccagacttattcagtgcattaatcagattctcaggtgttgcatgaactccctcttgatcttgccaggcaaccaggagctgcttagctctcatcttcatgtcttcactgtcacactcaatctgcctaatttctgagtctttcatttccaagtagggagccagaatcttccattgttcacccagcttgttggcaaatacctctatttgttctcctgttacaggtttgtctcgccgaacatcaggacctagaaaatgaagagaatataaattatgcgcaattctaagtatacaacagaaatggaaagctatggggccaataagttttattaaccacctttagtagactttattttaaaagtaaacaattattttttatattctccgtaagttgaataccactcttaataagcatggtcaataatcaaagctaaagctgttacctataattacgtaggctttccctgaaatgaggtgctccccctccaataaccaataattaacagaggtatgggtcgccttcaaatgtattttcattcccttttaaagcaccattacttcccaattttattgcataaaatgtagtgtttttaaagttattattaagcaatgttttaaattcctcactatgtcagaaacagttgagataaaatgggagaagttgagaagtcgatcaaattaaataatgtacctatcaacaaagaaccccaatcgtcttcaattttgttaaataaccaagaaaattcagttcttactttcattttccttcagtagagcatcattatcttcctcatcttcatcctcacctgtttttatttcttcagaaggaggctaaaaatgagaaagaagaatgtttgaaagaatgccagcctctgaagtaaggtaacaggtattttgtttggataaggacggttgtgagattccaagtacagggtgccagaacctcacccctgagagcgttaaatgacagtgtcaggtaaggatcctaagtgggactatcttcacctgcagaaggagtgaacttgggaagacctcagagttggaaagactccccacccccaatctgggaagcaggaagtcagtaaaaagcacagttccaggatttgcaaatacccagggtttatttagtaaagacggcctcaaggaagccagtagcaacagtgtccttaaaagtttctgattcttatcttttatctttgataaaagacaatataatgcattggcaaacaggaaaaaattcatgtctgtgtgtataggtgcataacagtttacctgaagtatcacgaactttaattttttgagacggagtcttgcttggttgccaggctggagtgcagtggcgagatctcggctcactgcaacctccgcct

SEQ ID NO: 88551 - DNA, 1082 bp, Homo sapiens
taataactttaaaaacactacattttatgcaataaaattgggaagtaatggtgctttaaaagggaatgaaaatacatttgaaggcgacccatacctctgttaattattggttattggagggggagcacctcatttcagggaaagcctacgtaattataggtaacagctttagctttgattattgaccatgcttattaagagtggtattcaacttacggagaatataaaaaataattgtttacttttaaaataaagtctactaaaggtggttaataaaacttattggccccatagctttccatttctgttgtatacttagaattgcgcataatttatattctcttcattttctaggtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaa

SEQ ID NO: 88552 - DNA, 1065 bp, Homo sapiens
aaggtaagataatatgggtagtaaacaatttgtaaacagtagccaagaaaaaaaaggacttgcttacgatttttcttatgtatgtgtccatttcatgttaaggctgtatccctaaaacacatgtattgcagctgatacattgaaggcttttcgatattaggatatttaaggaaaagatgttaaatatatctgtcagtgtgagtttttcctgcccaactccagggcttgccaggagttgtcgtctttattagcaggtggaggtctctgctccaaaattccgtcattcccttctcacctccctcagacctcctccaaagctgatttgcagactaagccagtaatacatatctcacaaggtgtggagctctgcaggacattcaagctaaaagatgcaaagaaaatttttaagcaaaaaggagttcatttatttggggtttcacaaaacctcattaggctctctactgtctatctaaatacttccatccatttcctcctatcctgtccataactgaaggtggagcccactgttacttaacggtatttgtgttaaggacactgagcaatgccgtattagttgtataatgacttcactacctgctgggtttgaatcccaggctcgtcatttgctggctgcagtgcagctctttcagacttgtaattttaaggtagtagcacatggtaaacactcaaaaaatgttatttcttatccttctatctattttggaggtttggtatagcatagtaggaagatgagggactttgaagtgagacgtgggtttgaattaaatctttatggccttgggcaaatcagtgagacacggtagtctctgtttaatatgtacatgtacttgttccgagaattcaatgaataatgtatgtaaagtgttcagatcctagccatcaatatttattggatgtctttaaatcacctagtgcattatgagagctcagttagtggcagctattaacaatttgggtttgcctgttgccttttctagggtttgggtgttttattcgttgtattttgaatgaatcttaatgtagcatgccatactgaatgtgcat

SEQ ID NO: 88553 - DNA, 1117 bp, Homo sapiens
atttccttcaattctttgcaatccagtttctctaccattccctccattttcttctttggaaatcctactagacagatgttggaaattcccaatctattcaccatggcttttaactgctcttccacttaaaaaaaaaaaatctgtctgtgctgcttgctggatgaagttctcatcaccttcttcagttcactagttctttgttcatctatgtccagtgtatagtttaattctgtgtgctgagttttggtttcaattattgtatttttcattcccaagactcccgattagttgtatcgactgtcctacttcatttcagcctgcttttgtttcatgatttcttgttccttttcaatggatgttatctcatcgattatctttttgagtatccaaaacatacataaagtcttggtcaggctatatatttcatctggaataaatatatatatatatcccaatagttgattttgctggtgatccttcttagcattagatttatggattttggaattttaatttatcagagttttgaacaggagccttttcttttgggatgtttgtttacttcctttcccctccctctctgtgtacatccttccctgtctagcagttttgcatctgcttctaccagggcccctgagtccaaaagtctagaagaagtcttatgatgacttcttggagcagctgtttcataagtatactgagcatatcacatatctggtcactgagcaagcagatggacacaaagctgtctttgttatccctaggctcacaacttcctataaaaccatagcccttggcagaagactggcaatattttttcttagtttcttcccaaaactggataaaagttccaccctagtccttggcttcaagaagtgaatctggctctggccccttgtcccacatggtgcacatttagtctctgttacttgtagccaaattcctggacaccaccacctgccttggatagagagtccagcaggcccaggctgcagttttgctcactacttggcatttctggtccatgaagatatttatcttgtttctggaagcccagccttgtctcttttgttttctcgtttatattttacccgtcattgctatgtgtttggagcaa

SEQ ID NO: 88554 - DNA, 1668 bp, Homo sapiens
cgggcatggtggcgggtgcctgtagtcccagctactcaggaggctgaggcaggagaatcgcttgaacccgggaggcggagcttgcagtgagctgagatcgcaccactgccctccagtctgggcaacagagtgagactcctttaaaaaaaaaaatttaaattaaaagaatatgtattgacactgtagatttgtgacatatcaagattagaagttgaattagtagtgccataataaagttactagataaagggcttatttttgtgatgctaacttgatatgtaccatatatgtttttctcatactggtgcttcttaggatataatatttttagttaggatatgatacctgtgacttttaacatagattcagattaacattggtttaaacaacataaaagttgatttttccccctcatatcgaagtctagaagcaggcagtccaaggctggtaagggagcactgctcggtgagattgcctagacccaggcttcttctaccttcttcttccatcatcttggtgtttgccctttttcctgtagtgcaaggtggctcacgctcacatctgcattctagccagcaggaagaggaaaaggccagtgataaaatatggcccaaaagttgcacatatgacttccgctctcaactgattggccagaatttaatcacatgaccatgcgagcagcaagattggttgggaaacataatctttaattctgaataaccatgtgtccttccaaaattcaggggctccaccagtgtagataaagagtctattggggtctatgagttccctaaaatgatttgtaaaagtttatataagcatttgtgaatgtgtacttttctgataactttcattagcttctgaaaacggtttgtgaccaaagctaagttaagaatatttagatatttgtaaaagaatttgaatgatttatttaatataacgtttattttattagctctattccaattgattacaacctgtatcgaaaattctggtcacttcaggattacttcaggaaccctgtgcaatgctatgagaagatttcatggaaaacttttctcaaggtaagttgccattgacagactatcagaagcccagtattttatagacagtgatagagctaaaacttaatcttgtctaacatacttttcactatgtaattctgcctcttacatttttataccaatttcataacaagtgaaattataaattaatatttaaaccactaatattgtgaagtagtatataagaatcggatatttaaaagttcgtcattacagccttgctttttttgaatataatgagtgttgttaacataaattgatattttgcagaatatattctatctttgtacaaaattattttagctatcttgttgaaacagaagtcctcaagtcatggctctgggccagatctaacctactgcttataaacaaaggtttattggaatagtaccatgaccatccacttacctgtggctgtttttgcactataatggcacagctgagtagttgcaactgagattataaaggccacaaagcctgaaatacttactctctggtcctttacagaaaaagtttgccaatcctgttttagaagaatttgttatatttttcttggctacttaaagatcagttgtccttttttgtcataattaaaatctaagat

SEQ ID NO: 88555 - DNA, 2701 bp, Homo sapiens
taattgatgtatatatttgaaaaataagtcttcttagttttaatttcatttccttgatcattattggtgttgaggaacttattatatgttggttggaatttatttttcttctgtgaattagctattcatgctgtttgctcattttattgttgaattgtcttgtgcatttccaaaacatttagccctttattcccagagggaatctattgattatgtttagaaatgtagatttgaaactttctactgtcttcatgactgtgttatatcattgtcatactgctcttgagttcttctgtccatcaggtaaaattctgattgccttacagattaactataggtctagatagttagtgactagacttctctaactgtgggttgcctaggaatgtgtaactgaccacttattctagcatttatctcttctgtctgatgactgcttcatgacaggctatacatttttttttcaatttagcacactgaagatagagaagaaggaatggatgtagaagaaggcgaaatgggagacgaggaagctccaacaacgtggtgagttttcagagcctaagctttttgatttacagagataatctcctaatttattgagtatcctctctggagtgaggagatagacaaggaggaaagaaattataagaaatttctttcatttgtaattttcatgtatattacttaataaatcgtaaatcactaatgggctttatctgctggtttctatattatgtgcagacagttcattgtttatatagactaccctatgcataatcccagcatttgaaaagccaaccacaggcagccttaggagctcctccccttaatcccttccattaaacttgtggacccagtgcctgtgtgtattgggctaacttttaatgaaataggcaagttaagaagcctttcctccttctctccccttgctcttaaaactgtttcttatctcctcctctgtagccctgtgctttctttccaaaagcaatcctcagtggcatagataggttctagaaactgcaacattaagtgaaatgatgtatgatgaaatcaattttcccataggctaacaaacaaaagttaggttcttatggcctatttctggtcacaaaaacaatcaccaaactcctagataaagatcaaaatgcttctgttattaaacattgaataaatgtgagctatacatgcatttgagaaagattaataaaaacaagtaagataattatttgcctagttattccaatttaaggttgtgggtggccagagcctgtcacagcagctcagagcgcagggcgggaaccaaccctgtacaggacgccatctgctcacagtgtgtatacccacccacccacactcacttatcctggaaccatttagacatgccagttattttcatgtacacctctttgggatgcaggagggaatctgactacctagagaaaacccacacagacatagggagaatgtgcaaactctacatagaccgtggccccagccaggaatcgattttttttttctcatcaacgttacaataaaacaatgttgaaggaaacatcgttatttgaagactttccataatttcttcctagtgctggcttagaagcaatgagcaagagaaaagagaaggcattaaggaaaattttccttcactggcactcttccaggtgtctgaggtgatgagagtcattagttataattgaaagaatttccattactgtctagaaaatcaagatgggattcctgtatctgcccagggagatgtatttctggcatcccagaattcaaattcaaacacatctccagaagaaacattagaggtagtgtggctccaagcttaactccaatacttcctagtcatgtgacctggggccaattacttaaccttctacaacacagtttccacatctttaaaatgtagtaatgccacctactctctacagttaagaggattaaataagacgatgatcagaaatagtctattaaggcactaattgtttatatgtagtggtaagtgtaaagcacttagaatattgtctattcagtgtctagtagctattatttgttatcgttattatttttttttagagacctatttattcattatacatgaataaagtaggctttaaggtctggcctgagcaacataagggctctggggcaagttagtaggctacaagatgatgagtcacctgaagtgtaaacagcccaaaagacactggccagtgcagttttgtctgcttagattttgcctaagactgtatagacaattcatccctattggttatgtttgtaaatcacttaaataagactcaacactcagctgcctctgtcacagtcactaatgttgaatagagggagaaaatacgtgaggaattactttgtgacagctgttatcaccagatggtcttaggcactgtaatttacaaagcagaactcattacccatctacctacaatatgaagtccatttcagatttggctcaaatacaccagtaaacatttttgttaagaaatttcaatgtataacatcctgtaaaatagctgaacatttaaaaaaatatatcaagttttccagagtttttttggttaaaatagttacaagacattctattttacatagtaactgggtctctgatttgttattatttgcaaatacaataattggttacatttgctttgtgtgggtaaacagaaaattc

SEQ ID NO: 88556 - DNA, 1123 bp, Homo sapiens
tattttcttttacttataaatgtatagcagtcctagtatataatacaggtaatcctgaaacaaagtcatggattcttttaagttcaaagcttattaatgtaaagttgaatcacactgaaacatgtagatatgaaccatcatatccgtatttcataatgtatgcctatttttgtgtttggattttctctcagtcacaactatttagctatatagacttcctttcatttctctttttttaacaaatttttattgtgaaatataacgctcatatagaaaagtacataaagcgaataataatgaaacaaatactgtataaccactatctagctcctgaaatgggacattgcttgtcctccagagccttccgcctccccagtatgttcaaatatgcgagattttaatatctccttgcttcagtcctcccttccttaatattgggctaatgtaccacctactttatatgttctgaggattaaatgaattaaaacatgtgaagagcttacattagtgcctgcatgtagaaagacctatagcatatgttagcagtggtttatgtgctttctttttgtcatcttatgtctgtgctgttttctttcatacttattttatgtggtcagggttaatatagatttaccacttcttgtatttctggctttctgtctgtgatcattttcccttttagacttttcttcagtgcaggtctgtgttttgcctaaaaatcgttacttctcctttattttttttcctttctttcttccaaactcctgttaatattggtattttgacctcctcccaataggtataagattctagattggcactagatacaggatttcatctcacgggaaataatctttactttgtcttctgtttcccatttttctattgacaagtcagatgtcagtctcacttcttgaagataatctacatttttttctctgcgcttaagattttttttctcctttggttttcttttagttttactatgatgtatctctgtgtaaatttctttttatttgtcctgcttaggattgtggacatcttgaatgtatggattagattcttccatctagtttgtaaaaatttagccattatctcttcaaatattgtgtatgcctcttta

SEQ ID NO: 88557 - DNA, 1379 bp, Homo sapiens
agtaaatgctctagatcttgtcaagaattattgtcatcattactgagtgcacatatcaaaaattacttaagtatgtcctatttggggacttttaggttgcttccacttcttgtccttttaaaaccttgttatgagtaacaaagtgtaccttttaagatattcttcagaattatttttcataggctattctactctacagttttttaaacttttaaattggcttgtgctccacttgaaggtatttgtaccgcatctacaccttttgtattgttgggagatgttttggattgtcttcctttggatcagtgtgacacaatattcacttttgtggaaaaaaatgttgctacttggaaatcagtaagtgccttagtttcttttcctgctaactttatctttctatagatccagaattctgagggtagatttttttttttaaatttatttgtagtattgctgaatgccaacaagtttctgcctatgaaaaaattatatactgctctctcgggagagccaaataaaaaccatgtgtggagaaaaacttgaaatacaaaatttgatttaatttgtgtaataaaaattaacttgaaaattcacactttcacatgtttaaaacagttacttagtatcatgttttcttatatctgaaaatatttttatttcattgaaaatgttatttgcttaaaaaaagtgaaagtggcatagtagattctcagtgcatgttagtgttctttaatatttcactctggcaacttattattgaagaatgtgtaacaagttctgaagaagagtgataatttccgtcttaatttcagaatacattctattctgctgggaaaaattacttactacgtatgtgcaatggtaagtaattgagtgataaaatgattgctttttaagtgtaaatatgcccagaaaaacacatggttgaattaaataccagtgataacattttaaagatagattaggtatctgcatttttaactaacaatctgatttgttagaactcattattcactttaaactgtttttgttctgggcataagcttaaagtcagaaacgtagtaaagtttgtctttttcatgtcatgttgaacttgttttgttcctaatttatagtacttttttgtggcagtggtttcggcccccaatttaagaactactgctttaggaaaatactcttgacacactggtttagaaacttttaggtgtggttgtaataaacatagaattatcttttctgtgtaacgttcattttcatatattgttagatctcctaagaagattgtctaaatcccagaatacagtcttctgtggacggattcagctctttttggccaggcttttccctctgtctgagaaatcaggtaagcttttatgcat

SEQ ID NO: 88558 - DNA, 2930 bp, Homo sapiens
atacatcctgtagtggcgcaaaaggtctagtccaagaatatttagcttaggagctgggattccattccctcattttcctctggcatcctcctcatcagtaaacttacataaataactgagggctctccaacttcggtagagaagtctaaccatgaaaaatctgaatttgtttaccaataatggggcacctgaatgaaaggaaaagtttcaacagtttattcttggtcaagcaaaggttgggtccccaaaagctagattcccttctattggccatagtacaatgtccctttctctcagacaagtctgattaaaaaatgattctttccttttcttcagacttagtcacttttccattgtgaggcattgggcaagttcttttccttttctgtgcttcagtttcttttgtgagaggggaaataccgttctttcagtgttgttgtgtgtaaaacagcacttaatgaacactcagtaaatgctggttattatgattttatagaacctaagcactgtcttccttctattaaaaccacccctcagacacatgggtgtattagtagttaattctcatagccctgcctttgccctgtgccactggctgagttatggcttcagcacttctgtccttgattagcttatagccttcatcttgctaatataaccattttcttgagaccattggattttgagtgagttgcctgttacttgacatacttctacgactattgattctatatgttactgttaaattttggtaacttcatattagaaaatattgttttctataagaaatattgtattccatatttctgatagtcaatttaatatcagagtacatgtttttactgttaatcgagtttagtctgaactcttgcccctaaattaaattgtttctcctctgttggtagataaatcattcatcatgtgaaaacgttttagctattatttctcttgctattgggggagtaactgaaggtaagtatggttccgttttgttttgtttaaagtaatcttggacatgacatgctttatttaaaacgtcttctccccatacttctccacctatctgattttgtttattcttcaagttctgcctgactcccaactttgccaagaagtcccagttgaattagttcactcttatttctcatctctattatgcagtgcacattttggcacttcctttgttctccagttgttttgttcattcagtaaattttcattgagcatctactatgtgcctggtactgagctaggacctggagattcaatggtgaataaaacatattcccctgcttatgtggagctaatggaagaaacagatgtatgcatgccttactatggtgtaagtactatggtcgaagtgggaatgaagtgtagttagagggaatagagccaacatggctctctaaacttcagtctaaaggagtcaggagaggttttagaaaagaacatgagaactagaatgtgaggtatgaagaatttgttagacatactaagaaaggaatagctagagaattgtgtacagcaggaggaggagaggacaatgagaatgatgaggaaagaagcaggttaggtccatttataaagggcactgggtgccatactaaagagcagctgcaggccgggcgcggtggctcacgcctgtaatcccagcactttgggaggctgagacgggcggatcatgaggtcaggagatcgagaccatcctggctaacacgatgaaaccccgtctctactaaaaataaaaaaattagccgggcgcggtgtcgggcgcctgtagtcccagctactcaggaggccgaggcaggagaatggtgtgaacccgggaggcggagcttgcagtgagctgagctcgagccactgcactccagcctgggcaacagagcaagactccatctcaaaaaaaaagagcagctgcagatgaatgattccatttgaagtgactgctggcaggaaaactgggcaggagcctgttaaaatggctgtgtgtgatagctttagaagacttcgggtaaacaatgcacatagtacacagagcctaacacaaaataggagctcgttaaatatatgcagaaagaagaaataaaaaattagtttatcagcattcttctttaaccaatttggttaaaatactcatttgattaattcaaataatatatgtgaaaactcctttttaatctgtaaagcattattcacattatgtgttattttgatgcttctataaaaactggcacacacctcccagtataggggcaaactattttatgaacttaagttcataaattcactttgttaaatgtttatacaagctgcctaatcattcattcattaggcatagttagctgagtcccacaatgtaatattccttgtctagtttcagtcaaacagtgttcagtgtgtcctgagttcattgattacctttatacattattcttgcacagctggtgatgtttttaatgaagaagttgtacaaagtctagtctatacttggaacttttgagaaggataaggacttaagagcttaaactgtaaaggcatagtgcatttttattttagggataatttttctttttgagacagactataattggttatgtgacatgtttttaaattatccataaatatattttgttaaattcaatttggccgatatttattgagcttctattcagtgtgagatgctactggttaaagcatacaaaaatgcctaaccttaaaaagctcatagtctacattcaaaggtgactagttaggatgtgctaaatgctacagtatatttatgtagagtgtgcttcaaaagcatagatgaagtagcctgcttcaggatatcagagttatttagatgagctgacattcactctatgcttagaaagatggagttgaaatttaccatgtggtaaagaggaggaagagtatgcagaaaacaacat

SEQ ID NO: 88559 - DNA, 1054 bp, Homo sapiens
aatttgacttctcttacaggtattcaggaaggaacacaatgtaccaaatgtaaaaataactgggcactgaagttttctatcatattattatacattttgtgtgccttgctaacaatcacagtagccattttgggatataaaggtaagcatgctttcttttttttcttccaaataacaagtgttccttcattaatttaagcatgagaaaactcatatttgcaaatacgaagtatttcattcatacaactcagatgcaaaataacaacatgataaacttcatctctgtatcttaaacttacagctatgagatctgaaaggggggacatagtaattccttttgactcatttcagcaataatcagcgtcctctctgagagttataaagttttttttcccttgttgcttttttctacctatttctagctactccttcttcctctatttttttttctttcgtcctatctcttggaggctttatggaaaccctggagtcagcacacaggaaaactatattgacagagaataagcaaaacacaagatctccagagatacaacatacttcacccagggatcggccaactaattcccttttttctctgcagcacattcactgtggtcactgttgtttatatagctctataaaaatactgccctgtagaaattaagcacagaggcagcactaccacctcaccctactttataggatgttgggcctaaacatatctggtttagggtaagggcaggatttttgcctgaatcctccagacttgcagacacagtaagttccccatgcacctttcagagaccataggtagaaggtgtcgtgattcagaatcacaaaactacataagcccttttctagaaaacagccagggaaaccttctttaaaagacacgtgaggcaaacacggccatttggtttcagaacagaggcagacgtggagtctgtggatcatcaggtcttccctctgctgtgtggcccacagactgacccaggaaaagaaagactccaagtgaattccctccaactggtcattcctcccacctctctcccag

SEQ ID NO: 88560 - DNA, 1113 bp, Homo sapiens
catggatgttcggtgacaaaaccagaattgtaacccaggtcttttgattttagtgcagttattttttacctttcaaggttcaggcgagttatccagaagagtagtgaattgtaggtaatgatagccatgcccagcaggtaccaagctacagtagcacaagttgaaaaattacaaacactgtaggtagggaaggctttctgcagttaacttagaaaaaagcatccatttgattggcaagaatgctccaaggatgctctttgttcacggagagacaggcacagtctggttcctggatcccatgaatggccccaggtatacactggctagtagagacaatccaaagatttgttctttccaccctttatttaccaaacatgcaaagtatgatgccacgtatgaattgtggatgaggatattctcagcagaatgcgagattattttcacaatcattgtaggaactttaaataatcttacctgttgatattcaatagccagatcttcccaaaagtccttactcattgtaaataataaggataaacttgaactctaggttttaaagattgcctttctgagtgctatacttaagtaaaaataactattgccacctcctgccaacattttcattaaacatctaaaaaataacttggtgtgtggtggagaattggtggatatagactgttttctctggttccccctgaaaataccaagatgggagataaattcagacattgatagctctgctgccacagtgcactaaattataaactagtgtcccaaaagacaggattctcctcccaatcaacaagagtacttataaccagagagccataggtgctcagtatagaaccaaaacaacaacaacaacaaaaacccccaatttatagtcagggaggagattccggacctcagtaccataggtggacctggtaccacaacacatgtgtattcgctgaagaactgagacactttgatgcaattatttgccaaaggtttcaaaaagcaatccacccccaaattgtggagggtaaaatgttctttcctgttctcttctctgtttgcgcacacacagtaccactcaccgcattccagttggcacctgcacacactcctaaa

SEQ ID NO: 88561 - DNA, 1042 bp, Homo sapiens
aaacgagaaacccactgttctagcactagaagaacaagggaggctgtgatagcatcattcccacttccagccccctctggggttagaaaatggatcaaataattggttgctgatcttaaatttcctcagcattcatgtgtgtttacacccacactgaccccagtaccaggttgcctcccaccctcctttctggactcctgtcctctgtcctatggaacgacaaaacagaattgggcacaattttctctatttctgactttactcaattgcttttctggtgttggcctcatcaatggacaagctgctggaagttgactgagtataaaatgctataagggaaacattgtaggaaaaaaagcatcccattattcctgtctccaaaagcaagattggagattggggtcttctctaagacagacgccaccacctgcacccgggacctccagcaaccacctccacaaagcctatgtaaacagtgtaatgtgttttgatattaaccttgtaacaaacatcttaagtttccttcatgttggtgctggaacaggagtgttcaattactcactaattttgtagacatttgttgaacatctattaggcatctggaactgaggatacaaagataaacgtacatggcattgcctgaaaggaatttatgatctagcaaagggcacagacgtgtatatagtctgctggaatatattatgataagtgctacactggtggtgtggatgaaaggccacacgggcacagataggagctatgagttccgccaggatttcacttatctaaaagacaggcaaagggtattccaggcagaggaacatgcgtaggcagacgcagggcaacatgaaagtgcatggcagattcaaggaatgttgcaggtcggtgtgatgggatcatagattcatggtagagagtggcttgtttatatacagtttatgtacagttgttagaggtgggaagaagatttgactccgagctccctagataccaaagaaaaaagggaaatatgaaatttgctgtgcctccgagctccctagat

SEQ ID NO: 88562 - DNA, 1017 bp, Homo sapiens
aagagagcatggtctggatgtattgctaaaagaggccgtcggaaataaaggaatactttggggttaccattgctaaactgcgtattttctacccttaaaggtgccccaagttagatacctgtctggcaaattacgtagtcctaatcataggtgttcttaagggtttatgtcttgactgaaaagggacaaatcacctggcaaggagaccactacctaaccctggtgactcttaccttacagggctggacagacatgacagtgtgaaaggcctttgtactctcagccatgtggcttgctggaccatctgaaggcctactgagactgtcctgggaaggggacagcaatccagtgactcacccagcagtaatttgcctgggttgactggataggcctgtcctgtagattggtatccaaagattaatatgatgggtgagaacttttagctccaatccagctggtgtgacccaaatgcataaaactcactcttggcttctcatcgaggaactaagttggagatattttaaaatgcttgaatggcagtttggagtctatttgaaaacactggcaggaatgtctagataagactaccatcagtggtcaatcactggaatcactgaagtatttcaactgagtgaaggaagtgccactcagcttcagtctgggtggcagagtcctttcaaatgtggcttcagcaccgactttctgtgcattactcatgctgtgaagtaggtgatttaagccactgactttctaaattaaaggcacaaaaaggcagacatgtaattcttttaattacacattcatatttctcttacattcctctgagtcgttcatgtctgcctcctgcctcatcagcctacaagcagaaaacaagcaacagggaatgtggaagatctgtaaagggatgaaaaacccaactcacttgtttgtactgtggcttttctcaaagaaaaataaaagcaccgtgtcgggaaacagacaatgggagatctgacttctactgatcgtagggaatag

SEQ ID NO: 88563 - DNA, 1029 bp, Homo sapiens
aaaaccttgttcttccattgttgctgaggaaggcttgaatctgagctattacactttatgtttcttaataaactccagctggggagaaattaaactggggctaccctactttgcctttttcaagtaaaagaaacgtataggcttcaacatttcaacaattgtctgtcttggtagaatgcttataaatccatatccatgtggtcacatgctcaacctcatgataaaatggcaagcctgatcaaatgcatgtggtgtggggtgacctcacaggccaggtgggagtcctcctccgttatttttaataacagctttatagagatataatttatgtatcataaaattcacccatttaaggtgtaccagttcagtagttttttgcaaatccagaggtgtgcaactaccaccatcaatttagaacattttcatccatccagaaagaacccttgtatccattagcagtcacttttcatttccctccaactccctttcacccttccatcctcagccaccactaagctactttctggttctatggatttgcctgtgctgaacgtttcatatcactggaatcacataatatattgtcttttgtgtctggcttatgtcttcaagtttcatccatgttgtggcatgtagcagtacctcattttttaaaaatccggaataatattccgtgacatggacggaccacattttacttatccattttcatcaattggtaggcatttgggtagtttctactttgtggctattataaataatgctgctgtgaacttttgtgtgggcttgtgtttttaattctcttgggtatatacctaggagcggaattgctgaggcacatgataactctgtgtttaatctttggaggaactgcctgagtgtatcccaaagtggttccaccacttcattattaagtatcctcattcccttcaccaaaaaagggaaaaagaccagcttgaattattttgctgtagtactgggatgatgtgtattaactaaaaagagatagaattggaatgacctaagagt

SEQ ID NO: 88564 - DNA, 1032 bp, Homo sapiens
cgagtataagttcttagtcgtcctttcctctttcctttccgacaggagcaccccaggcaaaaaatgtctcgcgggtcattggcgccaggctttcaggggacagtggggcggggcggggtgggcacaggacgttaggcagccgttggccctccctaaggccacaccgtcctgccgtcctggatcctgcgccagctgcgcgggggaggggactcgaaggtgtgtgagccaggggctgaccttgaccgctcagataaatggagcgcagccttgacacaggggtggaggtggttttgaatggggaaacccattcgtggtgaagcagattcactgtagctagcggaaaagccctccggcccacggacccatctagagacgaatacatagcagctgctgtggctgattggcgtgggacagcgtggggagttttgtctgaggagagggatccacttttctgcagctccaagcccaggggcctttgatgagccatagacctcatttttaacccacctttctgcttagacattgagcaagttacttctcatatagcttccctatatgttaaaaatggagaaaataatgcttagtaggcaattctgataaaagcaggtgcttgcaaaaatctctctgttgtctgaatataaactgtaccacaagcgagtgcggatgaacgaggactgcatttaaagataagtttttacactttcatttctctgtggctcgacacttctgatgcctccctttttgttcctgggacacatgcttggtgttgtcttcacacctttgtgacaggattagcactagtgggcagtggatgatagctcctcccttttgccacatgttcatccctgccctcgccaccatctcactgtgtggaattcctgtgtccactggtcaccggggcacagaagtgctgtctcagcctgaatcgggccactgatgggacttgcagcctgggagctccaccgtgatctctggcccactttgcgggagtctaggctttctggatgctccagggcctcacgtcccagggca

SEQ ID NO: 88565 - DNA, 3938 bp, Homo sapiens
atatcttgaagaaagtcaaacaggtaatattagataaggaaactttcacagaagtaattcaatataaagttatgtagttggtatatttggcaaaaccaagactagaactttcttctgaattcctgttttaaagttctttcagacaggatcttgccaccattcctcagtaacccaagtttggtcattgttaaatgttaatattagaaagtaccagtacctcatagtagcaccctaaattcttattaatcaaatggggttggcttttgaagacattagtattaaaaataagatataagatggaatgaaaaattagacatgttaaaacatagattagcattttctaagctcttcttgatattctcatgtttaaaatttattttgttgctttgttaaaagaattgtttcactaaataatatactttgaatgagttagtggctagggggtttgttatgttttcctagtggtagttaggaccattgttctttaatgttttaatcttgtgtattaggtatggtgaaccgtgaagtattagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatagtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaactcattctttgtggtcaattttcttttttttttgttttgttttgttttttttttgagacggagtctcgctctgtcgcccaggctggagtgcagtggcgcgatcttggctcactgcaagctccgcctcccggggtcacgccattctcctgcctcggccacccgagtagctgggactacaggcgcctgctaccacgcccggctaattttttgtattttttagtagagacggggtttcaccatgttagccaggatggtctcgatctcctgacctcgtgatccgtccgcttcggcctcccaaagtgctgggattacaggcgtgagccaccgcgcccggcctgtggtcaattttctatgtcaagtgagtgacattatttttacaagtattttc

SEQ ID NO: 88566 - DNA, 1057 bp, Homo sapiens
gcccaggctggagtgcagtggcacgatctcagctcactgcagcctccacctcccagcttcacgccattctcctgcctcagcctcccgagtagctaggactataggcacccgccaccacgcccagctaattttttgtatttttagtagagacggggtttcaccgtgttaaccaggatggtctcgatctcctgaccttgtgatctgcccgcctcggcctcccagaatgctgggattacaggcgtgagccaccgtgcctggcctcaaaattaagagatttatatagtttctagggggaaggagaaattttagctcacttgaaattcagcgatcagtattactttagtttgttacttctaaactcttgtactgaagtatcctaatgttgagagtgaaagcatataaaatttaatctttaggaaaaactgttttgctaatcttatgggttttgcatgttatctaacatattcctcttccctacagttccctccagctgtagatctaatgccatcaaattttatcacccactttgtctggttgctgttattcactgataccattcaagttattctcatttaatgactcaccattgtcctctccaacaaaactcctctcctgtcttaactcattgtcatcttaatacacatggtgatgattcttctattaccctggtctcttgtagcttgaactcttctcctgtgtaatcttgtctttcactctaccttagccagtctttccatcttcataccttaaaccttaatgttaccaataactgcaaccctttcaaaatctatttcatgcatctactttctgaccaccacttgccatctttccagataactccctccaccccaaccctagcaatttcttgatgctaccaggatctttactccactgtttctgccaccttttcctgcttctcacccccttcatgaaacaattctactccttaaattccctagtgaagcagtataatcactcctttgctgatttcacccttctctgatttcatcatcattgcttagcaaaatcaccacattaaataaatccaactctgcct

SEQ ID NO: 88567 - DNA, 1115 bp, Homo sapiens
aaagatatacagtaagtatttgagttaattaacatggacttttaaaagtagtacaataaaattttccagaatgatataaaaagtaggaaaacccataaacattataactcaatagaatattcactcatcaaccaatagttaactacagctattaggtgccagactgtacttaaaagttacacatattataacatgtatctttggcttactagagcttcaacctctattttcttaaattgttttctgttcccacagccaacttattttttatatcatcagctgtctaatcaggaagaaatgtgatttatttcaatatgaattttaaaaattaaagaatttttatcccatgtatcttgtacatttaaagaattgacactgatgactacagtagagatattgacagaacattagccctgcatatgctatgtttacacaaatagatttttaaaaaacaattaagcaagatggtcaacattattttaggtgcaaaatttccaatcaaatggacagctcctgaagctgcactgtatggtcggtttacaataaagtctgatgtctggtcatttggaattctgcaaacagaactagtaacaaagggccgagtgccatatccaggtaagcttgcattttatagctcttggttatctcatgagtggctttatcaggagtttattaggaacagaattgtaagcggggaaaaggcctttatttcttctcatagtccccctgcctctccctctccccactccttccctttactgtggcattggatgggtaactgtggcattggacgggtaagtcagtgaaagccacgatccttgacagggtgagcacatgagataggccccacattcacctcagctttctcaggacattttccaaaggggcctcttactgttctctcagataataaacatatcttaaatatcctggctcatccaccctataccctaaataactgttctttcccagtagtgtgattggtgttttgttttttttttttttttttttttaaacacagtcttgctctgtcacccaggctggagtgcagtggtacagtctggctcactgcaacctgtctcccgggttcaagcaattctcctgcctcagcctcc

SEQ ID NO: 88568 - DNA, 1111 bp, Homo sapiens
tttcccaggctggagtgcagtggcacaatcttggctcactgcaacctttgcctcctgggttcaagtgattttcctgcctcagcctcccaagtagctgggactacaggtatgtgccaccacacccagctaatgtttgtatttttaatagagacagggtttcaccgtgttggccaggctgatctcgaactcatgacctcaaatgatccacctgcctcggcctcccaaattaatgggattataggtgtgggccaccgcacccagccagtgttagatttttgaaatctgaatttagcctgcatttttattatgttttctggttttcctgttatcttctagactataccctgttaccatcatctccttctaaaataatatgattttcagtgacacaatttgatattaaccataattgtcttctctctgcttccctttgtatcgtatgtcttgtgttttttgtttttctctttccaagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtaaaattacttttacataaaagcttgtaatgtgttgtgtgttttgcttaactctcttgactatacagggttttccagaataagaattgttttagcttccctcagaagagtcatagagacattgatttcattcataaaatcatgtactgctgtggctttctgatagttatttcctccaagaaagaacttgactaggtatcctttgcattatacatagagcaagtagtagcctctttacacttcttttgacatgacaacaaatatattttaatttctttcctagaaaggccagaggttctcagtcagaggagatattgccctgtaccgccactcaccaggggacatctgacaatgtctacagacttttttggtggttacaacctgggggctactgcttgacatctagtgggtagaggccaggtatactgctgaacctcctacagtgtacagaaatgtgcaggcaaacccccccttccccccacaac

SEQ ID NO: 88569 - DNA, 2180 bp, Homo sapiens
catatttgctgtaggaaaatttttcccctcaaaaggggactgaaaccaaaagttaagaaattatacagcctattaattgatagccagaacacacctaaagacccaaagcacctggcgctctttggaaggaatgtctactgcaaacagttgccaaatatgacatttttttgtttgtttgcttgtttgtttgttgtttttgtttttttgtgaggtggggcctcactctatcccccagggtggagtgcagtcacatttctctgcagcttggacctccctgggctcaagcgatcctctcatctcagcctcctgagtagctgggattacaggtgcatgccaccacacatagataatttgtgtatttttctacagatgggatttcaccctgtttcccaggctagtttggaactcctgggatcaagcaatcagcctgccttggcctcccaaagtgctgggattacaggtgtgagccaccacacccagcccaaatatgccctttcaaagagtatattagatgaaccagaggggaagggagggccaggcatggtggctgacctgagcaacatggtgaaaccccatctctacaaaaactaaaaaaattagcaggacgtggttgcacacacatgtattccctactcaggaggctgaggcatgaggattgcttgagcccaggaggttaaggccatagtgagctgtgattgtgccactgcactcccatctggggtgaaaaaatgagactgtctcaaaaaagaaaaaaaaaaaaaggagaaaaggacagggaagatgtttaaatcaagatattggaagcaggccaggcacagtggttcatgcctccaatcccagcgctttgggaggccgaggcaggcagatcacttgaggtcaggagttcgatcccagcctggccaacatagcgaaaccccgtctctgctaaaaatacaaaaaacagctgggcgtggtggcttgtgcctgtagttccagctgctcgggaggctgaggcacgagaatggcttgagctagggaggcagaggttgcagtgagccaagatgacaccgctgcactccagcctgggtgactgagtgagactccgtttcaaataaataaagactttaacaattaaaaaagatattggaacataagaaatataatgaaggtaaggctaatagcccatttagctctgtatattaattttaagaattatttaattgggagaacatggtaaaattctgtgttgtcagaccactgggtacaattatttccaggcgggagagatttagaatacaagataacaaaagtcctttctatttttaaaactctttaattcctcattttggtattcacttagcacttgtccctttataatctgtccaaactcattgtcccatgcactccagcataaacccactgttctgctctttgttttcatgattttttcatgttttctctttgacctggaatttggtctccctagctctggaccagtccaccaactacacttccccgatccagtttatggtcaggcattccatttagttgtcatttctatttagtctcctttaatctagagccattcctcaaccttcctctgtcttccatagcattgttacttctgaagagaatagaccacttttatgttttaaatgtgccttaatttggttttgtgtgatgttttctcttgattataagccttaacaaataatagtgaagccgtaatcagacttctagcctttttctttgctgttattcatagtactttgtagttttcagagagagagcttggtcacagcagtagttccacagcgactcatttagctacctatatttagttttaaccacacccaagatattcctagttgtctgaattcttgattcagatttacttaaaaatatgtaagtatttaatactactttttgaatcagaattgggatattgatcaaagcgaggaaaaaatgcctcttgtcaggtaaagttaatgcattttctttttttgcatgtgttatcagaagttttcaaaatttcagcttagagacctcttctaggacctagataattatttggaaactgcaaaactgcacaaaatttaaaaaaaatgaaaagctaagaagttttgtgttgtgatttggggtggaggagtattcatttcaatcctaatataagatttgcttattttttatgaatatcttgc

SEQ ID NO: 88570 - DNA, 1795 bp, Homo sapiens
aggctagagtgcagtggcgcaattttggctcactgcaacctctgcctcctgggttcatgcgatccatctgcctcagcttccttagtagctgagactacaggcatgcaccaccatgcccggctaacttttgtatttttagtagagacagtgtttcactgtattggccaggctagtctcgaactcctgacctcgtgattcatctgcctcaacctcccaaagtgctgggattacagacgtgagacaccttgcccggccttaaaaataaattttacaaaatgtttcacttatgtatatttcatgttttgctgcttatggacaactccctttttgttttgtgcttttagagtaaaactcgaaaggacttctgtttttgtttttctacagtttaaacttaaaacattgatacactatatgccccttaatttttgtaattgatattacagtatagtttattcatttatctagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggtaagaagcctgaatttttgttttctgtcattgtttagctgtggattaaagtgcaacaatttatgataaaatatgtttcaatatttaagagaagtgctgttcactgaagtttggtctaaaatcctttaaaatataaattcctaaaatgtgttatttctttaggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggtatgtattagtatctccttaggtatttgtgttgataatgtttttaagagtcttgatttgtatgcatatagacttatactgttttctaatttaagatttttatgtagacatatttggatagaagaaacctgacactttgtttaatggaatagtgattatccagttattccagaggatagtatgacgtttaaaaggaaaagtaggcaggctgaattaattttgaaattaagtttgactaaaacaaatggaaaagctagaaaggtgaaaaatagaaagtgtttgtacacatttaattaaaatgataaaatcagaaagatacttacatttttagtactaaagcaaagaaataaggtaaagttaaaatgaattagttttctcattttaatataaacataattcctatattcaggacttctaggaacttttttccccactgctttctttttttttttttttttaaatagagactggggtctcaactatgttgcccaggctggtcttgaactcctggcctcaggcagtcctccctttttggcctcccaaagtgctggtattaccagcatgagccactgtgcctggcctccccactaccttcaatggaagtttcttcattttccttaactctagaccacaagatgggatcttcagtaacagggttagttagggggaggataaagagaagattgatactctttcctctttttccctgtgcagatggtacttagaggaactagtaagtcagcagataagctgacaggcctgatttttatgtgtttgatttcatctgctttattattatttttactcttgaaccaataatatacagtagtca

SEQ ID NO: 88571 - DNA, 2398 bp, Homo sapiens
agcacttgcattgtagttatgtaggaaagtatccttctcttttagcaagtacacactgaagtatttgaggcactaattcagcatgtttgcaacttacaattagttaagaaaaaatacatgtgtatatatatacatgcacacacatacatatgtagagagggagagagtatgacaaagcaaaatgttagccattggggaacctagttgtagggtttattgtagggtgtatgggagttctgtgtcctatttttgcaacttttaaaaagtaaaaattcaccttcagtgacacactacttttaggttaaaccagtttatctgggattcataaacgctactttattttcatgttataacacttaacaccgtaccttgtatatgataggtgctctatcaatgtttgtttgcttttattaatgatttgtaatgtgtctcaataactctttgttctactatggtgcttcttactttttgttttgtccttttgtctttcttctcattttctgtgagctcttccatagcagacactgtcattttattcacaaaaccttattaaattaaacccacacatatttagagttactaataatttgggtatgatatgcctgtgtcttactgaatgcagatgatgatgctgttaccagggaaccacttctattcttcctgtcatagtcttaatatttccatttgtcactgacagaaagggtctgttattttgctgcctttccctctctactgttcctgtgactgtcaggtggagttttgagagacacattgagtagttaatatatagaaatactgtaagagtatattctaacagtaatatttgtgatattactatttaatcaataaaactcttacattttcctgtattttgagccatgttctctagctattctttgtcgtccaaacctatcccagtccattcttactgacacttctgtataatttttctgaacctcatacttttcaattcaaaacacttaatttttttccagatggtattttggcaaaatggggagaaaagatgctgaaagattacttttgaatcctggaaatcaacgaggtattttcttagtaagagagagtgaaacaactaaaggtatgaatattgttatattagtataagtataaaatttcttggggcagtattttgagaaagatatagtgaaagtatttatttttcacccaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacaggtatgtgaatatttcaaaggtaaaaattatttcttcatattctagtttatgaggacaaaatccatatcctcatttctcttaagatttaacacacttatttacacataatacatgcccaataaatgtctgttgtattctaaagggaggaacaggtaatacttagtacttgcattgtgctactcagataatgtgctaatagactctcatcatttgggtccttatatcttactggcatagtatttacattggagttcatttcaccacatgtaccttatgaaaataaacctaaaagcaaatatttatgggcacttagtaagtaaaactaaacattgggtaacagaaaaagctatgtcagaaggattaccttcctctgcatgggctggatcgcataagctttcctaaagtataaatccagtgaaatttggtctgacgatgcatttttcttatcctagaaaattaacctatagcaattatagacatttttgtctttcaaggacctctgaaggtatttaatattagaatcttctgtctcaaaatttttcattaccaatttggcatatgaatgcacctgaaagtctttacatgattaatactaggagaggggatgtttccatggtaatgtcttcaatgacagctagctgcaaactgagtctatcaagtcagccagcaatcttgacattgatcaagcatgttaccaagcagtggcatcacttgtaattgcctttgtcacaatgtgaatttatgtggttattttagtgagaataggagagaacatgtctcatttataataagaaagattgtataagcagaattcataagtcaagctgttatgaatctagggttccctgactttgtgtctcccttatttaaaaaaatcagtctcctgttaggcatgtggattgtgcctttaatcccaactactgatgcaggaggatcacttgaggccaggagttcaagaacagcctgggcaacatagcaagacctcatctcttaaaaaaaaaaaaaaaaaaaaaaaaaaggccaggcgtggtggctcactcctgtaatcccaccactttg

SEQ ID NO: 88572 - DNA, 1042 bp, Homo sapiens
tattcactatcgtctgtcttaggttgaaagaattgtgttaaaaaaagaaatcttataactaagtgtgtaggattttgaggctttatttggagcagaagtatgcaattgtgcttcctttaattcatgtaacctattttttaatatcattctttgagtttaattcttcatccaatgaatgcataaataaaaaatgaaagtaataccctttgtttacttcagatacaagatagcactgcaatatattgtaccttgggcaatagtctaccttgcggtgattgctgttttatgtgttgcagggaaggagattggtgggaagcaagatcaatcgctacaggaaagaatggttatatcccgagcaattatgtagcgcctgcagattccattcaggcagaagagtatggcactacttcatattttattaattattttgatttttgaaatgttttaatgcacattctacttagccacaactttacacacacagaattatataccagtcttaatacagcttatgtatcatattaatagatgttacttaaaaattaataactaatgtcatactattcacttagagtaggatcataaacgaatctgcatcagtcatatttccttatgcctagtctctctcttttatgttttcacttaaatatgtatctataagccttttgcatatttttcagactgtctcacttcaaaaatttgccttctgattatcctcattccctgccttgacttattttttaacttacagcttatatatgagggtgtgttgatagggatgggtatattggtatatatatgcatcccatatttatgatgccaagacttacattcttcttttttttgagacagggtcttggctctgtcgcccaggctagagtgcagtggcgtgatctcggctcactgcaacctctacctcccaggctcaagcaattctcctgcctcagcctcccaagtagctgggactacaggcatgcaccaccacgcccagctaatttttgtatttttagtagagacggggtttcgcctattggccaggctg

SEQ ID NO: 88573 - DNA, 1733 bp, Homo sapiens
gtgtggcggcacatgcctgtaatcccagctacttgggaagctgaggcatgagaatcacttgaacctaggaggcagaggttacagcaagccaaaatcacaccactgcactccagcctgggtgacagagtgagactttgtctcaaaaagaaacaaaattaaatttgtttctccaagtctacagagttttataatttgtagaatacagtagttttatggaaggtcttcggagagtttaagactagttattgctaccagttattgagttattgtcccagaacataaaatatggtcatgtctctctactttaaaattcttcagtagttccaacttctaaaaatagtttctggagactacagaaaaaactatccttaagcttttttttttttggctggcaatagttctttttttctgttttgttaagttagctacataatttaccttggtcttttttccctctgataggtggtgttactatatttgtggccttatatgattatgaagctagaactacagaagacctttcatttaagaagggtgaaagatttcaaataattaacaatacgtaagtgtcatgaatattttgtgagagaaatactgacagaaatctggtctttacacaggaaccactgagctggttgatgatccagagatgagagaggtagggcatgggctgcccactgtgtttaacgatgcattggcttctatagatgcatgttgcaacactgctgctgtagccagaagttattacttctacaatttgtgctgctgtggttctgccataaacagtagagatttaagaatgaagagttactgaggggagtacatgcaagtgtattatttttttaaaaaactttataaagagagtttgatgctcctatttttctaagtaccagatggtgtaaagatcttgtctcattctattaaaaaaaaaggagggggagaaagttgggtaaggaacccatctactttccaattgatgaaattaagttgtgtttttccttttgtgacagactttttgtctagaggtacactgtagaaaatttgatgctcgttgtagaaagtagatcgaataatttcattagcaagcataatgaccactttgtaacttctcaaaatatatatttatggtctgcttccagtcgtattttcttccatccatgttcccatctgctaccagttattgttccggaacataaaatatggtcatatccttctacttttaaaatattcagtacctaccacttgccatcaagataaaaggaaaacgacaatgataacaacaatcattcattgagaatttactatgtgcttctcccctcttctaactctaatacccagacatactgaattacttgcaattttctgagtacgctggagtttcttatactctcatgctttcacacatactgtttcttttttctggaatgtgatttctcatctttccatttctttcctttatttagctaatcctactcacccttcaaaatatagttaatatgtcctttctcaagatgcctttccttaacattcttcctcccctgcctggcccagtccttatcccctgctggattaagtatctctcttaggtgtttacatagcaccctatgcaaacctcaatcatagctgtcatcacattttgaattacaatttgtcacttgcttgttattcttttagaccaatggttctcaacctgggacagaatcacccaggggatatttggcagtatctggaga

SEQ ID NO: 88574 - DNA, 1059 bp, Homo sapiens
ggcaacagagcaagactccgtctcaaaaaagaaaaaatttttttttgatctgacaagtcagtgggattatgttgagtagagtatatacatattcaaattaaaaatatgttggctaaaggatacaaaatttagataggaggagtaagttcaagagatctattgtagaacacagttaataacaatatattgtattcttgaaaattactaacaaaattttaagtgttctcaccacaaaaatgatatgtgatgcaatgcatacgttaattagctctacttagccattccacaatgtatatatatttcaaagcatcatgttgtatgcaataaatatatacagttttttaaaagaatattaatatattatggagtttttaacctgaatacctgccttgaataattttaacactgagatgtcatgcatattgtatacatctgttttattatttgttttgtttgcaaataatagtttggctgttcagtatgctaatctctttaagcatctgcacataatgctaaatatgacagtttttgaatttatactttataattcatatcatccataccattttattttatttatttttttgatacagagtcttgctgtgtcacccaggctacagtgcagtggcataatctcggctcatggcaacctccacttccgggtttcaagcgattctcctgtctcaacctcccaagtagctgagattacaggcatgcgccaccatgcctggctaatttttgtatttttagtacagacagggtttcgccctgttgaccaggctggtctcgaactcctggcctcaagtgatttgcccacctcggcctcccaaagtgctgagattacagacgtgaaccactgtgaccgtctgataccatttaagacaaaacatgacatttttatctttaagtgttaaatatgtaataattttgctaaaactagtaaattagttattactggtaatgattagatgcaattgttcattcattatttatatgaagaacactgccccactagtttgtagtagtcatcaatcctttttctgtcaaataattgatttg

SEQ ID NO: 88575 - DNA, 2696 bp, Homo sapiens
aaaattggtagtaacctgatggtgattatgtactggatcatgtcattaattattttattaactcattattcaaatagttattgagcccccccccactgtaggcaccgggaacataaagattaaaaacatatacctttccctcaagaatttgacaacttctcaggattgtaaagtactttgcagtattaaagtcttatagtggttacttaatagatgttaattaaatgacagtagagtagcgataatacagaatttctcccagatgctgctgatttaaaaaagaaaaatcctaaagctcagacagtttaaaattttcccccaagtcacagatagtaagtaggagagctcagatttattgtcctattccagaactccaattattacattattatatccttttagagaatagcaagaagtgattgttgacaacctttcgtggagacagaaggctcttaaaaaaatagattcaaacaattttaaaagagagaaaatgagctcttttgtaaagggtcccgtatcaggatgctttttcactgaagtaacaaagtatagctggcttaaaaaggtagagtgagtttcaggattccttgatagagcagttccatggtgtcatcaaggactcagatttctttatctctattctgcagcccttgggagtgtctgctttatccttaggcttggcaaaacagctgccagcatcaaatcaagcaatatatgtcctcattaacagccagtgggtgcaaaagataaatccccactacaagcatagactgactatacatttgtctcttcagtctgttccaactggaccaaaaacaatagccaggccaggcgcagtggctcacacctgtaatcctagcattttgggaggctgaggcaggcagattgcctgagctcaggagtttgagaccagcctgggcaacatggcaaaacactgtctcaactaaaaatacaaaaaaaattagccaggtgtggtgttgcgcacctgtagtcccagctactcgggaggctgaggcacgagtagtgcttgaacccaggaggcagagattgcagtgagccaagattgcgccactgcattccagcctaggtgacagagcgagactctgtctccaaaaaaaaaaaaaaggcaatggccagaggactgccatacactgattctgttagacttcatttagggagttatgcatgttaagtcaattacagtcttaattccagccccctaattctgaatacttcagtagtagatggccatgagggcatttctaagtctttagcaaaagtttacttttagagttatgtttgggaaagatagtaatctaaaatggttgaatattgatacttaaagacacactttagttacctaaagcaatttacttatatgaaatattctattaggggtattcatttattaactcagtgtacactcagtgtctgtgtatcaggtatggagaggtgagcaagacaaagtttctgttctgatggagcttacattatagagggttggacaataattaatgaataaacagctaaacaggatggatgattaatgatccttaaatgctatgaaggaactaactagaatgatggtgaaggccctgcagttaatcagggaaagctatctcaagaagaaatcatttgagctgagattttttttttttttttttggagttggagtctctctctgtcacccaggctggagtgcagtggcgcagtcttggctcactgcaaccttctgcctcccaggttcaagccattctcttgccttagcctcccgagtagctgagataacaagaaacaaacaccacggcacccggctaattttttttgtactttagtagagacggggtttcaccacgttggccaggctggtcttaaactcctgatttaggggatgtgcctgccttggcctcccaaagtgctgggattacatgcgtgagccaccgcacccagccttgagctgatatttgataagtgagaatgacccacctatgtgcaatcctgggaaagagctttctagagagaggaaataacaaatgcaacatttaggagatacagagagacttggaagttttgagtattagtgtggagactagtataaacagaggggagaattgtattatatgggattgaagagttaggagaccacgattactcaggaccccacagactctggtagcgagtttaggttttattcaaagctaggaagaaactgctgaagagattaagtaaaggatttgattgaattttcttttgagaaaaactgactctgacatctgtgtggggaatggatggtagagaagcagtatagaagcagatgagactggcactctcagtagtccacccagtccctgtgagaaatgacaaggacttgggttagggtagcagcagtggaaatggaaagtaaatagtattttagaggtaaaactgatagcactagtaatggactcggcttgagtacctgattagatggtagggccatttacttagataggaaagacttgggtatgtaaatataggttagaggagaaaaatcaagagctttgttttgtaataaattttaaatgcttattagacattcaagtaaagatgtcagccgggcagggtggctcacacctttaattctagcactttgggaggccgactcaggtagatcacttgaggtcaggagtttgagaccagcctggccaacatggtga

SEQ ID NO: 88576 - DNA, 1332 bp, Homo sapiens
gctcttgttgcccaggctggagtgcaatgacgcaatctcggctcaccgcagcctctgcctcctgggttcaagcgattctcctgcctcagcctcctgagtagctgagattacaggcatgggccaccacgcccagctaattttgtatttttagtagagacagggtttctccacattggtcaggctggtctcaaactcccaatctcaggtgatccgcccaccctggcctcccaaagtgctgggattacaggcatgcaccaccacgcccagctaattttgtatttttagtagagacagggtttctccacattggtcaggctggtctcaaactcccgacctcaggtgatcctcccatcttggcctcccaaagttctgggattacaggcatgagccacgatgcccagccatgatgttaacgtttctaagacaacccataaaaatcagtttaactcatattgcacctgaaatttacttaaaaatgtgaatcacgtatgacattagtaatatttcaaaatgagatgagcagcaatgatgggtcctatgcattgatactggggtgctggtggaattggactgaaattaatgggctatcctagagttattggaaagataagtgcgtagatgtgtgaggcattaggctcaatactctggattaagaaaatgaggctggaggacaggttaagcatagtaatggaagacttgatagggtgaggagaaaaggtgtgacttttgagggaagaggactttaagatggttatgggtaaaggaggtgaggatgaggaattaagctgggaatggaaactgaggtagttgggcaattataggagcctctgttgtgaattgacatggtatttccgagttggcctcctatcagaatttaaattacagtattactgggtttcccccataatttttcctccttcatacaactgctgttctttcaaagtataatttatgtaataattaatgctgttttcttgatatttagactttggatgcaggtaattttgtaaattccttgtaccgacttttaagatttttacagttaaactttttttttttttttttaaacggcaaagaacagtgcttggccctgacagaaagtggggtggggaacagtagacctttccccctcccagtttttacatattttgtggatatatattgattgttacaattttgccttcaggcttaagtatattgagtcaaaatcttccagtctggtaaccacaaaaggtatcttcttataatgtgcatttcttggaagactgggaaggttggatgcattttcatatgttaattggcctttcctgtgttgtgaattgtctcttgata

SEQ ID NO: 88577 - DNA, 1094 bp, Homo sapiens
aggctgctctcaaatttctaggctcaagcaatctttccacctcagcttcccaaaatgctgagattacagacatgagccgccacacctggctgcttttgccttttctcacatgggtcagttggaatagttttataacttgtctaactgctgtcattttttcttctttctaggctgtataattcatccttttgtcatagttattataaaacacatatcttctgctattcctcaaaacaaaaattctggattcctaatgctccctggagaaagtctaaaagttattgcataacaaataatcttctatattaaatctcctctagctgcctgtcctacccagctcacaaacagcccctcacactcttggaacagagaaattttctgttcctaaaatgaaccatgctgtttcaagcatctgagccattctgtacacttttcattcttcctggaatatccttttctttcccccaagtctccaactcttcaagaccaagctcagataccacttcctttgcaaaactttttttcctaagtgctttaagcagagctgataacatttgttgtatttccatggtattttgtacatacctccactctaacattttgtcacactctagcatttttcacattgtacagtgttgtatttgtttcatacatttgtgaccttttaatgaaaagggaccatttattgtcctcccagctccttttacagtgtctaatatacaatatttttagtttttggttttattttgatagcttttgaggtacaagtggtgttcggttaaatggatgaattatgtagtggtgaattctgaggttttggtgcacccgtcaccggagtagtgtacgttgtacccagtatatagttttttttaatcccataatgtatgttattaatgaatatataagtcagtagcttggaacttggaagagacttttccatataaatgttttatttttttattttgggggatttttcttgtttggtttattgtttgttttttctttccatcttttattttagattcaaggggtgcacgtgcaggtttgttacatgggtaaattgtgtgttgtggggtttggcctacagataaatt

SEQ ID NO: 88578 - DNA, 1093 bp, Homo sapiens
aaataaatcatgtaaccttgttatatgtgtgtttctgttcaaagatgccgtatatatattaaaatgtaaatggaatgaagtccttcagaacatgcaggtatatttgactttatggtagagatatggtccttggagcttgaccatataaaaacttgatgtgcagcaaatcctattttcccatacgttcttattcaggtggctcttagtttcctatttccaagtggaaacaatagcagttgctaaataatgcagaaattgatattatcaattgttattgccaccctgaactgatatggtattaattttggcaagcaggtgaattcataaatatggaattcaaaataatgaggagcaactctgtgtgtgtgtgtgtgtgtgtgtgtgtgtgtgtgtgtgtgtatggacttattaatgatgatgtttatagtaatgaatgttgcaaagtgccttctaggctaaccacaacaatagacaaagattctattttaggtttccttagctctcttgccagtgtccctcaaacttgacactcttatgtgaagctccccttcctcctactctagggaggaagaaaaaagggaaaaagtctccatgtttgatattgtgacaaagaaggaagtcaacccccacccccaccccatcttctatcttttgagtcctggtgatttgagtaattcctgtgtggagaccagcttcctgccaaattctcatttagaggttatttgaagaacaattgcatcttagggtttcttagtttattttgtgttgctataacagtaccacagatttggtaatttataaagaagagaaatttacttctcacagttctggaggctgggaggtccaataccaaagtgctgacatctggcaagggccttcttcttgctgtgttatctcatggtggaaggcaagaggctgagagagggttagagtgagggagagagagaaactcactttaaaaagacagtgtcactcttttgcccaggctggagtgcagtggcacaatcctggctcactgcagccttgaactcctggcctcaagtgttcctccctacttcagcctcccaagtagctgggactactggtgctcaac

SEQ ID NO: 88579 - DNA, 1046 bp, Homo sapiens
gagtaccacttaaaggctattatgttcttcagagtacaagacatcaggaggcacgctgtgttagtctatcctactattggcagtattaactttgattacttagttaagtgatatctgtcaggtttcatcaccacaaaatgaacatatttctctttttagtaaattacagataaggtaatagtttttgcttccattgatgattccttggctgaattaattattgcagtaagagttgttctgggatacgtgtgctgaatgtgtagctctcttactccaagtttagtagttgggattctgtaagagagaaccttcctgtccttatttatttatcagagtgacttatggattatcttagtcaactagttgtaatctgttagtgtcaccatttttttttcttgatgctcagattctgtgtttggtcagcaagagcctcttcaaactagttcctatgtacttttgatagatccctatcatttgttgagtactactttataactatttttggtatattacaaaactacttatttctcaatatatttttgtagctgctctatagaaatctgtgtctgatagcttttcagttaattctcttactttttttgtataagggatcatgcaggtcagacacagtggctcacacctgtaatcccagtgctttgggagactgaggtgggaagatcacttgagcctaggagtttgagaccagcctgagcaatttagtgagaccccatctctgcaaaaaattaaaaaattagttgggtgtagtggcagatgcctgtagccctagctactcaggaggctgagatgggaggattgcttcagaccaggagttcgaagctgtagtgagcgatgatcatgccactgcactgtagcctgggtgacagagtgaaacctcatttcaggtaataattataatggccaggcgcggtggctcacgcctgtaatcccagcactttgggaggccgaggtgggtggatcacgaggtctggagtttgagaccatcctggccaacatggtgaaaccctgtctctactaaaaatacaaaa

SEQ ID NO: 88580 - DNA, 1006 bp, Homo sapiens
tctgatacttccagggccctaccagtaagagagaaatcatggagacaggtagatatcttagaagaatgattagatgatgtcttaaaaggtgaacgttaataaatgcagacactgaaagttgcctttgattcctgacaaaatttttaaagtttgttaaaaagatgtttatcatttttaagcaatttgaagattataaagaagtaatttttaacagttgtttagaagtgctttattgaactaccttgtctcgagtttgagtaaatgctgcatataggtcattgtcagtggtactttcttgtgttagtgagtggtcagacctgataagcttagttttcttctaacagtaaggttcagtgattgcttttctacctgtgtttttttttggttttgtttttcctctttccataataaagtgttctaatggcatgataggtgttgctttttcttttggtgataaacagagccagggatgttagcaggtttaaagctctttctatattttcccagtttttttagggggattgatagaacattgttttatttttgttatatatatgaataaagatatcttaaaattattttaatttgctttttcaattgaaggctactatgcatctctccttgtggtgaactgcttgctcataatctttaccagttttactattgggttatttgtctttttcttacaggtttttagggactcttcaatatattatagatattctttctttgtctttatgttgcaaagacttttccatgtctgtgcataatgttccttctgtaacttttggattttgtgtttcaagaatattttctccacttgaagatgatgttaaaaattctacttacaggtttttgttttgttttgtcttacaagtcatttagctctatactctggattttatgtatgttgtgaggtaatttttttttcctcagatgatatacctcactactgctagttattaaatctattttcacactggttcaaaatgccaccttttagtgt

SEQ ID NO: 88581 - DNA, 1471 bp, Homo sapiens
gctggcctcaaactcctgacctcaagtgatccacccaccttggcctcccagagtgctgggattacaggcgtgagccaccatgcccagcctcacaaccatacttcttaaaaactctggcacacattagttcctcttatattacattgatataagcaagtcatatggatttatctgagtgtaaggagagctggaaaaaatagtttctagcaggtcagccacctcccagtgagggctgcataccatagaaggggagaatgaattttgggagaacaggtaattatctctgtcacagaaggggatgaaaagtatggtagttacacaagttagacatctgtatggaaaataccacttggttctacaaatgtggttagaatatttgaaaggtatgggcatcgatggtatcttaattcgggttacagtattggtataaagcaaactggttagtccaacggactaacacatttaagaaatgtgtttcttaaagcagagcatctgactaatttaattttatatttgaggtggtaagctataaagatatttgctattttgaacttaattaggatcagtaggaaaaaaagctagtgatatgtaaattctagaaagaacctttgacgataggagtcatgtcatctcgggtttatattaaaagtagcaggaaagacagttctggattttaagatgtgtgcactagactttaggaaacattggaaaaccagtaagagtgaggcttaaaattctaatggacagtgtaccccctgaaggagtgaaaagtcttaaaatgccccagacttcttatatgaaaggttaggaagcgcactggtggagggagggggtcagagtagaaaagtattatatgtccatctacataccacttctagtgattgagaacagatactaattagccatatcaaagaattccatggtggtagtagcaggtagaaattagggtggagctaaagcggctcccctatgcatcttctcaccatttccccttttcccccaccctaccccatcagtcactccaacttgggtcttagtttttgtattgtttttgttttaatgcatgcactgtaagtcagaaggagaaactcataacaaatgtcaagtagaaaagagggttgtgaagctcttaggatgttgtcagaagatgaataggatttttacaatgaccgatgtttcagaaaaggaaaaacaatattgatgattcttagagataaatttatagctagagtaagaagtcatgaatctgtagttcaggaaacttgaaataataggtgacacagaacacatagtttatctcctttttatcttctcatttctgaaacaagaagttgctctgtaaattagaaaaactagaacaaacaaaaagaaaatagacaatacacttatctggctggggagataccatgatcatgaaggtggttctcagagtgaggctcatccattgcactttggttgtgctgacccctgt

SEQ ID NO: 88582 - DNA, 1184 bp, Homo sapiens
tttttttttttgatgaagtatcactctactgcccaggctggtgtgcaatggcacgatcttggctcactgcaacctctgcctcccaggttcaagtgattctcctgcctcagcctcccgagtagctgggattgcaagcgtgcaccaccacgcccggctaatttttgtacttttagtagagacagggtttcaccatgttggccagactggagcatgcctggctaatttttgaattttttggagagatggggtctcaccgtgttgtccaggctggtctcaaattcttaggctccagcagtccacctgcctgggcctcccgaaatgctgggattacaggccaccacacccagccacagcagcgtcttgtccttacttttaccactactatctactgaaaatctggagatattcctttgacttatcttgtctttggaatttggtagtttggggtttggcatttgggatggagattagagaggattgagaaaagtagtgctcaaacttgtataaccagaggaaggatgaggtacagttagaccatgcatttgaacagtaagaagtacacatcattatggcatatacttagcaagagattggtgttatgacctctttgtgctcccacaaaacacttatgtcaaaacacacctctccttgcactgtaattatttctttccatgcttgtctgttattcttgacctagtattcactgtgtcaaggaactgttttatagcaatctttgagaacagcccttagcacaataaatactaaataaattctgaattgtatgtagggatgtggttctgggcagatttatatgaattacagctatggacttttcgcaaacaaaacaaatcttttgagtacacctctactaaaatgttataaaactagcttaatactttttcatagctcgaagttaattctttagatttttgctctcaaggttttgttctagaaggtgattttacaaaatagcttaagcagtccttcaaatatgaatttaaaggtcattttgatatttctaatatgaactgaaaattcattgtagttgaagttaaactagtctctagtaaggtttattttaaataaatacgttgtactattttagtgaagaaagtccaagttatgctgaagaaaaatcctagatttttaaaaaatgcatttggtatctcatcacagtagtgaca

SEQ ID NO: 88583 - DNA, 1645 bp, Homo sapiens
tgcggtgagctaagatagtgccagtgcattgcagcctgggcaacagagtgagactgtctccaaaaaaaaaagtcaaatactccgaaatgtacaataattagagaatttttgggaaaaaatttctaaataaagttctagttcgttttctttaataacttaattgttttaatattttcacagaagacacaggttttacaaaattaaaatccgcttcggcttgtatgttgtaaataaccaatagaagataatcaaaatgtttattgaacgaatggatactgttctgtcatcaaatactctgtttttctgaaaattacataacatgacaattaaaactcaaaactcaattacggcatcaagatcctaagttttgacttttatctattttcggttttctagaacagtaattctttagatcagtaatttcagccttagtttttctattcttaagaatgccatgaaatctcagcataaaataagtttttgtttaaagtttatgaagattcacagcacctgaaggatgaatatgttttggttcaaaaggcaaatgacaatatggtgttggagtttcagaaatgcagagaatcattgggtcatgctattttatttgctttatgtaatggcttgctattttagtggttgatattgtggctttgcattgttgtagagttgaagaagagatctcatctgtgccaaatttttatatcacaggaactttcagtcatgttataaaggtgatgtttgtggtgcacgctttgttgtgtgaatatttacaggaagttttagtaagatcttccattgtttagaaccctacatggcttaggtcaccttcagttcacatttaaacagttttataatataagtcctatagcgaggcacaactgcttttctttaaaggaaataatctgtttctattaaagtgtcttgtcttattggtagttcgtgtatggctatggtagggtatgtattatctcttttcttcctctcagctgctccagtgccacaattaggctgagtattgctcagctgcagctgctgggtgattactaaccatccagctcctgtctaaactcagaggcagatttagcaaaaggagctatagtaacagtagagggtgaaagagaagagccagtgctgccgccaatatcgttttcacatgtctgtatgccaaggaatcgttggctgcagcagcactactgttgtcttggaactagcagacttgatggcaatatatcctggtctgcgttgggtttacctttaagatctgaaagcccactccaggaaagacagagaatcctgtaattttagagtatagaataatgtactgttgaggtactaatggactgagttacaagcctctgtgcctcaactccttttcccccccaaatctagggtagcaatgcccttcagtttctcttgttcaaatgtacagtaagctgtgagactgcaggttccttgaagcattatacttcatttcactttaagctgtgattcttagaattgcttcttttattgttgtttaggggaggggagtagaattgctggcatataggttctttggactctactttctcctaggaagtggaaggccttcaagagggataacttctagaattagctatacattgcatatccgtggtggctgcct

SEQ ID NO: 88584 - DNA, 1018 bp, Homo sapiens
ccgcccccgcgggcccgagtcgggaagttgggaagaaacttctcccctcccccggatcgcccggcgggcttgtctcgttccccgcgctacctgctcgcccctgactcggtctctgccctgtccagacctgccgggtcccgcccaagtccgacctgaggttccaggggcgtggggacactccccaccccttgtctttggggtcgtgtggaccgcccggcgacggggaggagaggtttatttttgcccctacggccgaagtaggggcgagggaagcggcccctttgggtcctaaaggctgggggtctgtgtatcggccgacgccggtagcagctgtgcggggagaggagcgggtgtgtggggcgagtggatgagcctttctggctttacttggtttgattgaaaaccgcaacatgtttaaagttttcctttgttttgggttgggggttgggaaatttaccattcagcgtccacttttacggaatcatgccactccgcctcccgttgcgttcggttccctgtccacatgtgttaaagaaaattgtcttaaagtgtgtttttcttcttgataattgcttccagctttcactttattgggcatggggcagagctgttttaagaagctctttgaaaatcaagtctggtgtagggactttagtttttgttttgtaatgagtaggacttaacagttcggatttggttgaatcattttctgcataattaattgatacaggcgtggaataacatactgtataattataaattactaaaggaaataatgaaagtctttggtggaagcacaattttatgtccatttattatgtatatacgttccacgggtgtgtgttttcacagtcgatttcacatgatatgattatagtatcttcatgtattataactgtaagattacagtgccaaagataccttgataattttaaatatttaaaccatcctgttacacttctaaagttaaattacgcactaaggaaagtattactaaatgtatacacgtgactgtgca

SEQ ID NO: 88585 - DNA, 1040 bp, Homo sapiens
aattaaagttccaggctgagaaattaatttcatatcctggtgatttccccaaatatccatcattatatggtaattctcttaaagcctggcaatataaaactacaagtcatcctaattccatgtattaaaatctgactgtttccttgctatcttttattgcttcgcatccttttctcttgcctatctaatattttactgctaaatgaaaggaaaggaactaatagataccttgcctttacatttcatggaaagatcaattaaaatgcctgtggaaaatttgttacaacccttagttaggtttggagacagatacagatctgttcctgtgtcctgtcttttaatgataatagaatatttgaaagaaatgtatctaaaagaaaaggggaactgccttagctcagcatagttccttggttccatgttttgtgcctgcagcatctcactggggaaagagatgccaaaaatgatgtgaagcctgtgggtgcttgtggtcaatcaaagaccagccagtattgccttaatgttttctgagatcttcaaaggaacttttttcaaattataacaggcaacattacttattcccttgactttcttgaaaagatgtgtttatatcctagctttacgttaaaggtctaagtcatcaaatattatagttggaagaaatattagacatcatttagtccagatcatgtgacaagcttggtgagttggagggaaattcagattttattttgcataatgaatttagaaaaaaaaactcaatagaagtcaggaaatagaatcgtaggtgtaataataataatgccgtcagtgtaaagcacagcgcttctccggagagactttgatctgaaaaggccaaaaagaacagtgagaagacctggagccagaggaagtctaaaatcactaaagtttttcaattaaatttcagttttaatttagttcatagccttagggttgtcaggttaggtagctgatgtcctaatatggacggctccaagggatgactgggagaaaatggcgaccacagtaaatgccgctag

SEQ ID NO: 88586 - DNA, 1038 bp, Homo sapiens
aacaatactggccccaaagtaggtagtaaggaaaccccttctgtaccagaaacacctgtgttcaggggatcttggcatatggcagtgactcagacccacgcccggatgtggatttgccataaagttacttgctttcttaaatttaattttattatttatttatttatttatttgagacagggtctcactctgtcacacaggctggagtgcaggtgctatcttgactcactgaagcctccaactcctaagctcaagcagtcttcccactttagcctcctgagtagctgagactacaggtgtgcaccaccatgcccagctaatttttgtatttttagtcgagatgggattttgccatgtcgcctaggctggtctcgaactcctgggctcaagcgacccatctgcctcagcctcccaaagtgccaggattacaagcacgagccaccatgcccagctgctacacgcctttgcgtcaatgttcttcacttgcagaaacccaatctaagcttctggtagaggctgtagaaatgtttataggataatatgtcctggtacatttgcaaatacaaaatagtcaaactgaaattggctaagattccattttctttccaattttcccttcctcaccctttccttcatttcagggggcattggagtagcaatgaatgttttagggatctgtagaaacattgacttggggaaatatttagttgccttttagtggaatacatgtggctaggagttccttctgtgaggcgctgaacaacagtcaggcaggcatataatggtgttgctgttatgaaggagaagagccaggggccctgtgcagggccagctttgcagtcatgttacctgtatgatttacacagttcccggcacttagaagggtcctgcgctagcttaactgtctgccatcactttatcagaattgttaatgctttttggacaaaaggctgcacatgttatgtaggcagttccggctgcaagcaccctttaaaacaataatcaaggtacagaaagtgtgccccattcagctcttcc

SEQ ID NO: 88587 - DNA, 1340 bp, Homo sapiens
gcagattaggctgtatttatgcattctccctcacagtgaaggaagaggaattgttctttctctcccttccacctcctctaataatgctcctcaatacgtattcccacgagatttacatggaaatattaaccatgagaaatcttgtgggctttttaaaagttctggctcaattataatcatgagagacaatgggaaggaaaatagagttgtttgggacattattcacttactgtctctgaattgtttgagccagacgtatataatcatcacatctctcaattgcctttattttaatccatataccttaaatcagatgaaacaagttttcttttaaaaaatccacattataatattctgcagtaaacacgccataatttttcaaagagttttatcaatgtgagttacaaaagtcacatgctgtttggagtttgcaatgggatatggtcagtagtcagattagtcaccatgatgtcctttctgtgatttttggtctacaagtaagtattgttcaaaaagatgtgaaaagcttaagagactccttacagagaaaatagattggggcaaaaagcatggagttagtcaaacagcaagaaggtttttagggttgaaatgaactagtcatatggaaatacgtctgagactagagacaaggttctaagactaggtctgtccctttcagccacatgcccaaaacagtcagggaggacaggagaagttccttgctaagaagaagattagaaggacacagtaatgctatcaaaattacctcgaaatggaggtaaacagcttaaatgaaaaaatagtagactattggtaacagaggtgggaggggtaatttccaccgacttgaaaagccaaatctctggaatttagatgagtctatatgaaagaagaaggttcaagtgagttaggtagaagcattctactaaaaccgagggcgacagacaaggaaggtgtgtgtatgttcacagaaagaacaaaactctctaagccagatgttcaaaacaaccaatccatttaaaaatggctatttttgctgggttgatttttcctctctggtaaattctgaattttgtttacagtattagcattttttcaaaagtttttcactgtgctttttgaatatttgaatgcttttttgtttacttttcagacagtttttaaaatgtattctccaccaattatgcatgctctgttcatttagcaatgccttcatgaatttatatttttcttgtcagattttacttagcgtttgcaactactggttgatgtattagtaacttttctgtatcctggagtgcttttactatttataaaagattaatttttaaaattttctt

SEQ ID NO: 88588 - DNA, 1048 bp, Homo sapiens
ctttgagggaggccaacatcaccatgggccagtggccttcagcctagtctgtgacactggggatataagtctggatctagatctgggcctagctttagatctgcctttgctctgtccttgctgcaggctctctttaccttgtcctgttctagtcctctaaattctatgatgcaaactcattctcacaagagaatcatgggccccaaatcttaccatctcaaacttacacatatcttttgagcacttttatgtattcagcttcaggcagatgctggcttttctcctgatgtgattgagaggattataatcacttcaaaggaccttcccttccctgaagatgctgtccgatttacctcatttgattcatgtcatgcaccactggcctaccatgtcttggtaagcaccacagcactattggcactgttctgtggttattagagttcttttactttaattgtttcactttatcttcaaaacaatcttacaaaggtataggtataatgagggaatagggtcacagaggctactcataaggttaataaccaagacttgaattctattctggttcctaaattaaggcactttttgttatatcatgtttgctaatgaacttgagatcttaatagtaggtccatcagctactaatcagagaggttcattgtataggctggggcaaatgtagaatggttcatatataatcacccaaacatacctttctcaatataccacatcatcattcttgtgttattaacacagtattttttgttagagattttagtgacattagttgaactgatagcctcagtcaactcagaatcacttagaatctgatgggctgctaaaccctttgacataagccataagcatttttaccatgccattgtatttcaacaactcaatcagatgagccattttaagctcacattttaaggaagctcttctgcaaaatattcacctggatttgaagctgtatggatagttagaaaagggagtaagtaaggtaagcacaagtgtagataatttatggtgatctgataccagtgtttgg

SEQ ID NO: 88589 - DNA, 1047 bp, Homo sapiens
aaagctattccttataataaacatggcagcaagtaaacagtgtgattgtgaaaaaaatattatttatagattttctacaaataaatatttgtctaccaagtaaaatattttgactgaaatgattctttgaaatgcatattgatttattatgtattgactttttaaaaattgaggtataattttcacaaaattctccaattttcagtgtcaaattcagtgaattttgaaaacatatatacagttgtctgtctgccacagtgatcatgatacagaacactttctttaccctgaaaacttctcatttttccttttgcagtcaatcccctgctcctatccttggcccctggcaaacactggtttgctttctatcattagttctgctgtttgagaatttcatataaatggaatcatgcaatgtgtaatctattgtgcctggcttctttcacgtagcattttgagaaaagcatttatactatttacagattgttgacaaatatttatccactaagtaaaatgttagactgaaatgattctttgacaagcttgccaatttactgattttgtcaaagaaaaatatgttatttttgaagtttgttcatcctttgagtgtgtgagtatagtatcagaggcttaattttgtatttatggagctattctaacttgttatttaaaaggaaaaaggtattaaacttgaagcaaacttctcatgatctcatttgaattctttccagcttcttttggtatttatagattttatatactttgtgggaacattttatcctcaccaagtttttggacttttatttttgcatcataaacacgggtactgaaagaaaaaagagagaatcttaattcaatgagtctattattcacgttgcaagagtactagttttagctttactccgaagttgtgaaacctctggaccttgttttaacaccagtttaattattgggctccttttaaacaaaggagtctgcaaattttaataacataccttgtagaacaaaaatgaaggaagatgaacatcaaactttgacttcattact

SEQ ID NO: 88590 - DNA, 1049 bp, Homo sapiens
ttagctgggagtggcgacgtgtgcctgtaatcccagctacttgggaggctgagataggagaattgcttgaactcgggaggtggaggttgcagtgagccgagattgcaccattgcactccagcctgggtgacagtgcgagactcttgtctcaaaaaaaaaaaaaaaattaaataaataaagttaatactcaggagatatatcagcagtattggaaaactgaaaagtcacctagtaggtgttaaagtcctcatttctcatctacaaatgaaaccagtaaaccaggactatggaagttcagatgatattgttcccagtctcaagggtacttattttaaatggctttctaactataaatagtaaagcctgtgatgaaatccttgaaattaatttgctgtcttttaagaacaaaatgaaatatttctctgtttctactcttaactgctaaaaggaagtggattccttcctcaataataatttttgtgttttttctcttttttaaacagaggttttaaaagactacatcaagccagatggggaatatttggagttgtttgctcgaaatttacagccaggttggactagttggggcaatgaagttctcaaatttcagcatgtggattattttattgctgtggagtctggaagctgactatgatcttgattaaagtagtggtttcttcattgtttcctcaccacttttcccttaattctaagtcatttttttattttgttaccaacccatattcttagaatataaacaggacttgtttttttcagtaagggaccagaagtgactagccttcatgtaattttaagatgaattttacttgagttgcactaacattctatgttattctagactatacaaattaagtggtaagcagttataaagacggcaagaccatgctattgaaaaagttcagaaaacatacaccgtggaccagaggtcttaatcctatctatggatgtgttttgtgtgacccatacagtgttgtaaaaaacacttagaaccattattctaaaaaatggggctatttcacattaaagtc

SEQ ID NO: 88591 - DNA, 1050 bp, Homo sapiens
ggagaatttgtgttcccattagattctccacacaaaaagccctacgaaggtcttatactggggagggttcaagaaaaaactgctctaccattgaggtaggaaaggtgatttttcaaaattgtatacatgtattaatttttacgcttttaaaaatgattagtaatcattgactttttaaaatgtttatgtttttgaaactctgaaaatggtccagtgtagaaaagaatggatggtatggcacaggaaactatattttgttttatctagtgtgtaattgtcattattatagaaaatgaaattataggaatgtctcaatacttaaattgttaatttctttcattgattgtaaaatttgtgttaaaatcagatacagaaagagaacaaaaatcaatgcagctgtggcttatgtatagaaaattgttttttaaaatatagtttactttcttgttctgtttaattaggaatgcagatgtaaacgtgctccccattccagaccacaaattaattgtcagcgtgccctgtactcttcactcacataagccaccgcttgctggtatgtttttataaaatagaattgttatcacttttgtcaaatttgaaaaaaagtgtacatttagtatttaaacggcctacagattcggaaattaagtcagacgtaggttgttaatgaatattctaaaactttatagcagaattcatagcagaatttgcctatctctatgaaatagagaatagattagttttatgttactcagcttttccagttataccatttttcagattccccttgctatcagttgcttcccatcactgggctgacacaaagaatgctgatgggcatctgaggatgcagttcagctagaccctttattttactaccggggctgtatcccttgcttgttctaaaaccaggaactcagaatagtagtcagagaaacagaagtcccttgatatttggttagtggctctcagttttacgtttttttaaaggtagtgttgcttttctggaacattgacaggtaattgctgcagcctgcaaattctcactag

SEQ ID NO: 88592 - DNA, 1387 bp, Homo sapiens
cagttggaaattgagaggtactcctactcctgagcctgtggtgactgccatcatgtgtcactgtcactcttaggctcgccccttcttccctctaattcatttctgacactatttctatctttagatagtgtcacatctcccaaattcattgtacagacatgaatgattacatcattggtcactggtgatcaactcagccttcatccctgcactcagtaaggctacaggggcggtgagccaggaactgtggatgaaaaccaatgtacatcataatctcactcatggagttagaaatttgaatctaaatgctgtgattattaattgtgccattaagcactcatttatttcttattctgtcccctcttaagttctccactgcactggatttagaaagcaatatctagaactctaatccatcttttgaaaaaaggttagttctgagaaacctagttatccaaggggtactgctcagaaccaattacagatctagactcttaaccttgcggttttgctagggtttagtgcttctgatgtgctggtaaaattgcattttctctgactagaacaattttttctttttaccttattactccattggtagtagtgattaagtagggaagatgatactggagaatgggctgacttactatgacaagtgtagtttgcaaaaacgagggattacctgctaacagcaccttctgaaattctatgcccctctctagataggtttatctcattaaaaagggtgaattcacgtagctaatgtagtgttctttgcttttacaggctactttgtccttttaaggattcaatgacttcctgacttggaggatgtggacctagtggctagacccaaggaccaaagcaagaagtcgtggggggcccaggaagacaggaggatcacattgggattccagacataagatcaggttttaaccccctttggccaaattttggctgaaaatgttgaattatcaactctgaaattaaaaagaaagtttatattaaaacattgcaattttccttagaatttctgtatatattaacatcatgaatgataaattctcttcaatgtgcatgtcaggtttttgtacttgtatatcaaatctatctgtgtgtatgaagtgtatgtttattgaaatacaagatatttaagaagctgatctggaaagttggattttcattctagttcctaattcccagaggcttttttaaaggaagggaatgtctgtggtacaccagttgtcagctgggtggttactggatcatctttcttttatcaacaagataaactatcaacttcaccagcatcatgaaccttgttgccgtaaaaaggagttcactacttctgttcactttgagtctcttcaaatggattctgtgtcct

SEQ ID NO: 88593 - DNA, 1869 bp, Homo sapiens
cagttgggcaaaattaatctaacacaaagcgtattttataataaagtattgaatagctcttgtaatttattgaatactatactaacagtgaaaaacaaaaaggttgtatggatacttgaaggatggtttctactccattgcttttgcaccatcagaaagctgaaaaatctgaagtcaaaccatcgttaagtcagggattgtctgtatattcttctgtagagttgtttttttgcttcctgaaaacattataaatttgttttttttaatattaatggatctgtttgaatcacattataatttcttaaaaataactaggcacaaaaatttgaaaattttaactaagtaaaaaatggaaggggattggaattaaatcataacatgttatatgttatagacgtaatgtttcttttcctcctttatgtcgtggaatgaagatatcagtattggcaacattattttaatgtaattctttgtcaacacaaaacataataggttaagtcttaagatattgcacgtggataggttgtttattttgttttgacctttttcattagacatattgccccttagcccagagtcgccacttccaaaagtggttgagataaaggaaacattaagattatacattaatacttcctagcatacataaaaaactagtcatcacatgggccacttagaagaaaaactattctctgttctaattctaaccttcattctttgaaacttttgtcacaaaagaaaagtggaaataatttcagtcccatcttttatgactgcctgggatgtagttcaaagatacatcaactgactagtgttggcatcattgcctttttctttttaacaaaaaataaacatgcgcctttactacttcaacaatgatcccagttggaaaggctcctagaaaacctttgatcccacccttgagaaaattatcctcccacattgcaatatgtatattgggctgcctctaattacccctcagttttcacccaagtacattacaacatctattaagtattaaatgtcttgccagacacagtggctcacacctgtaattctagcactttgggaggccgaggtgggcagattgcttgagctccagagttcaagaccagcctaagcaacatggcgaaaccccatctctgcaaaaagtacaaaaattagctgggtgtggtggtgcgtgcctgtggtcccagctacttgggaggctgaggctgcaggatcacttgagcccaggaggtcaaggctacagtgggccaagatcatgtcactgtactgcagcctgagtgacaaagtgagaccctgtctcaaaaaaaaaagtgttaaatgtcttgacatccatcctaaaggttaaaaaattattcttgctctctgagctattatagctattatttcaaatgacaatatatagagaagcacatgggaaactataaagtactctttgtaattaaagaaagttgtcagagtatctggcttcacaagtttccgatactcagctttgtgagtccacaaactcgatatttttaaacctataagatcaaaattgaccaagcttaaggaaactgattcagtcttaaccaaattcacagcaactgatctgaaggagaatgaaaatgtattaatttaccatcagtgatacacctttccagttacaggaatactcagactgcctattcagggtactcacttcaaggtcaccttaataagcaatgaattagcacaaagggaattggtttgtcttgagggatatttacttcatctaaggtatggaaaattctgatcatccattcttgccttctcataaagtctacattctcagtgaccaaaacatctcatgaatgcaaaatatagtgttattttctcttggat

SEQ ID NO: 88594 - DNA, 1022 bp, Homo sapiens
actttttgccacaaattttgaaagagaccttaggtcttttgactaattggtgctttaatttctcaaatagtaagcaaggacaacgtagggatattatcccccaagaggaatagcatttgctaattattgtctatgcttctggtagcatgtttggtatattatgactttattatactgtcatctactgctgctacactttgtcaggaggtcaagtattttattaaggcgccacagacagtaagatgttatggctcaggtctggctccaacactagtattctttttgtttaacttctctccaccaaagaaaccacaaagataaaaatcagtaggcatccagatacatttaaagtaagtagctcatatgaacactggatatggtaaataaattaccactccatgagcagagtgaaatgaccaaaagcaagcaccctaagaacgagaacacttactcagttttgactgcagctctgcattcatctcatcaaagctgtcggcaccactcataaaactctcatagcattttatggtgtagtccaaaaacaactatggggttaagcagattttagaaacaaagttatgattctctatttggtctgtttcacttttctaggtggaaatttatatttgaatttaaaaaatagtcagaaatactaagtagtcagatgaacctataaataagagacaaaaacctaggctatataattatgctatatggacttatttagtctgctacttctaaatatgaataatgaggataaaataacacttaaatttggataaaggcaatatttaaaaacagccataccttcagaattttgagaaggtcaaacaaacagggaagcttattaataaatgtaattcaacataaaatgcacaaacttaatcatctttaggaataaagcacctgatgaaaaatttaaataaactgctgatcatctaagtccaattgaattgataaggtctaattgtaaaaacccaaatgtaattaatgaaggctacaattacattgtaacttcaggc

SEQ ID NO: 88595 - DNA, 1972 bp, Homo sapiens
caacaatggaatcaatcactttgccagtattatcacaaaagctgaaagcattcccttatagtcccctgggattgtatcttcctgaagagtaaccaggacaatttcagcttgttcacatgggaaagggagcaaaataaatggctttgttttaagagaggaaaatttagagtgatctaagcatctaatgagtaatttgatatttctgtatataattaaccaagcataaaaactgcattcatttattcaaataaatattttttgtatacctactatgtgccagccaccatttaggcactgaggatacagtaatgaataggataaaaacctctgcccttatgagcttacattttagtagacagaaagaggaaaataatgaaatgagcaactttaagtcaaatggtgataagcgctttggagaaaaatcaagcaggacaaggagagtcgaagtacggtggagtaatggaaagggtttgctgttttacaaggatgggatgtacttcactaatagtgttttgggcagagaccagaaggaagtgagggagggagtaatggtgaaaacttgggaaagaatgttctaggcggatttgaggtcttaaaaagcttttggattttgtctccagaggatttatttaatgtggatgcttttaagctggaatcattagaagcaaaaaacagagcattgaatgaacagattgcaagattggaacaagaaagagaaaaagaaccggttagtaaacatgtttacacacttacttgagagctcttttagacttttgggtgtccttggatattagctgtctttatcaaaattttaaaaaatagattaacaaattaagcttcttaaaagttaaattttcacctagaaactcccaatgaaaacatgtttggtatctgtggagccttgttttcccttgcggtctatcagtcttagactaatggtgctctggatatgatgaaagattcttacctacttacataagatcaaaagtacttttgaacaaaggccctgtgttatatacctctagggagcattagtcacaagaagccctgagttttggaggtagtgcaaaaggaatggttaataaatgggtttatatagtatattgtatcctgagttttctaaaagctaaatattaatatccagttatctaactttattttctgcattattagtgaagcactcaaactgttgttgtaaaataccagattttaaatatttgtgctttttcaaccctagcaattgtggtttttttttttttctatttcaaactgacagtgtagtccccttttagttcttttgacttcctctaaaaatgaaaggaaaactcaaatctacctttctctaaaataaatttaaataatattgctttactttaaaataaaatatggaatggttattaagaataactaaagttatattcttttctcttaaagaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtaggtaagcagagctaatgctaaaagactgggatgcgaacctgtgtgggatttgtcacatgtaaaaacagctttgttatccatatcttttgttgttctgtggtacatgcttagagcaggctaccaagttttcagtgtgtttcgtatttgtttcctaaggctgctgtcacaaatgatcacaagtttggatggcttaaaacaacagaaatgtattatcgcacagttctagaggctgttccagcagatctgcatccctccaaggactcagggaggatctattccttgcctcttgcagcttttagtggctggcagcattactgggctatgttcacatcactccgatctctgcctccatcttcacattgccttctcctctgtgtttgtactctactacctg

SEQ ID NO: 88596 - DNA, 1071 bp, Homo sapiens
ggactcttattccaagctgtcagataaatggaagatagtagtacattacacaccaattgatagtcttaattattctgtaaatttaagtgttactaaaaccttatcttctttgtatattttaaaactgctactcttactgctaaagattactgaattagtaaactactaaaaataggtgtgatatgttttgtataaaattttagaaatgtcaattgaaaaaaacatatggaatggggctgctttaacatgtcttatgtgttctgttcttacagattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtaagtaatcatgactacttttaagatttttttaattctgtgattggtatctctaagagtttgaactttggcttgttcataacccagtactaaacaaaggaataaaacactgaaactgtatcttctttcttctcggtcatagaaatcttctactatccagtaaaaaaaattgattacatataaaatagatgccagtactataaagacaaagagggcctaacccttactgtcaagttgctaatgatccccccagaggagaaagacataaataaatgctatatatgtgcttaattagaagtctttacaagttatagtgaaaagatcagttcttcccatgtagcaaaaaagactctggagatggtaaccgtggaatgaaatcttgaaagatgagacatatatgggaagggtctgtagaaagaattccaggcacaagggcacacatgaaggcataaaatgtattagagtactaagaatactggtaatcaacaaggagaaattggtgcctaattttaaaatatggccaaggaagtaattttgggaagaaaatttttaaatagctctattgtaacttgtcagttatttatagattttagtatttgagttgcccctaaaaatgccaattttcaaaatacttcagttttgaata

SEQ ID NO: 88597 - DNA, 1134 bp, Homo sapiens
tgaagtgctgtgttaaagtcagtagaacagaataaacataagaaatacaggcagagaatcctaagactaaacagttgaaaaggattaagagaaattgatacttctggataacatagcataaaaatacaacctacatatgaattgttttcaaaaaaaatactgcagtaaactaagtgtacttgtaaaatgtttaaataatagcaatgaatttccaggatagatgagcaaatcttgaattttgcaagtattcaaaaccaaaagcaggttatagtctacacttacagaaatttgattaaaaactagttttgtttctgtttgacagtatattagatttaaaatgttataacttcagtttttctccaaaagtgactcctcctatcacagtgtgtagatgcttcaggagggatattttgtaattaaatgttatatgtcacccacattcctatgtattttataggtacctcttaaggaactcctgaatgaaactgaagaagaaattaataaagccctaaataaaaaaatgggtttggaggatactttagaacaagtaagtaataaaacataaaaagtcataaaaagtgaaaattagattttaaaacctaaaattaaaagttatttatggtttctgattgctaaggaattaattttttaacaaaactatgaaaaaatgagaattgggtatgctctcgacagaaatatttgaagtaacttattaagacatttaaacatcctagccttcacacatcacatatgatgaagcgagatgaaactaagtaaattttcctttttttaatagagaagtgtctctaacttgagataatttaatatttttatactaaaagaggcttcaagtggctaccttgaaagtaggcaagtataattacggcgttagaagctaattagctgtgatagattaagaggtttctttttaccaagtttttggattctggatcatggaatttcaggagaactcaaattcctttcaaagtctatttccaaaagtgaatttcaggtagtctctgcttctgagatccttaatatcacctatatccctgaaaaggaaaattctattattgtatttagtaacctttaaagtaaacattgttagttaagaaaagttaagctacttctcaa

SEQ ID NO: 88598 - DNA, 1050 bp, Homo sapiens
agattaaatgtggttaccttattactttttgaaggaatgcatgactataatagcaaacatccaataaaattaatacaaacaattcttttttaacattttagaaaatgaacatacaaatgaaaagctaaatagctgtagtagatatagtctaaataaagctagatttcaaatccagaggcaaaaattatttatatatgaataaattgatataacaatattaataatatataatatatatgagagcttaaaaagcactcccacaacaactagtggaaaaacagatattaacatcgttaactttgaggtttctttgaaattaatttctctttggagaataataaagtttttggacaaatgataagtgagagtccaaaaggactagaagaaataacattgttcagttagttgattgataatataaaaactctataacttgttaaaatatctttgatgtatagttatgatttctcaaccaaagttttatttccccagttgaatgcaatgataacagaaagcaagagaagtgtgagaactctgaaagaagaagttcaaaagctggatgatctttaccaacaaaaaattaaggtaagaactttgccacagtttgcgtaggttatcaaaagctatgtcatgattgcttgatgagtcacatattctgacatcaaaatcaaaatctttaagctatatatatcctataatttgtatcttgggttagttttctctgccaaagtttatcgtaaggagtcattttattttgttctttaaaggacatttttctggattagggctgttttaccatagaaaaggaacatttacttttcctttatctggtattttatacttgcatatgactcagtatccttgcaaaactaaacagaatctctcctacctttttgtagagatttattgttatgtactgctaaagcctgaaccccaataaggtcttttgaatatgtagttgcccaccaagagtcattgtaaactgactatcctggtcaaattccaaagactgtttacgtgcaatctagaaggtgggtaaaataaaaagac

SEQ ID NO: 88599 - DNA, 1021 bp, Homo sapiens
agaagatacaattcagaaagggcacaaaaagagagcctatgtggtgaatacaaatatattctttttactttttttttggagatagcatcttgctctgtgacacaggctggagtgcagtggtccaatcttggctcactgcaacctccacttcccagcctcaggtgatctcctgcctcagcctcttgcatagttggaattacaggcacacaccaccacacctggctaatttttgtatttttagtagagagggggttttgccatgttggtcaggctggtctcaaactcctgacctcaagtgatccacccacctcagcctcataaagtgctgggattgcaggagtgagccaccatgcccggccctttttattcttaacttaaaaatgttatcctcttgtttgtaaattttacaattaaacattttaaaagaaattaattttttttactttaacaattgttaattctcttcactagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgtatttttctctctcatttcttactaatttcaaatggtgagaaggcaaggtagtatgatttaaaccagaagtcggcaaaatacaggttgaggatcccttacccaaaatgcttgggaccagaattgttttggaattgggtttttgggggttgggttttttgttttttgtgtgtttgtttgtttgtttgtttttcagattttggaaatcttgtgatatcttgaggacaggactcatgtctaaacatgagatttatttatacaccttatacacataggctgaaggttacttcatacaatatttttaataattttgtgcatgaaacaattttgactgaaatccttcatgaggtcaaat

SEQ ID NO: 88600 - DNA, 1017 bp, Homo sapiens
gggccccgggcgcgcgcgcggcgaagccccgcccctgcccgcgcggcctgctggattcgccccgcccctcgctgtcgcccgccgcccgccacccgccaccgctcttcctcctgcgccacagtcccggcggcggcgctggtcgcgggtcgcaccgtgaggctcgcgtgggcggcgataggcgctgggcccgggcccggtgaggagcgcgccgcgcgtccccttctcctcaggagtggcgggccgcggaagtgacgtggtgcacgggcaggagcgcgtttgaatcggttcccgggtgatcctcgcgcctgccgctgctcggccgccgccgctgacgaggagctgcagcgcgccgggccgaggcctcgagccgccccgggagctggagctgaaggcgccgcgcggagcgcgcacctcagccctgagcccggcggcggcaggcgtcgctgtcttttctccttttccccaatatggcagcggcggacggcggcgggcctggtggggcctctgtggggactgaggaggatggcggaggcgtcggccacaggacggtgtacttgtttgatcggcgcgaaaaggagtccgagctcggggaccggcctctgcaggtcggggagcgctcggactacgcgggatttcgcgcgtgtgtgtgtcaggtacgcgaaggggcgaggaagggatgcgcgtgtagacttgggggcgggagggtgatgagaaactcaacttgctcactgagggcaataaacctgtcacccggtcccggtcctgcggccttggcttccctctcccgtgtgcccgccatgtccgtgacctggtggccggacgcctcgggcgggccctggcccgggcctcgaagtgcagggccggctcccccgtggccctccctctgcctccgctccttttacgggaggccttgccggcccgggtggagagctcagcgtttgttggccctgggcgagcttagcccggttgcggccctgcagtctagggaaagccgttggtggtgtctgtttttacttt

SEQ ID NO: 88601 - DNA, 1692 bp, Homo sapiens
ctggctgcatgtgcatagtctgcacagaggttatatttttcaagcttgattatagaaaaatagttgatatcagttatggctacagaagatgattctgcctagcacaaatcttctgaagctaattttgctaaccaacttggattattccattatctttttttaacctaattagttttccaagacctgctggtttttcatgcctgattccatctgaatttaaccattctccattcatgttgacactacgctattttagattctcgtctgatttcctgtgatagtttaacttattaagaattgagtgtttcaaatgaatggaaggaagtatttgtgcttgtttcattaatatccttaacatgactttgcttacaggtagatgattgggggtttttctttaccatcattaaagatatttcatagatagaatttgtatattcacaattataagttcattgagtttctgatgctgacctagcacttatgattttcactcttgattacagatgaaactgttaaagatggagtcaccttatacctgctacagtcggtcaatcagttactactgacagctacgaaagaacgaattgacttcttacctcactatgacacactggttaaaagtggcatgtatgaatattatgccagtgaaggacaaaatcctttgcgtaagtatcccattcatactaattttgataaattattacctgcctttatcccctgattacgtatcccattccttcactttttgtaaatcttcttattacactttattagaagaccactcattttctttcttactcaaattcatcacggtattattatgtcttctacctgtgtcatcttcagtgaaaaaaaactctcctttaaagctaacctactagtagaacttttcttttcaactcataaggggtcttgacctatacagctttccatcgcctgtatactctcttctcctgatttcctagcctcccatagacctttcccaattaagaaaatacttgttttactttgcaaatacatatagctaggttgcgtaagtaagaagtttgtgttcatatttccatgtctttatcatttctttctacctttactacttgctagtttctgtcctttctctggaccatttgctagtgatctttacaaatcaattagtttactgaatcctctctttcaggacttgccaaagtgtctaatactacttacatgttcatcgtaaacttttgtattaaaattatttttttctcattatatgtgtatttgcaggaaattagaaaacatagataagcaaatagaacataaagaatatctctactacccagacataaccaccactaacactttggtgtttatcatttcagaccttttcatattatttgatttttaatggttttatatggtgcatacttctttaacctacattttgtttaaaaataaagtgaacatcttttaatatatatgtctctgtatattttgataatatttaggtaatataatttatttgaacagtattctttttctttttttgttttttgagacagagtctctctctgtcaccctggctggagtgcagtggtgtgatcttggctcactgcaacctctgcctcctaagttcaagtgattctcctgcctctgcctcccgagtagttgggattacaggcaggcaccaccacgcctggctaatttttgtatttt

SEQ ID NO: 88602 - DNA, 1051 bp, Homo sapiens
atgtatacatgtatatgtacctttggttttttgtaatcttctactttcccttaacagtacattgttaacatgtgtcatatcatgaatgttctgcaatataatctgttgttgcagtgacttattggctataatataaattgtgtagtttgtgttctgttgttgaacatttagattttttttctgtatttttgccactggaaggaatgctggaatgatgaacattcttgcacaccttggtacatgtctctgaatatttccttaagttgaattgtgagaaatggaatttctaggctaaaggacatgaagaattctgaggcttttgatacatactgctgctgaagtgcctttcagaaaattgtattaatttgcacttccatcagtaatgtataagtgagcctgttgaatcatttttttcatgtttaacttttcatgttttaagtattgatttgacttttcctgtctttttgaacttattttgtttcatagctttttgatgaaacacaaggaaaacctgctgttgcagtgatagataatggaagaggaatgacctctaaacagcttaacaactgggccgtgtataggttgtcaaaattcacaaggcaaggtgactttgaaaggttagaaaaccttacttttttttttttgtgggtagctatgtattttagtaaggataaaaaactggtatgcctttggatgcatatgatacattggaggttttactgttattcacatatttatttaggttttatattatagaatttttatgattgatactcagaaatagaactatgtaatattgtgcctttccattaaacagctcattttgcatttcctgaggtatgtaggagttgatatgttgggtacctgagagcttttcccctttcctaactctgtatagcctctgtagcagtagaatcattttaaaatgggctttagaaatcgcttcataccatttgcaaaatgtctaaaattgcatgtggttctgtggagctcactgttgctctactttcagagctctttttgcaaaacattcaggagtggaatctagtgg

SEQ ID NO: 88603 - DNA, 1056 bp, Homo sapiens
tacgatgttgtcccacttcctacctctagcaagaaacctcgaattaaatgtactcatgacttttctgtccttcagctctgatttgctgtttctttgcttactttatattttttagtagtatgttccttattgagatgctacttaaagctgtttaactcatatgtaaatatatgtatttcattaagccagattgttacttgtacaaataaacataatttttacttattctgttgttgaatcatagctgagaacaaaagtaaagttaccatagaatttaattatttttgtttcctttttattttagatttctatgtttgaaaaagggaaggtacctaagattgtcaacctaagggaaatacaagacgacatgcagacgttgtatgtaaacacagcagctgatagttttgaattcaaagctcatgttgaaggagatggtgtagtggaagggattatccgttatcatccattcttatatgatagagaaacttaccctgatgatccatgctttccatcaagtatgttaatctgttatcttagttataaaatatgaagttgtaatttaggacagtgatttgtttttctaaatgattatcggttgggttattcaggttagataaatattaaattttttcttatgcaagtcttagattgttaggtatttgtaatttttgtaattcctgatttttgtgtacattcatttctagatgaataaatctttaatgaactcttcttttagttctgttacgaaaccaaacttttagatatgtatgcgtattaatcctttatatgttcccttgtcttctctttatccttgttgcagttttacactttatgcagtcatatttactaactttttctttatgctttctgattttgtcttactgtagaaaggctttttacatctcaaaattatataaatctgtagcttttttgtttttgttgtcattttatggtcaatgcatctgtgtttttcttttttgtatgtagagcaaggtggggttttatttatttatttaaatttttgagtgatggggtcttgccgtgttgcccaggctg

SEQ ID NO: 88604 - DNA, 1051 bp, Homo sapiens
gtacatttttcatgcttacttgaatctgaaaataatttctaaaaagtaaacttaattttagcatcattcactaatttgttcaaactaggtaaactcgctgctattagatgtcatagatttctcagatgactttcatgtgaacatactagttctgataaaattgtgaaactgttttagatacgggatttaagctcctatatttgtaggaaggagggattttgttataggggataatctttttggatgtaagactcttttagcctcatgaataggttttaaagatgacaggcccagcagctagtacattggttcatatataagtaattattgacttctaaatgacagacagcattcgtaatgtggaaccactttgtaaacctacctttttgtgggcaaacagtataaaactacctttaggttttatagaatgcaatttgaaacatttatgtgtttgtttcattatttctcacattttagcaataaacattttgttccatttgcccttttgatctagaattaaaagatgaagatgatgaagatgattgtttcatacttgagaaagcagctagagggaaaaggcctatttttgaatgtttttggaatggacgattaataccatatacatcagttgaagagtaagtttgatttttgctgaaattatgtttttacaacttaattcttttactaactaacattttgttctgttcaagctttgactggtgtactcctcctaagaagagagggcttgcaccaattgaatgctacaataggatatctggtgcattattcactaatgacaaattccaggtcagcacaaataaattgacgtttatggatcttgagctaaaattgaaagataagaacaccctttttacaaggattttaaatggacaggtatgatttttaaatataaagttgtgaatatttgcaaatgttttatttttaagtaaaagaagacactagcagtgtaggtttttattgatattttgcatcaaaagactatgatgtataaatttttttatgagcagtcaagtgttcacattactaaaaa

SEQ ID NO: 88605 - DNA, 1085 bp, Homo sapiens
actgcaacctctgcctcccaggttcaagctattctcccgcctcagcctcccaaataactgggactacaggtgcgtgccaccacgcctggctaatttttgtatttttagtagagatggggtttcaccatgttggcctggctggtctcgaactcctgacctcaggtgatcgacttgccttggtctcccaaaatgttgggattacaggcatgagccatcgcacccagccaagatcttaatatctagcccttgacatagtagaagccacagaagcatcttaatgagaacatgtatgaacaattgtatttgctttaagggctatatttgtatattaataacctagttgtgcaatttttagctagtcttgagggtaaaaatggggtaaaactgtgaagtactttgagctaaaaggtgatttgagattgatcagtattaaaatacatgtattgattaatacaacaagaatgatttcactttgaaatttgttacaaagttgagtgaaactagtatactagtgtacttgtattctgtgaacagacctcagagacttttgatactactctttcagtagtttaatgttgaattgccaagaaatagatgattttattatcaatttattgctgggcaataaatacagtgcatagtacatagtatttgtagtcagtcagtcctgtaagatgttgaaattaattttgctcttataaagcttgtgaatcatagaagattaggacacttttaagaattatacaccgagaaagaccttatcaaaatgagttactactcctttataatacacttagaattcatttataatatggtgttagttatccaacatttattgagcagtgggtgttttcaaaagctatccagaataagttaattctattcctttgttacactgtacttttaaaatatatattttctaattttgaaacattcaagctgcgcataatggttcacacctgtaatcttggctacttgagaggctgaggcaggaggatggcttgaggccaggagttcaagaccagcgtgtgcaatacagtgagacaccttctgtatttaaaaaaaaaaaaaaaagaaggaaatgt

SEQ ID NO: 88606 - DNA, 1057 bp, Homo sapiens
tcacaggcctgtttgacatcagtgtcttccatcatctctaaggaaatttaacttatttttagattcaatttttagtagaagttgagactaaattagatgtattaaaatttaacaacagtaacaacaaataatgcaaatattggctcctcaggagctaggtaagaatgaaaaggacaaactgattttaaattccataatttattatagcattaaaaaaactattgccagaggctcaattaacaaggtttttatggtttcctaaactaaactttactcacatggagatctcagtgttttttgtttgtttgtttgtttttaatgtaatgcgttaagtaatgatttttaagtatttttttgttgagcatctgctgacatagtaagttactgcaccttttgactgtgtggtggagaattcagagatataggagatgtgctttgctcttggtgatattatatcctagcaatggggatagtgtaagcataaataataggtaagaagtggatcaatgcaatggaaagaaaggattaatagtgttttggcaggttagaaggagagaagaggagaggattttttttttttttttttactttggttggtcgtgtgggctggaagaacagagcagatcgttaaatactttggaaaagaagtaacatttgtgtggaccttgaaaggggtagaggctcaggtttacacagataattacaaggtagaaggctctctgttctctccataaatgagagataccatcatatatttaaagctatagaattggatgagatcatctatacttggtgagtatagctaaagaggtaaaaggattgagcctggagctttcccaacatttagtggttagaatgaaaaggaggagctggcagaggagactgacagggataagctggtgagacagaaggaaactagcagaatgtgacatccctagagccaagtgaagagttacaagaagaaaggagtgatcagtttagtcaaatgcttagtggtaatggagtaaagtgctttctagaaggtaatctgagcatagagatgtgcgtaggttaagtg

SEQ ID NO: 88607 - DNA, 2385 bp, Homo sapiens
cgatcatgatggagaagtatatgctacaggaggagaggttcaaattgcaatggtaagacagcaagtgataaaacatactgaaagtttcttgataacacttttgcataattgttaagatacagtatatttcgctagtgactagttttccattggataaagtggttgtagtttttgtgtggatttttatgtgtcataagttgatgtttttaataatctatacaatttaacatcatatgctcagtttttgtaaacatatatacattataactagttaccaaattaattttataaagtcatatttcctctagggcccactaactagtaaacattggagccagaattctatctcagcaatgagtaactacaaaactggagtgggttttttccctataccatgctttcttgttaatgtttgatatgttaggactacagaggttatataaaaaatataaacaaacattgtggtgtaacgtaagaatagctactgttatttatgtacttaattaggataaaatatatttctttggaagaaacaaatgggtgtttgtttttattacagctagatttaaatagttttctttgaaatgttggtaaatgtatttattcaggaacctcaggcactatatgatgaagtaagaactgtgccaattgcaaagctggataggacagttgctgagaaagctgttaaaaaatatgtagaagatgaaatggcaaggtaagtcacacttcaagatgcatgacaaaaataagaaaaattggaaagaattgtgctgtaagtattctgagtatgtcatttactctgctgttagggcatttgtagtcttagatattgtacctattgagatgaacttcttgttgaaaaaaattaagaggtctagttatacaaacagaattctgcatttgttttgtagacaaagaaggaaatcttatatatctaaagtgtcacttttataggcactatgattaacatgttttaaaaaaactcagtttggcctacaactaggatattacaatacctgctgagaggtaaagatgagtgtattagttcgttttcacactgctataaagatactacctgagactgggtaatttataaagcaaggaggtttaattgactcagtcgtgcatggctggggaggcctcaggaaacttataatcatggcataaggcgaaggggaagcaagccatgtcttacatgggcggcagaagagagagagagggaagggggaactgtcaaacactttaaaaatcatcagctctcgtgagaactcactatcaagagaacagcatgggggaaaccattcctgtgatccaatcaccgcccaccaggtccctcccttgacacctggggattagaattcgagatgagattcggatggggacacagagccaaaccttatcagtgagttataaagaagaagaaggaagtagaaagtggcttttcttcttgtatagctaatgatgcaatcattttgattcttactgaattttgattcttaggggttatcctgtcttctaaaggtaatttgtactataaacaagtagaaaaaaaaaatcaacaaaaatttgacagtttctggcttttaattccaaaaggtttttttttttcttcttcttttttttcagtagccacaggaatggttagggaggaaaaaaatttttagatgattaatcgtaaagaattccagatttaaccttttaaaatatatcagcaataaatatttaagtttctaataactcgtatctttttaattaagatcataattaacaaagtttgtggaacattaatatgctggtttcataacaggctccctgatagattgtcagtaacttggcctgaaggagatgaattattgcctaatgaggttaggcctgctggaacccctattggtatgtttgtttatttttctaataccaaaaagtgtgcttttcttttgtcttacatttccaatatgtaaaaggtcacgagatattaaaatgcaatgggaagatttggcagattcagcaaatttttgggtgtaattaagatacttttaatttttgactcataggtgcgttaagaattgaaatactgaataaaaaaggggaagcaatgcaaaagcttccaggaacaagccatggagggtcaaagaaactcctggttgagctcaaagttattttacattgtaagtatacaaactaatttagatctttaatattgtttttaaaatataatatcaaattaaatatcttcatgtaattattgatgacctagcaatctgataggcatagcaaattttattgaagttaggaatttcaggaatgttatgaatagctcattttcttggtggatatttttctaaggtttttaaaaaatacttcatcttgaattttttcatgtgggta

SEQ ID NO: 88608 - DNA, 1040 bp, Homo sapiens
tgaatcagattcagtctctgcttgctttgttgtttgagtatttgatgttcttgggtctttctgctaagtcagttacacttactcatatgttctttggctttccaattctattactctcatcttttttcttgtttactgcttttgtagagtcattgttacagggtttttggagagaactgatctaggtagctgtgatatcaagaaggcccaccttggagtgtggttttctttttttttaaatgttttaggagacttttttatacataaatctactgtgttcttttaacacctgtggaacatattttcataagatgggcgtgctgtagtttaagcagtttcctgttgatgaatcgtgttgattgtttccaagtttttggctattagaaaccgtagtgctttttggggaaaaaaaaattatgctgctttctgtacgtatgttagaatctctttagggtgataccaagaagtggacatcccaaaaggctatgccatggtaccttcacttctcactatgagagttccaattgactgcatgctcattcctggctgaactatatattcatttagcatagttggtggtgaaactgcttctctaatttttagattgtgtacctcttctagccattattggacattgtatgccaatgcttgttcatttactatgcccattttaatagtttaaagctgtggttctcaaatttgagtttgtatcagaatcacctgaaaggaaacacagcttgctgaatttcaccctgagtttctgattcagcaggtttgagataggccctagaatttgcatttctaataagttctcaggggatgctaaaacttcaggactagagaccacactttgagaacagccaatttataggagggcttcatgtagtctgaattttccttgttacacatgttgcaaatattttctcatgtcgagcttctatttaacttcatcatatatatcattttataactattgaatatcgtgttttgcctttaaagctctttcctatgaaaaggtataatggctgggcatggtggct

SEQ ID NO: 88609 - DNA, 1128 bp, Homo sapiens
aactgtgcccagtttcataaatttgtgaataaaagtttactcacctctcctctcttgactccatgcctctcatttcatatatatgaatagaaagacaaaaatgtctttcaggattgggaatgggctgctctgcctatggagtagccattctttattcctttactttagggaaaaaaaaaaaaagggaatgatgactaaatgaaggtaggtaaaagaccgcagaaagaaaaagaaaatccagttaagtaaaaaagaaaaggattgtaattgaggaagttagttctttccttccaaaacagataaattttacatagtatagtagaaaattactgtttttgttcagtattctagagttttagtgacttttacttagaattttcttattcattgccagaaatagtagctctactgaattatttgaaactttgaacaattacggaagaatcaaatatatttaataggggtcttacattatttttcatctttcaaatagttttcaggtgctccaaaccttccagtctatgttgtagattgcagtagttctggaaccagtattttaacaggatctgcaattcaagttcagaatattaaaaaagaccagacgcttaaagcaagaattgaaatacctgtaagttattattgttactcattgatattatattgagtcttcatacaaatagtcttcaactgcttaataacattttttgcaaaattgttaacttctgaaaatgaggtatttgtggttctttcagccaaagcaaagcaaagacaatatgaaatgctgtaatgactattttaacattttgtgtcaaatattagtaattgtcttgatttttacagtgtcttttatagtgtctataactattattgatttacatttccctaaaatatttttcttctattaaaatacataattttattctttcgcttttttttttttttaaagagatagggtctcactctgttgtctaggctggagtgcagtggcacaatcatgacttgctgcagcctccaactcctaagctctagtgatgtgctcacctcagcctcccaagtaactgggactatagacaaggaccaatgcacctggttatttatttattatttattttttgaaaaagagggtct

SEQ ID NO: 88610 - DNA, 1070 bp, Homo sapiens
actttggaagaccgaggccagtggatcacctgaggtcaggagtttgagaccagcctggccaacgtggtgaaacccatctctgctgaaaatacaaaaattatccatgcatggtggtaggcgcctgtaatcccagctactctggaggctgaggcaggagagtagtttgaacccagaaggcagaggttgcagtgagccaagatcatgccactgccctccagcctaggaggcaaagtgagactctgtctcaaaaaaaataaaaaggaggggaatccttttagtccacatacaattgtttttattttaagaatgtggccactgccatttataacctgatggtataaaatacggaattattaatagtataatgccatcttaatgacaaaacctgtgagtataacaatgtatgagatggtcttccataatattgaaagtaaattcttcaggagtgtaaaatttcagtacagatatcactcagtgtttgtgttttcttctctttctagagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagtaagtatctctaacagattggttatttgtaagaactttttaaattttatgtttgtaagactgaacaagccgttttatgggtagcatctaaaaaagaagcttgtcacagaaaagttatactatcatttcaaattgtaagcagaataagcttttttcatggaataggttgaaatgcaaatgattcatatgtgacaaaattatacttagaaaaatgattttgacacttaaaaatctaggttttggcattttgtttagttgtgctcttcctgactagctgtttttctgcaatcataatcaacatcaccaccttgataaagctagcaataaattggtagcagttct

SEQ ID NO: 88611 - DNA, 1088 bp, Homo sapiens
taatacagaactaaaaacacctaagaagagattaaggccaaagtatggccagaaagttagatcaaacttcttttttctcaccttgctaagaataacgtccacctagatctcattgaaagctttcccataaataggattcttttcaaaaaataattgaatattgcttttcagaattaatcacatgatctgatttatatgttacttttaaacgataatggccacagtgatacttttgtggcagagctctaaagaaatgacttaagaatttttattttatctcactaaaaaaatagggcaatattaacaacaaagacaaagaggatgcctttgtatcatattagtatatgaaccacaccgtttctgaccataaagagacttttttcttgggggtgaagaagacggattataatgtagttttaagagtaagataagtggcagtaagagaacattagacgaagctttattattgttaaatatctctttttctcctaggttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaaggtttgtggactcattatattttgcagcctatggcaacaaaatactgtcctccattgcacatatatgaaagttgtttttaatgtaaaaatattacggtttctatgaaatataatagattgtctttggaataaagtgtcattggtgatagcgattaatttttgttatcactgtaatcttgcactgaattggccttctagtagctggaaccttcattaaaggaaagtttagtgccagtaacagtgaaaacacctgcaaaatgacaaagacgtgaaaaatacaaaagatacagtgtgatcagtcagtgttgttcagaaggaaaaatcctttcattgcttagtgagaatttttaaagctgagagtccaaccagagttaatatgtagaactcatattgaagggacagaattaagtgaatgtgtaaaaaaaacctttacactggcctatcaatt

SEQ ID NO: 88612 - DNA, 1034 bp, Homo sapiens
gaagagcctcttattaaggtatcatgtacaaaaatctaaagacaaacagtgtgtatatctggtaaataatgttgcaaacagagggaaagaacaagtataaaagctattcaggtagcagaaaggaggaagtataaagaagagggaaattaagaaaagataaaataaagagacattgccagaaccttttagatcccctaccccttgaaagaaaaaattcagtttctcctctcttgaaaataaaatgcatggcatgccattattgcatgggtgctatttattttctgtcatgttaccaagaaacacatctgtacgcccatgggttaatgacaaaacattttattttgtttttctgaacactaagtgataccccctgtctttctcaatgtacttttcctcactaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggaggtaagtcacttcatgtcttcactgaaagaatttaatatcatatggcttattactttcagattgtcagtgaatcagaatagatatattttgttgctgaagtaacaactaacagttgttaacagtaaaaataacaaaaaagcaaggtaatgtgagtcttaatactttgttatttgattcatcattgtgtcctcatttgttaaaaataatgagtgtaataattcagatcttaaaaactacattacagaggatttcaagcatgcataaaaataaaaagaatagtgtagcaaactcccatgtgccaattacctagtttctacagttactgatttttgccaattttgttctttgttttcttatactaatctaataactttttattggagttttaaaaagcatatctcagacatcaagtcatatccgtaaatacttcggtatgccttcctatgcaagtacttaaattttaaa

SEQ ID NO: 88613 - DNA, 1069 bp, Homo sapiens
ttggggtaaacggtgccatagaattactccaagggtctttgaatatcatataagcaccgaacattgtgagaaacacatataggcctattggttttcaaatgtatacaggtgctgctggtgttaataaaatatttaaagtcactacaagtttataataacttattaagcactttttcacatctgtaggtactaaaagtacatgaaaaggtgatattttaaaatgggagtccttgtaatttagtaaggtaggaactgttgtattgaagtctcttgttcttttatggtttctggaactatttcttgcctgtggaacactcaaacttagaactgaattttgtgcttagactaagaaagatccagataatttaatgttgggggctctctgtattatttctgatttgtacatgctcttctctgggtttaatcttctcatcagtttctctaattgttttccattttttgttttaaggatgactacgacaaccatactggaattgatttggttggcactataatagccaccattaaaggctctaatgaggaagatactgataccccactttttattgggaaagttagaacacttgaattccccttcgtgaatggttcggctgaaatcatggtaaattttttatatcttttggtagatagaatttctgtatttaatgcttttaaccaccatattaagacaccttttcttttgtatagctatgaagatgttctaatcatagcactaaattgggaagtcagctgaaatattttctgtttttgctattacaaattgaacccaagatctttataagtaagactctcgtttttcctatgggataacagctttctctgattctagttgtttttaactttagtgacagtacgtgatgttttatgtttcattgaaaagctgccgttatgtggatagaaacaaaaaatgtagcccaggtaaattttaattaaacaacttgtctttgttactcatttttttctaaaatgaaaatagttttatttgtattttaaaaatatacagtgcaagaacctccataaataatcaagatattgtcacctgtcagag

SEQ ID NO: 88614 - DNA, 1314 bp, Homo sapiens
catatcgatttagattttttaaaaatactacttctctgtaaattgtattgttatagtctaaacaaaaacagctactatcgtttcccttagaactgtgtgaaaaaatcatttcagataaaaatatatttgtgtcatttactagttatatgttttggtcttaaagtatatcaaaaggttttttatccattaatgagaaagacacaatttaaaaaatctttagagcttttcaaaatctcttgttctgtcacctgggactttgatgggtctatttccatgttaacagctgtaacttaaactcagcattgggctttgtgattgtttttataactttcacactatcagctctttcatgctgctttcaatttagaggttagaatcaagaagattttacaggtcaaaattttaagtggccatctctaatgtgaaggaaataactttttcttgaaattttttatcatatatacttttcacataagctgtttattgatacgatcatttggctttcaaaccaataccagaaggtaaaaagttgtatgtcttgggtagtggtggtggtgataatggtttaatggaatcttaaggatcagcctatgcctttggcctttaaaattaaccacttacttgaaaacagcataatgagttatgtaacatttatatgttgtaaattttctttttaaatcttgttttcccctattgtttgtttatatgtacagagtctggtgctggcagaaagtagtcctggaagggatagtactgaatattttattgtatttgagccccggctaccacttttatcaagaaccttagaaccatatatcctaccgttcatgttttacaatggtaagtttctaggaaataaatggttaaactccgttgttagtgatactttagataaccttgttttgctttccattaacttggtgtttattagctatctaaccactttatgacatattttagaaaagtcagtttttaaattatttaaattatctcaattttttttcttagatgttaagaagcagcaacaaatggcagcacttacaaaagaaaaggaccaattatctcagtctattgttatgtataaaagtttatttgaagccagccaacagcttcttaatgaaatgaaatgtaagtcattttgtattcaagacaaaaattatgctttggggaatgatgaggcaggtgagatcgtgatacacaaacaagcttccactttcctaaattacaagtaaaatacagaatgtttcagaaaggtggtaatgatggttgatactgtcattgagaattcttaagatgaagtatttcttattttaa

SEQ ID NO: 88615 - DNA, 1026 bp, Homo sapiens
cttaaatctaacagaggaaactgggttggtgatgctaccttgatacttaactgccatgggttccaaagcacagaactctctggcctgtcctcttccttccacttatcaatccatcatttacttttttcacttgcgttgtcactgttctagtttaggctgacatttgaaaagttgtctaattcatctctctgcctctggatttttccctccagtttatcttacatattgctagttactaagtttttgaaaatactactgtgatcctgtcatttctaatctcagaaactttaaattatttctccttttttggagcagttgaaataagttgctcactacttactattcacttatttacaataggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaataggtaagttgaataagtacttaaatagcaatttctaatttaattttactcttatttttctaagagcttatgttttgagaatctaacatgaaaaattaacaaatgtaagtaagtaacaaatgtaagtaagatgtttttgtctactactttcagcttttttatatcaggtagtttagagttatgtaaatagtagctttatcctttgtattttcattcttatatgtagtgcatgcctgtgttcccagctactcaggaggctaagacaagagtgtcgcttgagcccaggagtttgaggtcagcctgggcaacgtagcaagactccatctcttaaaaaaaaaaaaagaagaaatttctgtcattattgaataagtcagtattttattacataatcataatacttatttctatcttgaaatttgtaactatctagaacaattaaggcttattagaaagtgtatgacatgtgatctcctgcccctttttcccttccacaggct

SEQ ID NO: 88616 - DNA, 1154 bp, Homo sapiens
gcattgctgccaagtttgaaccacagcatgctcactgtcagttacacttacacatctttttattagaaaccccctgttactcatcagttttcatttgggaaatagtgatttctaacaacacaatatttaatgtatttgccttctccctgcaaaatttgtccacatggaattatattgaatactgaatatcagacaagatataaacactggcttgagagagtgatccaataaaaaacagagcacttttatatagagaactcttccctgacacagaagtaaacttaagtcaaacaaagaaaattaaatttaacaattttgtgctgggatcttaactatgcttttttatttcatttgtttatattgaatgttttatggctttaaaagtagatcccctatgttaccataacacaaattccagtgttgctcattttttcccctaaaacatgagtttggtttaatagcagtaatttaatcaaatgcatttggtttctttacagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtaagtctttgctttttgttaacttctactttctttatatggagataaatatttatgatgagagagaatccaaccgtaagaaaaaagaatgcaaatgattcagaacttaacaaaaactcttaacctccaagtcctatctgataaatggttataaactattctttcaccagaagtaataggcattctcagtatactttcttaattctttttctataaattatgacatattcatgtttgcatttctctaattccattgtttttattgtaaatttaactttctacattttccatcttcacaggtatgactcccatacgtaagtgtaatgactcattgcgtcattcaccaaaggttgagacgacagattgtccagttcctcctaaaagaatgagacgagaagctacaagacaaaataggtgagtttgtttgacctgagaattatgcttggttagtttaccaaagttcttgggtctcatgatagctttgtttttttgagatga

SEQ ID NO: 88617 - DNA, 1024 bp, Homo sapiens
aaccccacaaaaaaccaaaatccaaaacacttcaggtcccaaccattttgaataagggatactcaacctgtagtaccatgggagccaatcttccccacagctaattctgtaattaccattttgtttcttctgtaacaacaaacagtttaaataatttccaattataaagatagataggttaacatcatcatcgttttttaacaagataacttttatgaagcttccaattttaaaaaagaaaaacacttatctattcagtagggaagaaacaatcttatttattaatggcctgcatatttagaaagggtttaaaaacacatacatttcctgggacacaaacttacttaccaaatgtatgtccttacaaaataacttcacagatcaatagtcttgaacttacacaaagacatatatatgacatacattaggttaatatacatttcaaatgtttttgcagcaactttctaccagaaagtacactaatgtgagaatgtatgttctctttaaccccttaaaaatagtaataaaaaattacaaaataatgtaaatgtaaaattaaggctgagactacatattctagtattaataaagtcaaacaaacaatagttataaaacttggtgctgctgaatattttatatatatatatttatatatatatatatatatacacacacacacacacacaggataagtcttttgaaatttgaaatgctaccactgtcacaagttcactcattgatttaatgttgttctgggtatcttaacatttcaattcccaaatacctgtgcttttaaaatttttatcctgaattctgcattgagtttcctcacatatttacaattaaacatctagcctctagaacctcccttacacaaaagacaaaacatctttgttaaataaattcacgcaaaagtaataaaaaggttttcaagaaatagttctgacatgttcattatatttatactgaaaaatagtacatgtacttttcttcaggattaataaatgccatgtgccagttttac

SEQ ID NO: 88618 - DNA, 2007 bp, Homo sapiens
ggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaatttcgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagaca

SEQ ID NO: 88619 - DNA, 1156 bp, Homo sapiens
tgtacctccatttttttcccacgttttccatggaaggtgaaacctctataatcctaagcagtttcctgctaaatttgagaatttggttttcacagtaaatgagaggaagtttatttggatcttttaaaagaaaagtatgggttgagcatggtggctcacacctgtaatcccagcactttgggaggctgaggtgggcaggttgcctgaggttaggagcttaagaccaatctagccaacatggtgaaaccctgtctctactaaaaaatataaaaattaagccgggcatggtgtcccatgcctgtaatcctagctacttgggaggctgaggcaggagaattgcttgaatccaggaggtggaggttgcagtgagccgagatggcgccacagcactccagcctgggtaacagagtgagactcaaaaaaaaaagaaagaaaagtgtggggttttttttttgttttttgttttcttttcccttagccagaacatgtgggctaacagggtgtgttttctttcaggaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacaggtacctctccggcaggcagccctctgcccaccgccccagcatgtgggcggggctgggcccaaggtggggggatgtgtgggaacagaagtcagatgttggagccgccacgcctctcccagttctttggtccctggtggtgtcctaccacatactgctcacttgccatgtggcgggcctggtgaagaaaggcaggttctaggaaccgtcaagttttctccttccctaaacttcatcactcaaattttcttagttatcagactggcaaagaaggagaaggaaagattccagttacaaagggttgaagaaattgggtggttgtgagcactaaaattttaggaccactcactggggaaaacgaccattttgagattggtgattgtatttgtatttttttcttagagaagtgatagaaaagaaaccagagaagttcaaaattgagtgtctaaatgatatcaagaatctgtttgccccgtctaagcagcccttc

SEQ ID NO: 88620 - DNA, 1048 bp, Homo sapiens
atccttttttgtaaaacaattcattttccaaaattttgaaatctagattttaaatcttagaattaaacatctatatttgatagtaattttttacaattcgatattataagtaacatagccatttttaatacatgaaatttttttctactcctcttgttttattgctcactagctgtcatgtctgtggtgttctgtcttactcctcccacgctgaatatgtaacactttgatttcagttctgatagaatgcagaatttctccaatagaactaaacaacaaaagatggaaagcaatagtggaaaagtatgttaagctctacaaaccagagtacactatatttacaaaattttaaaatcctgaatgaatcaataaatttaggtaattttttttgtcagtgtcaaaatactagctgagaagagtttcatcataaatgttctgaactctacttttaaatatcattgattcccaaagaaatttaagctgataaaaagtaccagaatttcttaaaaagagactcttcctgtccttttccttccttcattcagtcttttaaaggttatttgtccttctcttcactaggagaataaagtatgagattttttacttttctactgcttgacttcaggaatattaaaaacattattaaaaggccgggcacggtagcccatgcctgtaatcccagcactttgggaggccaaggcgggaggatcacctgaggtcaggagttggagaccagcctggccaacatggtgaaactccatctctactaaaaatacagaaattagctgggtgtggtggcaggctaattactcaggaggctgaggcaggagaatcacttgaacctgggaggcggaggttacagtgagccaagatcacaccactgccctccagcccaggtgacagagcaagactctgtctttaaaaaaaaaaaaaaaattataaacaatttcctttaaaagttttgtcttatgcatactaaaatgtgtaggtgggcaagaaacgtattcttttgagaaaaacttgaaatgcttacacatcttaagtttta

SEQ ID NO: 88621 - DNA, 1125 bp, Homo sapiens
agcattctttctcccagttcagttttggactcacttggcaacacagaacatgatctctgaaacttttcagagcatggacctttaagctcaaggcagcctccaagctgggtgtagagaaaccacgagctgcttatggcagacagcctggagagcagtcagtcagtcctgtggttgggtgaaagttggcctctgaattagctggagcattggaggggctcttggttactctctgtcattccagtccccagaatggctttcactgaattgtgctttggcataatattaggggtgtcagcatctaatgaataaaatgtgggggtgtattcagtagctggaagtaaaatctgacattaggactgaagggggggatttggtttttattagtggaaaagttggggatggggccaaggcaataaagccacccctggctttagctgtacttcctctcctttgagcctttctggagaactccttgcagaccttttgattgtgatttgaatagtgaattgaggttgaggaacaagagtaaaacccttttctgtgctttgaactttgtagaacttgattgcatgttccagttagttatattgagtcattgaagggatttttccgtagaagtaatgttataaatgggctaggctcaggcagacttgccagagtttatttaatctagcatgtgtccgaaccatactattctggtaataatagttccttacaaaatgtagctctcactaatttattacattggttctgttggaagatgaatctctggtttctcccggggatgatgtttgttttttctgtttggctgctatggccaaagtggatgcagtagccgcaggttccaaagggtcttgggcaggaggtcagggttctttggtgattctgtgctgatcctgaactttggggaaaaagtccctaatggcagtcagtactatccaggttgctgagaaaggaaagggaatgcctcaggccctggctggagcagcctctcagatacaaaggagaatagtctcgggaggtccgtgtgtggaaatgcgtagaaacaatggtagcatgagactgttaggttgaaaattaataaggctaatgatatgaaatctggcatacaagtgagtagtgtca

SEQ ID NO: 88622 - DNA, 1033 bp, Homo sapiens
atctgctaagcacttactgtggcataggtcttggaactattcagttcatagttcttttttaatgagaagaaaaaagaaaactagcatttattaagcagctggtggtttccaggcaccacctcatgggatcctcacagcagtcctacctgacaggtgctctgaaccctgctatatgaagggggcctgtgaagcttaggttgacctgaaactgaagaaggttccatcctggaggtctgtatcaagtgggagagctgtggtataaaactccctgtctaaattcagccaagtcatgtgcttgccggcccacccctaacatgtttgtggggacccagtcagaacaggcttatcaatacagggccatataccatctgtttaaaccagtggttctcagctgcagacaattttgcccacacaccgcccccacccgccgccggggacattcagaaataaccggagacatttttttggctgtcaccactggggagggtgctactggcatctggtggttggaggccagggctgctacactcctcacctcccaagcaaagaattatctgaccaaaaatgtcaataggctgagaaaacctgtatctaaactattaaaagctgtaaatccaaagaaaagataaatgttcgaggggatggatatcccatttaccctgatttgagcattacacattgtatacatgtataaaatattattatatgtcctccccaactatgatatatcattaaaaaatttttttaaagctataaatccagtcaccacccccatggcccggcctccatggccaccagtggccctgcagaagccttgtcctttgccagctgccctagggagcctgaccataggtctgctgcacacatctacactgaccagggcacaggtctggggcagcttggcttgtgataaccacctgttcctttagctaaattgtcttcaaaaaactttcctagaggtctgaaatgaagaagaaaaacacttactgcctttgtattttgggtttatgatacacagagccttctaaagtgc

SEQ ID NO: 88623 - DNA, 1066 bp, Homo sapiens
aatctctgcctttatattcacatggcgttcttctgtgtgcatgtctgtctctctgtccagatttcctcttttttttttttctttttgagacggagtttctctctgtcacccaggctggagtgcagtggcgtgatcttggctcactgcaagctccgcctcccgggccatgccattctcctgcctcagcctcctgagtagctgggactacaggcgcctgcaaccgcgcccggctaatttttttttttttttgtatttttagtagagacggggtttcaccatgttagccagaatggtctcgatctcctgacctcgtgatccgcccgctttggcctcccagagtgctgggattacaggcgtgggccacggcgcctggaccagatttcctctttttataaggacatcagtcctactggattagggccagccttaatgacctcgttttaacttgaatacctctgtaaagatcccctttccaaataaggtcacattctgagctaccagaggttaggagttcagcgtttcttttttggaggatatacttcaacccaaacagtgggttttgagagtggggataacacatgtgacatcctctgggtttaacaggatgtctagttagagcaatatttttaaagatgcttttagttacacctatcttcactaatgatcagaaagaaactcttaggaagtaatttttagattacaactggagatttttgttcagacttgtgactgccaaaatttctgcatgttcctgaatgtttaatgacagtatctgagttgtctcattttcactcttggtttgtttctaaagtcatttgaaggttggcaaaatgactaaagaaagaacagcagtagtgtcttatgagaaagtaaaccgtatctatatcctggcatagtttcgtgaacatgttagccaggttctcatcatgctctgtccctccatgttatactctatttcttttttcagatatgagccttcttggagctttgttgcttaaaaaaaaatctgtcatgtattttcctgttctgggctctacaacgcttttctttccttaaaagtggctct

SEQ ID NO: 88624 - DNA, 1074 bp, Homo sapiens
attaatttacttagcatacctcccctccacatatatttgcaatgcttcatttatctttcattaaacttttagatatagattggcgcttactcattctgttcctttaataaagccatttgtttttgtaacacagcctgtattttaatctgatgggatttttctccctttggttttgtgacttctattttcatttaagtttgtatgtcagtatgaatgtatctattctctcttttctttcctaccacatgattttagagtcaattttcactgctggaaatagagatgctattgatttaggtttattcattggtgtccacttgattctaaactcttttctcaattaaaatagttttcaattcattcctttagaaatctgtgtcttctcactccacgttcagtgctttttcttttatatcttgctgcattaagaactattcaacttcacaagagtacactttcttattttaagaaaagtaattatggtttttctcctaggtggcaaatattaagaaggagactcatattgtgtggtacaaagatgagagggagatatcagtggatgaaaagcatgactttaaggatggtatatgtaccctgcttataacagaggtaggcgattataaatgtaaaatgtaatatattagctctctaccctctatcttaccccaaaacagtaactagattctgtattcctttcatgaccaggggatttatattagcttacttccaactgctgtaggaacacaaaagcttctctaaccttgtgatgtgtgtggatttgttaggtagcaaaccagtatgagctgaatgccacaactcttgcttttctgagttgcttttatccatatatgggcagtgaagtggatcattcttcatttgtgcttaagcctcgtggtcctaaaagtacagagacatcagacatggtattcatttaaggatagatttttatctacttcttgtctaaaagagcacagcatttaaatatatcactataaaactagtgatcactagtttttaataaatgaaggcagagtaaaaagtaaggacattaagcctcatatcaattacagcctt

SEQ ID NO: 88625 - DNA, 1227 bp, Homo sapiens
agacccgaacttcgctcctgtgcccaaacttggaactctggaaatgtggcttcgctcactggcgccttgagcttgggcgactgccgggcccgcgaaacccgacccctgcagagctgactccgggactattttagtttctaacgtcaacttgcccgattcaagagggtttgcgcaaaaacgtagcccgttgtccccctgctgcagctgttgttgcagctgtgtggctgcgtttagtaggaataaccaactcaaattgggaagttcttcagctcagtatccgctcctgtaattagaactttttttctttaagcgatgaaattttggacagagagatctggagtttagtttgtgactcgaagaaaaactccaaaatgtaataccttgtcccatttggggggaaagtttgggctaattcaattcgccatggaagtgtcttctttttaaagtagtttagtaggtatatgaatgtatctgtcagttcttgagagacctatggatttagcagagattttaacttaagtgcaaaaagtttcatatttaaaggcgaataaagcgaatatttcttaaaattattggtatttgtttcatgttctggaagggctctaataaacggtaatcagaaaagcactctattttcaaaagcgaggctttactggcaagtcagccctcacagctaattgtctttgtccagtggtgagaacttttgggtgtggcagtccaagagaacgaatcctaccttcaaccggaagtttgcataagaaatgaaacttggtttacttggaacggaagcaccaacttgaaatacactttttaaaaattgtggttagcaccagaaaataagttatacttaggctttttttttttaagtgcattgattaaatgaggcggtatatttggtcagggtttagaaagcccaccaaatactaggtgctatcacagtacgcagtgttttgtaagatggtggttttttcttgcagaatgtgtgatatttctcagaatattatcaatttgagtgttcgttttgtagaagaagtttctaggttattttacatttattgccactttgtaaataaatgctggactctaggattctaaccacagaactctaatgtatatattggtatggattaatcccattttataaatgaacatagtttctagagattctgaaaacttcttgtgtcctttggtgtgtggggaaagccactttgagaatctcttctattt

SEQ ID NO: 88626 - DNA, 3940 bp, Homo sapiens
ttgtgcacatgtaccctaaaacttaaagtataataataaagcaatttcaacttttttagattaaggggtataccctagttttctaaacttcgatgagagttgtgcatttgctgaaggcttattacatgaagagtgacagtctaaattgtttgaaggaaagtaaaatgaacaacaaactagaatcagcaaagaggaccctgacaatatcagaaatgatctgctccttgagatcatagcactgttcctgatttgactccctccaccattatttattctccccacacttttagtttggtagggaaaaaaccccacagtttctgtattttggaacagtgactgtgcagccaaactccctatcgctgaaaggtttctggtggaaaataactcatagatcagaatccagcctccttgaaaaagtaaaggcctaggtagtaacttcctcaacattacactgccagtttttgatagaattaactaccttaatttgttagaattgagactaacagccgaatctcttcattctaacaatgctttgtagcttctaaatgatcccacacggggtttttcaaggtcttcctcctccccaatcccttaattactcagaaacatcttttctgaactcacagcatttgataattatgtaccatgttaggaattatttttcattattgtcacacgttttaagtttagagtcatacttctggaatgaaaactatgactcatttcataagttgaaccaatcatctcatttctttatagttgcctccccaactatattaagctccttgaagataggacacatgccttacatttcttaactcttagctagtattcaacataattaatatgacgtttgatacatattagtttaattaacttcataataaaattgataagattaagtattgaatgtgctgaagaagagctctatatgaggccattgtcagtgctgacccaaaaaaaaaaaaaagcttttttactttaaaaatctattttataatacatttacaattcaaaaaagtgcgtgattaaaagaataggaaatatatcagaattcagaaaacatactactttacaaccaaaactaagcattttgaaaatgtatctagaggaccctcgtaaatttagttatatgagattttatataatagattaaaaaatcagatgtgtcagccgtttgacctcatcagtttctttgttcttaaaatagctgacatttctgcatcattagggaaagacaatgttgtcacacaaaacagactatttttaaagatgtgctttggcttgcaaaggcgtgacatgcctaaaatattaaagcgatatggactggtaaacgtgtcactcattgggtttcaacctcttgctccaagtccttgcgtacatttaagaattggaggaataatatattctatatctctttgtattttttaaagacagcatttataacagacgaggaaagtacatcctcatgtagtttagatgtgaatgggatttactacccccaaaggtgttatagaatgaaaatatgcatttatgaatagttttaagtcatgaaaggcagcatcctaaaagttgattaaagaattctaggaaatttgggaacagcatatatatcataacttctgtgctatgtaggatatatcttttcaacaatatattccagttgccatacggtgctgtattggatgggctggaatttgtgactatcctttgtggaatttcctattaaaatctgaaaacagatttagctttaaaaaatttgaggcagagcttttctaatcattccataattgtatttagtctggacgatatggttataatcaaggaaagaatgtaagaaattactttttaaacacatcggaaacacattcttagggtcactttggagtgctgagatctaggtggtagttcattctttgcagtccacagacttatttttagaccaatggcatagtgttttgccagatcatagctaaatgttgttttcagaacgtaagctttaaaattgttatcctggtcagagtgaaatcagtagtgcctattttagacctgcttggaagaatataactcaatgcagtgtcttacttttgctgctgagcggttttgcagactaccatcttccctgcaactctgaaggatggtatggtagaattttattgtctgatgactgagatttttaacttgaaacaaatttttgtagtttttaacagattgagtattgaaaattgcctttttattttaggtattattagacattctttttaattttaacttaaattttaccgggataaatttaggtaagagagcaaaggtagtttctacgtttaagatgttttctaaaacttttaaaattattttaaaagcttgtgctctgatttctgtttagagatcttagatacttccagtgatttagtgtgactgtaatgcaagaaactggtttggatagagtgcaatgtctataaaaactatagatgaattcccttcagtttttttatactttactattagcctttcaacaaatagtttttttgaactacttttgcctagtggtgagggtacaataaaaaatgttagttgaaagtgaaagctttaacaatatttgtcaatagagattaggagatgaagacctgttccatcagttagtcattcttactattcttcacctttctgtccaccgtactatggaatagccagtttaggctaaggctgcaaagcagggacctactgaagatgaattagtatccctcagcacccctatactgctgaagtatagaacttgggagtttcctaagtacctaattttttttgcttcttggttttttattgttatcaaatcagcagatttggttatcagctgttgttagttatatagcagtacaggacatatgtaatcttgttgagatgtgtcttctaaagacacatttctgagtagctcaaacatatcaggaaagttggttctgtgtacttttgttaatcattgttttgattcaaacttaagtaatcttagatgttgatttggtttttattgtatttcctttcctaattaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattgggtaatgctcagtttaaatattaatctattggatagaatttccatggtgcctttcatcttgatttcatgagtcttaaagctctgtaaagcctgtctaatgagtctactaaggtttgagtaaagtgtggaacagtgtttcccaccggatcaccagcagattcgtgaccctgtcttaggattgggttggggttcgtgtgtgtgtgtgtgtgtataaaaacactgatcttgattatggaagcagtattattccttctgacattccaatggactatcatatactttccagactctttaataggccctattcattaagaaaactttccccccaaatagtttcactctcatgagtgcaaacagtaaactgtatgaatgataatctttgttaccaaaatgtttactgtcattaatagttgatatgtattgtaatgtaattaaaattatgaccccttttaaaaatttagggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggtaagtgagaggtaacctttaattataaagtgatttaatttttagttatggtaactaaaatatacagtaacttaa

SEQ ID NO: 88627 - DNA, 2580 bp, Homo sapiens
atgtgaccattcatgccacttgaaggaaccgtaaggcttagattctttaaccatactttttattactttgtttaggcataggtttagtctctcttatcaagagatcagaagctgaatgtggaggcagaatgatagagcaaatgatagagcggagcagtgctgctaagcagctaggcatttttctaggcacttctctgctgaggctgttttaagtaggtggacaccctgtagttcatatatttgcatgtttatagtttgtaacatacagaacatgcttagtcaagtatagatattctttgtaattaaccctcagaatagtatgtattctgatcccttgttctttattctccaggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcagagaaagttattcgctcgattttttctgaatcataattaaactttatgataaaatacttacttgtttaaacttcttatttaccaaacttggcttttgttggtttcagtcgtatctcccaaagaaaggtagatgagggaaatcctagaaaatgatatggttgttagctttctcttcctccagttttcctaacaatcctatctcctctactatccattcctcctcctcctcccaaggatatccaattttaactgccctaatcaggttttctgcactttgtcttccaatttttaaaataatttcctgtagaatttgcatatatgatagtttccatagctttaagtccttaagttgacatacctgccaacatttccactttatttaaacttttgtaatttctggtcatttaaaattagaccaggttactgagtataatttcaatttgtcatatttttaaaaaccattttggcttaaaggttctgtggaatgctaccaaagagagatttttatgttatgttttaaagtgctggaaatataatgcagtattttttttattatatgtagtttttctttaacacagcaatgtgtattgaaagatatttgtttatgcagagattcaccatgagtccatgtttgagttttggacattcctgaccttcccacaatcaaaacagctgaacctgcatgcctgggaaagtgaggtcattatttcagtcctaaaaataacttctactatttgcagaaatgcagaactgtttcacagttaatcagggagtggcagacagtttcgttctttttcagctttaaaaatctgactctcaaagggcttcaagattctcttttttttccagacagggtctctcgctctatcacccaggctggagtgcaatggcacgatcacagctcactgcagccttgacctcctgggctcaagtgatccacagccacctgagtagttgggactacaggcaggcaccaccatgcctggctaatttcttaatttgttgtagagacaaggtctcattatgttgcctaggctggtctaaaactcctgtactcaagtgatcttcccacctctgcctcctaaagtgctgggattacaggtgtgagcaaccatgcccagcccaaaactctgactctcaaagagcatgagttttaaaagatttgaaatggagaaaaatttggttgaaaagatttgacaattagcctatgaagatgagtaattgacaattactataataactttaagttttatgctacgattaacatgactctccttggacaaaaccattacctcattcagtaaacaattactaaaagccttctgggcagcaggcctttgcagccaataagatagatcagctagatcctgtaacgtgggaaggccagtgctataggaatagaaggactagtcaaagctagtccttgacctcttcagcattagaatcttagaacctgccttcattctttgtcttttgtttctgaattttattcactggttaagccaaaatactttttccaggctatggccatggtgctaaaatcttgttttttgaattgaatttccatgtcaagagaaaaaattatcatatgctttgttacatctctagtgaagaacagatagcattgtttgcactatatgaaaaacaaggtactactaaaaggatctcttgcagggcccctgtttccctttcagataagtgcttaatgaaccaacttgcattaagaacaatgatgtaccctgaatgaaataattctcctaatttagtaatagcattctttgcttaaacaagag

SEQ ID NO: 88628 - DNA, 1079 bp, Homo sapiens
ggaggtggagggaggagggttggcggcgggaggagggttggtggcgaggccctggcccggacgtccaggggccgggaggctgcaggcgatggagccggtatggggagacgccctgctggagaagtggccgggtcccggccgtgcgtgggccggccctgcgccacctgggtgacctcagacacctgggccttggacggcccggctgcccggcggccaacgcctgccctcccggcgccgcggcgggtcctggcggtggattggggccgacccgggcgtgttcgtgtggagcacctgccctgtgcccaacactatcctagatgctttggagggtggaggagcctcctgttgcacggtcttgcctaaggtgaagcctccaaggaagccattagcatgccggtaaccgagtgtgtggttgatacgggctcaaatgtgatgatttacatagagttgtaattcgctcagtgtgtcttgcatcttgtaaaggtttagtttattcgtgttgattgaagaaaggaccattaacagaaatagggaaaggttacttggaaaagagtcgtgacctcactgaaggccttggattcaaccttaagagggagaacttagcgtttccggctagatgtgtgggaggtggtaacgagcaaaactcaaaagctgggaattgtgtcctgtgaaaagcaggccgtggggacaccggcgggtatggaacagaactgtaatgactaatagtcggaaataagggtagataggtaagtaggaccttcttatggatgtcttgaaaacttaggagaaagaaaagattatctaagaagccatagagagtaattttggagtcttcactaacggagtaataagaaagggatgtttagaggattcgtttggccgctttagtttaaggtagatttggaatggtcttttggtaagagaagaatcaaagcatttagaattcagtaggacctgatagattaccttgtgaaggctttgcgttttataactgaggaaagtgaaacccagagaggtgaggtaatttgtcgaaggtggtggaccctcctggactttataactaagagcacttttgagtg

SEQ ID NO: 88629 - DNA, 1013 bp, Homo sapiens
tgccattttctagctgtgtggcaagttgtttattctctttaccctgattttcgtatctgagagaagaggatgataacaatacctatatgatgagttgtcgtgaggattaaatgtgttaacacatacaaaatgcttaaatcagtgcctggcacatctttagcacccagttgtccctggttgctactgcttcttccaggtatggagcagtgggtagctactaagtttccttagggatctcttggggaagagactggaaccataggtagaccgtagagaaaagcctcatgttggaattcagatccgggacctaccttgtaatgaacatatatgtgtaattctgtttgtgacaggaaagaactatatatgtatatacactatatacaactgtgtatactatacatatatttatacatatatatatgtatttgcttaactaggattatttgagcacctgccatgtgcaaggcacactgctaagttctgcagtccaaggtggaaaggcaaaaggcaataaaaagaatgaatatggccaggcatggtggctcatacctgtaatcctaatgctttgagaagccaatgtggggggatcatttgaagccaggggttcaagaccaacctgggcaacatagcgagaccctgtctctaccctgccacccactccttgcaaagtagctgtgtatggtgactcatgcctgtagtcccagctgctcgaggctgagtcaggaggatcacttgagtccaggagttcaaggctacagtgaactatgattgtgccataaacccaataagagaggtgaatttcaaaaacattgtattgaatgaaagaagacaggcatatatatgaatatatactgtacaattccatttataagaagttcaaaaacaaaactaatctatggtgatagaaatctgaacagtggttgcctatgggagatggtgattaacttggagagaattttctggaacagtgttaacatttgtaacttaatgggggtgatggttacatgggtata

SEQ ID NO: 88630 - DNA, 1026 bp, Homo sapiens
aactactctctgcttttctgtgtgagttcatctactctgagggctttaccttgtgcctctgctcacaaatcagcactgctaacaagaccctctcagagtcctgtcctctactagcattctactgtggcccagataaaatttgagttatttatcatcctttgctgacaaaaccagctcctccctcccctccccaattacctcatttttgagtggtagctttatactaccaggttttcagtcagcacttaggaaaaaggacagagctttgagactccaattagaaagcaggaataactagcaaatcaggaagtgatttgctggtcagagccagaggaattcagccaaaagaataggatggtggtggtgggaatgttgaggaagggtgactcgtgcagtaaagagaagaacctacagaacttggatggaaactgagtagaaggactttaaacttttctgttcagaaatggaaaattccccgtgctatgcaaatttgactgcggtcccttggaacttggactgtggctgtaattctgaaataaaggcattgccctattttaacattaaagaggtcaaggagacagtggctttattacttttctattggtgtataacagaatactccaaaacctagcacctcagaaacaatgaacaatttttgagggtcagagccagagcagcttaggtgggtggttctggcacagggtctctcatgaggtcacatggggaggctgcagtcgtctgaaggaagatcagcctccaagatggctgacgcatagccgacaagttggtgctggctgtcggcaagaatcctcagttccctgccacatggatctctccacagggctgtgtgtctgcatgacctggctcccgccgattgagtgatccatgacagagcagggcaaaagctgcaaggtgtattatgacaaagccaaacaccctcatttcacaatatcttattgtcacaatatcttactggttacacgggtcaacacttttcattgttggaggggactgcacaagggcatg

SEQ ID NO: 88631 - DNA, 1229 bp, Homo sapiens
tttatgcccagcctcattccacactatataaagtacttctgtgaaatagaaggggttttctttttttacctttagaaaatatttgcttaagaataattttgtaagcatatgatctgtttctgagcttttaaatgatttgatctaatattaacacagaactctaagaataattggaaaacataatgatatagttcatatagccttagttcactaacttactttgtttatagatatggatattctgaaatattttatacgattgacaagctttaggaatgaaccatcaaagtgccaggaagtattgatgactgctttcttctttctattgtcttccaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaatgtaatggcaagttaaacaaatgattgataggtgggggtagtccttttttcaggttttcaacttcatatgattcaggttttatggtaaaattgatttttcacatatatgggacagtgttcttcagaacttttaagtaccctttaacattattatgcagtaaaaactagttatgccattgtttttcacgcttctagtcagatgtttattaaatgataaatatagaatgtatctgggaaaacattaaacattgcgttcatctaagattctgagaagaggcaaaattccgaagattagttattgtacatttactatatgtggagcgttgtgcctacacaatttttcttgaatcttcccaacaaccttgtgggatttttatt

SEQ ID NO: 88632 - DNA, 1183 bp, Homo sapiens
gaggccgaggcaggtggattacatgaggtcaggagtttgagaccagcctgaccaacatggtgaaaccctgtctgtgctaataatacaaaaattagccaggcctggtggctggtgcctgtaatcccagctactcgggaggctgaggcaggagaatcgcttgaacccggaaggtggaggttgcagtgagccgagatcacactgctgcactctagcctgggctaaagagagagactccatcaaaaaaaaaaaaagaaaagaaaagaaaaagaggaaaaggaaaactaggcaggtggtggctgaaagcagccccttctgtgcacagatccagcctaagagaccacctgccagggcacaggccagttcaaaggccaagcatgatcctaggacaggaggactgatgagtccatcctaagctgtatctgtaggaagagcaaatgtaccactggaggcatcagactagagaaagaggtaggggacctaaagggtattggtatttgtttattgcctgtctttcatctctctcataatctctctcctacagtataatctccacaagattacagaataggcacctaataaatattcatttaaaaataaaagatgttagcatctctatagcagtgatgttcacacattgttttggaaagcagtcactgtaagaaacacatttttttttcacataggacccaatacttctatcagtctctctatctatctctctatctatctatctaaattaaaacgggtttcatgaaacaaatcctactcttgctaggtatgatgctttctgttattttaatcttctatttatttattttaaaaattctgaccctgacctactcaactcatttagcaacctcacaaggcaggagggaggccccactggtcggtgtgatgggatcacctgagctggaaatggaggttccagctgaatcggaaattcgttctgatttcacgctctgcaggaaggcttcgtattttaacaggatttcctcatggatttgccttcagggaatgaatgtgctcatcagcaaacatgagtatctgccttgttaatacttctatcaattaattgatagtatatagcaattaatcaatcaattgatattctattttatataccactctcttgtgaatttgattaatgtgagtcagaatctgagaaactattcacctctggatg

SEQ ID NO: 88633 - DNA, 1048 bp, Homo sapiens
agttaggatgggtggtgttataactgtgattctgaagatttaaaataatccaacaaggtcacatgctcagtaatagaagaactaggcttcttgctggcaggtcagctctcttcctgtggtttcacaataacatttgaatacaacaattctcttctgcagggctccagcctctgtgatgtccaacatgcttatgagcaggttccaacatgctgcagctctatttccaagcctactcatccttccaacttacacctcatatggtgcacatggaaaagacataaatttggctaactttgtgcaatgcaggaggggctatgtacacttcccactctcgaaactatcctcttgactctcatggctagagaaagccatctgatcccaagagttatctagatccagtatctggagggtaattcaaatcagaaccaataaacaacaaaaggaggtaatcaggaacgaatgcacaccacggaatgagcatgatgtacagctgaccacacagtttatataaacatgcggcacactgcaaaaaatatagagtgagtttcttggaccagcttccaatttgtcttcactaaaacgtaatgaaagtatgggacttcgaatacattaagttagtcactcttaacgcctggagcttttcaaaaccatccatactcagacttcactccagttggatgcccacgccattctaaaggtctgataagtgactattcctgctgtttaaaacaggcattggccgggcacggtggttcatgtctgtaatctcagtgctttgggaggccagggcaggaagatcacttgagtccaggagttgagcccagcctgggcaacatagtgagaacccacctcttcaaaacacagaaaaattagctacttgagaggctgaggcaggagggtagcttgagcctgggaggtagaggctgcagtgagccgtgattgtgccactgcactctagcctgtatcaaaaaacaaaaattaaactaaaaaaaggaaaaaaataaagcaggcattagtaccaaatatttgcataaggctcttttcctaa

SEQ ID NO: 88634 - DNA, 1014 bp, Homo sapiens
tagtgcgtgattgttgagtcctcagatttaattgttgttagttgcttggtgataatatcatggaggtgagaaaagaagaggcagctgggtaatcagctttgcaggcaaaacaggataaattccaggggccctgcctccaagtagccacactggacctgtgtgttcactcagaacagctccaaaacccctagtacttctgtgtcacccatttccctacagttcccagagaggcaatcccattcaaaagcatgcaacccctcccaaatccttctttgtgacttacaaaaaaattcccagattttcttttaagtattcatccctgatgataaacaatctatagttttcccaaaaagaatgcccccattctctgcagtcacttgagggttattaacatgttcctttacaaatcctatagaccaagtggattagctatagccacttcacagttgaggtcactgaggtctagagagaagagggaacatgcccagcatgcaaggcgcgatccactgatgggctaacagattcactgagtgctgtttattaattgatgcaattcttacaatagcaacattatcctcattttatacatgtggaaagagaggcacagagaagttgagtcactgcatttggacccgcaggtaataggtggcagtgtggccacacaccagagcccttgcctggattaccattctgggtgtggagccgggagtattcctggaggctgaaggaaaggatccagactcagtctgcggaaaggctctgagtcctggctgctccaacatgacccttctctcctgctcacatattcctgaaggaaaacatgggactctgtgatgtttaatacaataaagaatggggcttttgactgcaaacctctctaaggaatgatcatccagtaaagggtatgcaaaacagaattattaaataaagaggtagaatgactttaacctaccaatcccttccccaagactgaaagtggagaaaaagagacaggggctgcttgtttaattgtat

SEQ ID NO: 88635 - DNA, 1084 bp, Homo sapiens
cagctgagcatggtggtgcgtgtccatagtcccagctccttgggaagctgaggcaggaggattgtctctacagaaaaaaaaattagttggatgtggtggcatgtgcctgtagtctcagctactcgggggcgctaaggtgggaggatcacctgagcccaggagttggaggcagcagtgagccatggttgcactgctatgctccagcctagacaacagagtgaggctctgtctctcacggaaaaaaaaaaaggtaagtatatgaaaatatgctgtacacctcaaatatattcaattaaaaggaataagaaagtaagaggtagcaattttttccattttccatagttataacattgagaataaatttagttctgttaattgaaaaataaaaattttaaaaaataagtcattcgttttttaaaagttcattagcaattgtctctgtgacagtcagtttatttcccttgcacctttgtggctgaggtttcgtgtagagacaggggcctaaggaggaccctgagtgggtcccctgaaatgtggacacaaagcaaccaccagtccacattcctcggtccacaaggatgtcacgtgagacttttgctaagtgtcttgctaaaataagtcatttctgactatgatattttcctgctcgtccagtggagtgctatggcatggaaacaaggttgtctggcacgagctcagatttcggggaactcatgagagtgcctagcaatcattactttctttaataaatacgcacaaagccccttcaatcatctgttccggagttttgctgaagctcaacattaaatgtaaccagcacacagacccgtaagtcacctttcctgttgtgttggaaaatctggaactcatttacccatctccggtcttttgctgtctctccattccccccggtttctccggttcagatggtcctgtgatcacatctgcaagttctttcaggactctggggtgccatctatctaagccaacagccattcctgctctcattttaagcagttagatgctctctttgcctgtgtcttgggttgaagatcattctgcttgagagagaaaacaaaagctt

SEQ ID NO: 88636 - DNA, 1057 bp, Homo sapiens
cttcagagcagagaaagcaaaccctaaactgtgctcaccttgctctagcaaaaagaaaccaaacaggttcaacctgtaactgcctatagacctttcccatttcctcaccccagagagttttgagatcattccacaaagataccagcttttcatatttgggcctaaatgaaatgctcaggtcccaggacctcctacgcttataaattggctccaagacacaacacatctactgtttgcttctgtcacacccacatacattttgaggttgtggaggcagatttttgtggataaggaaggaatacattccataaacacaaactggaaaaccattgattagatggaacagggaagaaagtctaggaaagaaggcagggccacaagctggacatgagtcaacaaagcaacagaaacaggcacacacacagtgtttgaggatgttcaatgaaagcattgtctgtaagacaattctatttctttctctggccctctctagtgaagacacaagtcgagtattgttgcagacagaaccacaatgatagcagagagtcgggaaaacaaactgtgaggacagagtgaataaaaactaagatgtttatacaagtgcaatagtaatcaataaatatatgagtgcttgcatttaaagaaatagcaaggtagtgagaagggaataattgtggggattaattcccaccatttgctggcagaagcataaggtccaatgatcaaattcaaaggtttaagtcaagcattctgagcttaaggggaagggaaaagtctcccccagtctgggataagctctaccttcaagctgttcggataaaatagcggctaacatttgttgcattatgccattgtcatgcaccctcccaaagccttagatgtattagcttattgactcctcacagaaacactatgaaacaggtgtgattggatgcacatttgacaaattatgagactgagataaataaagtttaagtagcttagccaaggtcttgctgctattgtcaggacaagatttttaatcgaggaacccagctgttacccaggaggctggagc

SEQ ID NO: 88637 - DNA, 1061 bp, Homo sapiens
ataccacctcccagatgtgcaaagaatttagagtgcattttccctatgcgtgctcatttagaagcacatctgctcctcttcacctcccaggtagcaggggaaaggctagatttaatcttgttacaatatttccatttcttctcattgatacaggcttgtttcagtgtaaacatttggtccatttgaagttcaacttcccactagtgctaatgaaaatctttacctggttgagtaaatgttttcaggtaaaatactctatctctcaaatttagtctcctcttcctcttccttgacctggtagaaagggcaggacttactatatccttgtgatgcctgtaggataaaagggttcctgagtggtatgttgtctcaggcctcctctggtctcagaggcaatgccccatgcctgcctgattactgtttgctctgctgctgttggggggtgaaatttgctgctgggatcattcgtggcttggtcagtgcccagtgggctgtcttcagtaaagtcactccctctgagcctatgccacaacccccaccaaaactctcccccgttggagccacacaagctcctgctgtcaagccctctcgctcttgccctctggggacccaaaaggcccctggtcctcaagtcagccacctctgtgtcttcctccatccaaaagacctgcaggagcttctgagcctggtgacacttgctggggaccaagaccatcctactccgccccagccacgctgcatgacctcatctcagcccaaaaacagacattgggaacatctgaccatccatcccgttcccccgctctttttggctacctgcagtgaccccagcagcaggggcgggagttgcctgccctcttccagcctggaagagcatctgtcctacgctcctccttccgggagtgactcccgcccgcatctcggggtgggaagggttcaggaaacacagaccagcttatcttaaggaagcctggtcgggaatctttcaaaaacacatctgttacaagggggaaagacacctccaggacaacagtgatttgcctcagcggggcaaaggccag

SEQ ID NO: 88638 - DNA, 1284 bp, Homo sapiens
gagatccagaatgaaaggcaagaaaggtaaggcggccgcgggctgcgcgcaccagaagacgcgagtccggggaaacgtgctggccgggccgcgccgcgcggagtcacttggtggacttttccgcccaggggctctcatgctggagtggcggccgtgctctttgttgaggctgcgtctgaaacggcagcggctgttttcctgctagacacaacacgaggggctgttgtggggcgagcctctccacgctgctggcacgttgtcaagaaacacgctcagcgccttgtttgtgcgcctgcaagtttcattgtctccgccgacaccccacgctcggcccagccgccgcgtggcttctcgctctttctcgcgtgctggggatatggggtccgagtagggaggacccagcccctcgtttttcccgatccggacccaggcggccggggccgcgggaccgccgcggctttgtctgaaagttccactcctaggctccccccgcccccgcccccgccgcccccctactcccagccgggccctagcactgttctttagggatgtggtgtttttacgatcgaaggaatgcgattctggaccccctcatcgccctcgggtgtaaacagctttggaaagctagacttttacaaatccccagtctctaaaagttttcccacgatgaattttggggcaggaggaagagttagcacccagggccagcagcttcaagcggcatgcagtcaaaatgcgtccaaatgtgacaagcaggcttggttgtaagtgcaaagagcaaggctgtcattgtttccacgaagtgttctggaagctttacaactaaaacttgccgtcagtttggtttaaaaacaaaatacaccggagggggacggggggtggagaaaccacacaaaacaccccgaaaggtcagagtgtgaagtcccttttgaagttaacaaaaattgagtccctggctgggaggtcccccgagtgttccgctgtgggctggaggtggcgtttctgtcgtgatttatgtggagtggttcaaaacagaagttaatcactcgggaagcggacgggaggggcggcgctactgcgcatgcccgggagccgcctggagtttggaactccacattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactgg

SEQ ID NO: 88639 - DNA, 1431 bp, Homo sapiens
cgagacgccccgtgaaagccgtgccgacccttgggaggactgacaggtctagagacacgcgctgtctgttgtggtgggcctcccgggaataagtgaggggctctgtgtttcgaggatggttctagcgcagagccgggtgtctgccggggtgggctccccgcattgttcgggctccggcgggggcggctctgattcctttccatggcccgcctcccaccccgggaatccccagtgctccttttccacggcttttctggcgtccccccgactctcccgcggcactttggcctaccttcccccagcgccgtggtcctccctggcgaccccctctgcgctcctggggtcctcctgcgccccccctcctccaccggcgcgctgcccacagccgcgtgccctctccccggagctggggaccaaggctgggccccgccggccgcatcggtgggaacttccgcggtccccatcccagggcgcacagggtccagctcctcggcgccgactcctggaaacaatgaaaggtgacgggctgaaggggaaactttgcgactggttcagggctctttgggggagccgaggctgccgaggttacccgggtttctttccccttttaggtttccctggcgagtcgtctggggtgggcaggcctctgagaaggtgggattcacggcctcatttctagtttcttgggtcctggagttcctttgcttgtgctaactcgtgcagtgtgcgggccggcctgtttcacttgaggccgaggaactctcaagaacaaaagctacttgcttttcctccttgggcccctccctctccccgtgctcctccgccgtcctcctctaaaactacctgggaggggggagccttccccgtcggctctggaaagactcctgaggaagtcgggccctccttactgtcttgtcttataaaagtctgcaaatcttttcaagttttcttaaaacaagtgcactttcagctccattcctgagcccggggtaagcttggtttgtgataatagtgtgtcctcccagaaagctgagagtgacgccaaaagatctcctaaaatgacttaaaaacaatgagaaggatcgataaggaaaatccactaagtctttttgctcccagtttttaactgttgaattcctgctttgggattgctctttggctggggtagccaaccataccttggatttggtggcttgagtgttcaatgcctgttgcttctcccaaggagatactgattttttttttcttttgttcctggagaccgggtctggctatgttgcccaggctggtctcgaactcctgggctcaagaaatcctctcgccttggcctcccaaagttctgggattacaggcaagagacattgctcccagctcaaaggagaacttctggtcaggaaacttgttgagttaaatttgctttttcctaattgt

SEQ ID NO: 88640 - DNA, 1031 bp, Homo sapiens
agctattcagaaaagaaagtgcagggctgggcgcggtggttcacgcctgtaatcccagcactttgggaggcctaggcgagcagatcatctgaggtcgggagttcgagaccagcctgaccaacatggagaaaccccgtctctcctaaaaacacaaaattagccgggcgtggtggcttttgcctgtaatcccagctattcgggaggctgaggcaagagaatcgcttgaaccctggaggcggaggctgcggtgagccgaggttgcggcattgcactccagcctgggtgacaagagcgaaactctgtctcaaaaaaaaaaaaaaaaaaaaaagaacgtgcaggaacaaggtcgctgcttagggcggtgggatcctcaggccatgttgtggctttctccacaacatttccttgtatgtggatagcgtgaaagaagcttgtgatcctgcccccaccctccccaccgccacattttttaaagtgtaagcaaagcaagacgtttggaaacaagtcttaaccgggaaacttttcaaaagcgctgttacaataggaaatgagtaaggaggaaaaaagtctttgtttttccaagctgagccacaactaggagggagagttttaatgaaaacagtcctgacagcagcaaacgtggttttactgcagtgaaatatcagctggcgtagccaaggcactgaagtcttaacttcctgttacttcagcttttgtgcacatattggaaatatttgttaagagttccagaggtctggcattcatttatttaaatgaactgagaacagagtaaagtcgcgctgcagtttggtgttgcttaactgaaacctgcttttgtgtgtcactaacctattctgaaagatcaggcttcttgtcaaactaggcaagcagatcaaagggcagccttcaggggctttttttgtttcaaactctttgtgattaccaacttacagttgggaattcactgttcaatgagcaaattttcacactttttctagattaaaaaaaggaaggagataatagccttgaga

SEQ ID NO: 88641 - DNA, 2506 bp, Homo sapiens
ttaacactttttttaaaagttcgatttctttaattattaaagccaatgtgagacaggaactcagctataatttctttaagctattttattaatagttcttcacccaaatttcaatataggttttgaaagtctcatcttgccaatagtgaaagtagtttcagttttaaatgggcacttttaaaaacctttttaaaaacttaaatcatcaggggaggggaatttcaaatacatggcagttaaaacttaggattcttgtgcagtttatttgtagctgtttgttaagctgtgagctaaagtgaatttgcaagatcatccacctctttgttagaactttactttgtctttggagagttctgccttttgtaggaataccctgcagcaccttctgccccctgcagtccaaaactaaaaatgtgtcaccaagtcagagtcattaaaagggtgggaaaaattcctttaaaaaacacggtgtttagcttaagaggaatattccgtgtttatttcctgtcaaggggaactggctcaattaaggtcaagtcatattttcaaccaaaattacatactacagaggaaagaaagcatacaaagctaaaaatgcttacctttacatttttgttattttaattacttcccctaatatagaagtactgatttttttcaagcatgccattgtttgtaattcatttctgtttttaagattctagattgtctacaagcaaaagaatgtatttctttagtcattcggagtagcctgctgtagtttttgaaaggtggaattaatagcgtttgttatttaattttttttaagttcagaatgatgtttaaatatctgtaaaggccagttctggagctttattgaaccccgtccatctgtgatttaaatattctctatggcttgtgaattcttaaaatttctggcaggattaaagtacttacagccaaaagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacttggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtaaagaaagagagcgtgaggtttatggatgcatttttagtttcaaagtcattttatggcattcctgtgtgtcaagtcattaagctccttgccactcaaagacagaaggaatatctttttattgtaaacttgatagtgttaaaagctaataactagctatttagagaacacagaaacacttgacagtcatctatcagatagcatttcctttaatgcctaaaagaaccttcctttatgcaacagacattaaaaggaggttaaaccttactctattgtccaggaaactggtttgatatttaaacaaggacgacttcagtgaggtaattcatgttatgtctgttgacacagtcatttgaactgggaaaaatcagttactgggaggagtggcccttttcataaggagaggttttcctg

SEQ ID NO: 88642 - DNA, 1114 bp, Homo sapiens
gtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaattgttgtaattcagagtatttctgttgagggaggtgcttcttaaaaataagtaggaatatagcaccccagtgagcaggaagctgggggggtagggtgcagtgttagggggtgtcaccagctctttgaaaacctgtggacaacaagccagtttgcataaacaggatgtgtgatatttactcttgataggaggcatagcaggcccttagagctttacttaaactgcatggcaaattgaaatgaatcattttagtgtttagctagccactaaatcccttgctgatctgtcctgcgtagtttaaaacgtggccatgttataaagaaaagtcttgaagcatccggttattgctgagttttcagaagaaaacaacgcaagcaatctcttgccctttttccacgttac

SEQ ID NO: 88643 - DNA, 1035 bp, Homo sapiens
ctttccattatagtgttattttctggtatcatctgtaaacccagtattgaagtgaaagtgttggattaatttgagaaggaaaagatgtacttatcaaacaccttatattaaattattatctattatattattattgtatttgttgaataccacatatacatatttagtcctcacaaccctaatgggacgtgttattcccattgtgtagctgaggaaactgacactcttcaaagttcagcttgtctgtggttaccagctgtaatggggcccccagtcatggggtgattctgtttgctcacactctttccacaccctatccccgaaatgaaacaacttggaactgtctccatttttattatactgttcaataaaaatttgggggttgctttggcagataatcatatgcaagctctattttccaaatatctcaacttatttttctgctctctcgaattcctccctcccctcccccattccatttccttgtgaccacatctgcttcttggagagacttgcaggatctgacacatcctcttggtttcctaagtcttatgactagccaatgcctgaaataatgaactcctccaaggcaagaaatctgttttgaagcttctctgcgtaagtattaacacttaatctattattcgatgcatttcatttccctttgtaggtatcggttttctgagcctgcagccttaggctagtacctttttttttttttttaagttagtttctgttttttatttgagctctgttagaatctttagatctatccagtggctatagtttactctgtgctgcgcctttctgctttctctctgcaaaaattatggctttttagctatatttccccaaacagaggtgaggtactgctcttatacaaatacttgaagttataaatcccacctgcattaaaaggaaagtgaagatttatgacaatgccttcccattcttctctttcaaccccaaaacctccaccatttttgaaacaaggcaagttctttagggctggaggtcttcaatggtatacaccat

SEQ ID NO: 88644 - DNA, 1054 bp, Homo sapiens
aggctggtctcgaactcctggcctcaagtgatctgcccacctctgcttcccaaagtgctgggattacagatgtgagccactgtgcctggccaaatgtgcttaatattaaagccaacacttgcccagctgctctgaaaggacagctcagttttaaaagcactatgtcctgactgcacgttacacatttttattccttgaagtaacaaggctcttttctctcagtttccaaatgctccttgacttctcaactaagtgtacattgatacaatcacagtcattttcctaatcaatgccaggttttccatccttggaggtccttgaggctccctgaggtcttctcaccttcttcttccgatgaagaacatcacccttggtcttagcagggctggcctggctccacccaccaggccatgatgccccctctcttcctgcctctgtctcctccacccctttctgttcaccctccctcttctgccctgtaccaccctggtgttctgctctccaccatctgccctggcatcaggggatgcttcctcttcacatcaattcctattacttcgactaaaacaaacccttagaccagactgttattttctttttctttttttgggatggagtctcactctgtctcccaggctggagtgcagtggtgcgatctcagcttactgtaacctctacctcccaggttcaagcgattcttctgcctcggcctcccgaatagctggtattacaagcataggccaccaggcataggccaccatgcttggctaatttttgtatgtttagtagagatggggtttcatcatgttggcaaggctggtctcaaactcctagcatcaagtgatccatcggtcttggcctcccaaagtactgggattgcaggcatgagccaagccaccgtgcctggctgactgtccttttctctggacagaaatgtcatcccgaaagtttcaaatcaccctattgatggttttgcccaaagaaaccaatcatttcatcattctgagatgccctctactgaactttttatttgcattttcttctatggcaaacc

SEQ ID NO: 88645 - DNA, 1022 bp, Homo sapiens
ggatctcagtatgaggcagggcgacggcatcaggacagggggcgaagctcggtgaagaaggagatgggcaaacgggtacgggaagtggggggctgaggggggcccggggggcggctcctgcgaggtggacaactacaccgcgacagtggaagtcaccgagctcgggagcggacgggctcggagggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcactggaggaggggcccttctctcctgatcaaagcagaaggttcaggacattacacagcttctcaggacaagcttgggaaaaactgggataggtcagtagttagaacacacagttttttacctaggggtggttagttctgatctgcacactgcatatctacttttttcttcattattctggcttgggcattcaaaagatgcagaaaaaaaaaaatcccggtaagcttaaggcccagggtaaggctgggttgcagaactaggtctctccaagggaaggaagtgggtattttaaaggccccctgcggaaagcctgcggctcccagcacattgagtgcggttctctctggagactccagactcctcctggtgccagagatgggccaggaagcagcggctgcagcagcatcttagaacccctgcatcccctctaaggatgcaagtcaccgggtgcaagcttggttcagagcttaaaaacatctccgctctgtccccggcccgcccaccgtccccttcccaccaaacctaaataaacagaggaggaagaagagatatcagattgtgttctttagctttg

SEQ ID NO: 88646 - DNA, 1078 bp, Homo sapiens
cctgggctgaagcaatcctcttgcctcagcctcccaaagtgctgggattacaggtatgagccactgcatcctgctgaatttgttttctttttcccttttctctcactcctatgaaatgaagccctacagataaaatatatgttctccactcctatcccattccttttcatccccagaggaaaccattgcagtagagaatgactatttcagtcccatcactgaattcataaggtctcttttctggtcctggaaaggtgatcgctaagggtcattttgagtgttagactggggcaatctcaccagcacagtagcacccatagtcaacatcagcagattttctctgaaagttagaatgggggttttaaagctctatgggtgttgagttgatctctttcacattctggtcatgctttttttttttttacagattgttcaacccagatgtggttaacagtttttgccacccatctcccttagggcacattcaaatgcatcttacagaataattttctctgctgtgtcagccaggcaagccgtttaaccatgactcataccatctatttgtgtaatacttaatcagataataagccttgtattgctgggcagttctttttacataagtaaatctagcctccccagacaccgtataggcacctgatggtgaggcttatagactcctccctttcctttctttccccagctactctgttaatctgtccctcagtggaagtacaaaacaaaacagaaaatgcagttgaatgggattcttcctatttaagaagtaagcactctttataaactcccccacttataattcttcaaacctctcaccccacaacagatatttaagaagacccacaatagagagtacaggcctgggttagtgaatcacataaagtcaggaggaacttttgggaggcctttgtgaacatgtgtttacttaaattatcatcacttagtatttcaaaactcacaaacaggcatctaattagatcctcgcaggaccctgtgaggcagagcagataacttcatttgaaaaaacttgtactcaaactacaaagtttcttccccacggaca

SEQ ID NO: 88647 - DNA, 1047 bp, Homo sapiens
cctaggaacagatctgtttccaggcccagttctgcccccaattaaccacatcacttcacctcttcatgctttcgtgccctcctgagctgggagacaccaccctcaagaagcacatccacaaaaggatggtgtctaatggccttctggcaccagcgctgtgcaaagcggcatgaatggagcattctcaaggttaaacatatggcacattacagccgatttccttttcattactgccacttcctctgcggtcactaatttcaggttgtctggagcttacaaaaagagacatgcaagtatgtgtgtctgtgtgtgtggtggagtgggagggaccttttgagggttcattgcaagagttagatgagaataaaacagaaaggagctaggctagaatgcagccattgctccccacttagaaacacacacgggctggaggcagatgaattgcagaactcacagatacagctttgtctgccacccactgtttcacaggccgcagagacacagcagaggcaatcccaggcggataaaccctgggtgatggcaccgatagaccatcacaatgactgtgcacagtttccgtaaccaaacctgaaaccaggcaaaccccatttcaggtgtcattaccagccccgcattcgctgccaagggtcccaagccttctaggggactgaaggccaagtttcactagcttggatgctattaccaggcaaaattaaagtggaagaattaatctgcctccggcacatgctctaggtttatcagtttgtttcagataaagcctgaaaattccacgtatttgttgtctacaattcagaaggcaaagacagatttagaagtacaatcaccggtatttcatcttagggccattgaaacctgagcctatgttctttccccacagtggtagactgcattcctagttggaggcattcagctccatctggtcgtttcatccccggttagataataccagacgtatctatgtaacatacaagccactgtcaaatagcactgagccatctccctgagacagctgtttcacacaagggc

SEQ ID NO: 88648 - DNA, 1050 bp, Homo sapiens
caaaaaaagaaaaggttaagtcagagaattggtgaaacaaaggccctctgcaactctaggcccagttatcagaacagagtggtgcttgccaaggagtcagggacagatctgcatggcgggctttaaggaggacagtgccaggcaacgcaaagtatcattatcttgtcaaatgttattcatgtgtatctgttctatcagacacttctgttttctgtgaccttggacaagatactgccagagaactgttgtgagggcaaataaaacagcacctgtcaaagtctctaggccatcgtcaggggtattgtgagggcaagatgaatattctttcatgcactgatattttcccttcttcctggagagggttgctactgctttatggtccaattctccctgatctggattggccgcatttgaaattggtgactctgtcctgggcgcagggtttgccacggcactgactagaattttggaatcccagtagtttgaagctcctatttcgtgtctctcaaagtatgaaaaaatagagaaagccttcaagtgtttgtggaatggaactgtgtcttaagaatgagacaggacacacaaggttcatctggactagccacctgtcccacacggaagtgctttccatcacttctgtggcaggtgcccatctctctcttccacatccttgtcctgatcagaagagctcatcatctgtcacgggaacacctttccagcttttggcaacaagaactgttagttacttgctatggtctgaatgtctgtgctcctctaaaactcatatgttgaaacctaattaccaatgtataaatagtaagacagggggcctataggaggtgagttggtcacaggggcagagtcctcatgaatagggttactacgcttatcaaggaggcccaggaagcttgtctgctgcctccatcgtgaggctgcagcaagaaggcgccatctttgaaacagagagcagcccttgccagacaccaaacctgccagtatcttaatcttgaacttcccagcctccagaactgtgagcaataaatttctatt

SEQ ID NO: 88649 - DNA, 1078 bp, Homo sapiens
acttaaagaagtactagtccctcattgttttcaatcagagcaaactgccacagccagaatctgttccacatataaaacagaatgacctactttcctgtgcctctgtttttatctacacagaactgtactacccgcattcctaacagccatctcctggctatggatcttgcaaaggatccaccttcttagaaaaattacttggcagtagattaatagaagtttgcagtttgcagtgtagtcactcagaaagaaaagttaagtaaaattaaaatggtttgggattaaaagcggcgcctttgaactcaggcagccctgtccaacctgctagtttctatcaattaagttccttaagcaagtgctttcttctactcagagctttcaaagaatgttctgctctacaaaatgatttatgtctttcataagcaaagttccttttgggtgaagagtgcagtcaagttgttattgtttttctgcaattttgataggaacacaaaatgaggtccctagattaatttctttattttttgaaagaattgatcagttcctcgttgatgatatcaacccaaaagctgaacccagtggcttgctgtttcccaacccacagttttcaatcttgaagcttccttggctcttcatgcccctgcaggcacagtgtgtaataattacaacttctgaaaaatgctggccaatattctggcccaagaagcagaaaaccatgaaagcaaagactggatcaaccagtatggaacacaatactctgtctgttctgaatagccagaagaaagtcacttgttagcattcacttctgctgttgctttatgttccttctatgaaacaagtttatatttctaactagaggagtttctaccctctcccacttcctacaacttttctgtacagcaagttacaaatcaaaacatatatgggtaaactgaagaggttccattcttgtccccctgtctgatagagttgcagttaaacaaaagaaattgtgcacaaaaactaagcacagtcattatctttatgacatccatgctttggaactacaagacactcaactgatgagactcaagtcatg

SEQ ID NO: 88650 - DNA, 1060 bp, Homo sapiens
aaacagctaatgtttgatgaagatgatgggtttctgcactggcttgagaggagcagtctcctttcaaaacgacatacgcattcattatccctggcttcctgctgccacggcatttaaactagtgatcttcagacagcattcctctgtccacggtcctcaccgcgaggcagccccagagaatggacaatgtgcatttgcgatccatggcattttgagaatgtcatggtggcctgcaaatgtaacagggatatttgtgatgctccatttcaactcctgttattgaagcagatagggctacctggtgcattttagtttttactaatgagtttttaacttctttttgttttgatttggaacactgaaaaccacactaaatttagaagtctactccttaatagatcaatcagttaggtgggccttgctgggttagtttttgttcctaaattataattgattcaaaaggaaatgagtcccttggcctcttacaaggtcttttaatcatttctttgcactatctctttctcagctcaattttctttctttttctcactttttgttaggttgctgtcttttatcagtctgtttatttgaaaaaggaagagataagttgttaactggccattcagtgtgaaaacaacagcctcacctttatcaccagataattaaaaaaaaaatacccctcagctgtcattaagtaatcccatctgcccgatattgctttttaagatcctatctaaatgaattacaaccagcaaaatcataaaagaattaagttagagacagaaggtattggtaatcccttcttcctgtttgacaatggatttcttttggagaggttgaaaacaatcattaacatcaatttcaatgcttatttactttacagtggttaactataaagtgacctttgaagaagggtatgttttggaaagctaagtactaaaattggcctgccaaccgttttggggatgagttttaaatattttactcagtttactgaggaactgaccattctacaaacttcaataattcaaataaagttcaactttaaaaaataatgata

SEQ ID NO: 88651 - DNA, 1052 bp, Homo sapiens
gtggactccgtatactgttaaatgtgaccaagattatgaaagtattttcttttctttttttttttttttcatggtgagaagatttttttatttgaaatatagtctgagcaacatgagtgtagccaagaggagtaggggctggcctgcctggggcagcagcctctcaaatggcacgagagcagtacaaatattccaatgtctgtgtgccccaaccccacctgtcaggaaaggcagaacagcagaacaaagacccacccacagcgccttctcaaggggtctggttcttggtgcctgcctgcctttgccttacctcctgctctgcccaggttccaaacagaggtgtgcagcagaggcttctcccacctcacccacagagacatgataagccagtgtgacaattagttctcaggactattttgagggaaaagaatcagagaagacagggaggagggccaaggtgatcaagggcctcaccaaaccagactaggcagagctctcccagagggactgtgtcagcacccctcatttccctccttctcaggatctaaaggcaggaaggagagctggtgtctgcaggaaaacagggctctgaggagcgccctggctgaaggcagcaagcgggaacctcccagaagagcacagccgctgtggggttcaagcctagttgacagcattggggttgggccacataagcagcctggggttggaaggacacagacaggagatggggtaccaagaagcagcaaaaagccgtaaataacagaagcaaattcagagctgtgagggtcccggccgaccccacatttcctggggctgggggatacccagcactggcagctcagggcagacgctactgcagggtacaaccggccacactcaccccgggggcagagccttttattttccacggtccgcacggcaggtggaagacgcttcggcaccacccctgaccatgcacactgcaaagtctccggtcacacctgaggggatggtgcgtggctgtcctggtcctgagaggcctgtggttgactgtgatcattgtggccaccgtc

SEQ ID NO: 88652 - DNA, 1038 bp, Homo sapiens
gggaggctggttcttgccctcaacatatttataacagagacgagaagagaaacgagagttagcagtaatggtgatgggaaaggaggatccaggaaaggctccctggaattggccaggtttgcaatgagaaaataaaaaggcttttaatattttgatgttaactatttactgcttatccattaaaataacatggtacttcattattaacatttaactgtgctaaaaaaaaattgcctataagatctcatttcatcaatacaacaacctgtgcatatttttctgtttttctcaggtgagaagcaggaggtcagagaaggtgagtaacttgccaaaggacacacagctaaaacggcagcactagggttcgaggtgtttaactcctaagatcaaaattatattaatcaaaattttatgatttatgtcactttgaaacctaaagtgttaagaaaattgtccacaatagcacacacacatatcagacacagatttctaaatattataggttctaaggaagtgagaatagatgttctactaaaagagcataattctttcctttttaattgttaattcacctgtataactggaaagtttagatctaagaacttcagattgaagagatgctactattcatggtcttgaaaacagtggtttgtaggttctaattctgaaaagtactaaccaagatgaagcatcaccctgcagcatgttcattttatttaataaattcttatattgtgctcctgtgtgcaggcactgttctaagtgctttttaaatgtcagctcatttgatccacacagcggaggggtggtattattattattcccattttacaaatgaggacactaaagttatgtagctcactcagagttacagctaagaaggggctgagtttcaatgaggcagttcctagggccatatcttgaccactgtttaatgctccttgtctttctaggctgtgctttgtggcacctgcagaactgagcaattatagtcccggacacctttgtgctcatcacatttgatacacttgtcattta

SEQ ID NO: 88653 - DNA, 1212 bp, Homo sapiens
atagtgatacgtactcatgaggttacctgaatattaaattaattaaaacatgtaaagcacatagaacaatgcctgggatataactaggcaaatacttagtaaattgaagatgaacaggagtaacaatatggagatccttgagttgggatcagtcttttctacccatattcaaagaccactcttaacattgactttctgaaattgttaggttccatagattgaccaggaaatgaaaatgtgactgtgttctctatatggaaaagtactatttataattactaaactttttttttttttgtaggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatt

SEQ ID NO: 88654 - DNA, 1051 bp, Homo sapiens
tctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactgaaagctctaagtttgtatgtttaataatttcagtattgtatgtgtttagtccagaagtaatatttgcatgacatcaaaggccttattcagctgcacggtagagatatcctgtctttacaagattgaaaaaaaaaaaccccacagagtatacagtatgcagtgtctgtaccctttgagggattgaagatgggaacaaagcagatatatttaaatatttggttgcct

SEQ ID NO: 88655 - DNA, 1344 bp, Homo sapiens
agagggcatgtttttcttccttaattatgctgaaaaaatcctttcctggcgttctccagtttttctgcactaacacagaaaaagcattaatatccagggaaagttcagtatattcaaagtactccttaaattattaacatccttgggcttatcaaatgttaattctctaatgtttagggtattataaatgtaaaaaaaacatatcttactagtctaatagcctggacttatgaagttcccttgtttatcagcaccaccctttaaattctctaagttgttccctaaactttcattcaaagtggcgatcacttagcatttagttttgctctgttttgttttgtttgggttggctatttagtttgtgtttttgtaacttaatccagtatctgatatctttagagccagtaaattatttccaaaagaggtagtagaaataggataagccaaacttaaccaattacaataaaattcatgagagcataactgaatattgtaaggactattatatttaaatcaatcaatgtgaaatttgtctcttgaaactcagtagtttgaatggaactgaagtgtaatggtacaagaatatggtggtagtcgtacttttcacttattctgcataaaagggtcctttttaagtcattcaaatggatatagacctatttcttattagctaggtttgggattgtcatgaacatagtgataatgagttcttgattacttttgataaacagctttcaaaggtttagaacatgatcaacaataagtgtaattgaattcttatttttactgcaaggacttaagcactgcatatagaccactgtttaaagaatttttctctcaccaaagcctaagttttaatgttccattctgtgtcagcttcctgaacagatatttccccataaagtggtcttacagaaaaggttaaccaatacaatgctaaaaaagatgcagttttcaaaaactacttttgttgaaacagagataaagcaacatgatgtctaacagtagacagtcaagttagcactacagtaatttttggttcccacacaatgggagccctgaagtaacaccagctgaatcctcagagtctttggttgtacatttaaaaagagcttccttgggaggctgaggtggtgaatcttttgaggtcaggagtttgagatcagcctgaccaacatgttgaaatcccacttctattaaaaatacaaaaaaattagccaagtgtggtggtgcctgcttgtagtcccagctacccaggaggctgaggcaggaggatcacttaaacccaggaggcggaggtcacaccactgcacttcagcatgggcgacagagagaaacaccatc

SEQ ID NO: 88656 - DNA, 1031 bp, Homo sapiens
gtgtggtgaagggcatctatagtcccagctacttgggaggccaaggcaggagaatcacttgaacctgggaggcggaggctacagtgagacaagatcaccccactgcactccagcctgggtgacacagcaagacactgtcttaaaaacaaaaaacaaaaaacgtaatataaatcaattaagataatcagttataaataaaaatcaaataaaactcttgttatatcaataaaagcctggtgtaatatctcagagtaaaattgtcctgaaatgctatcaacttcaggttaccatttagtcaaacaatctcaatgggcctcaagcaaaagtagaaagcatatgcggaaaaagtgtcaatgcatgaagagaataccctgatttctctcagctataaatctaggtttatggtcagaatcagctgatttttcacgatagtctccctgtggcttcccgccctaagaaccatctgatgctattactcactcctcagccactttaaccattttattttgcagttttctgttggagcactgagcatctcagctcaggttaaacataggtaggaagagagattttctacccagaagactgtcaaatgcaattccacaccctgtagagaaggaaggcgggtaaacagaatacgagtctgaccacaaacctgactactgacctcttcagggacaagtggttcgatcatgggggcatcctcctgcctggcggccagtcgcacgggggaggtggaaagcctcttctcccattcattcgttacggcagtgtctgttgaggtttctaagaaggttcttttcagctcgctaatgttggtttgatgtttcatcaggtcatcttgagttttttctagctcctatattcagaacataaagtatccaacagtcaatgttttacatttgtgttcctttcagctcttttgtttgctttaaaagtaatgtcaatcttattagtagtcaaaataaaacaaaattttgatcaaggctcatggcactaccacaaacactctggtgaaaatgtgattttcc

SEQ ID NO: 88657 - DNA, 1097 bp, Homo sapiens
aaaacaacagtgtgtgataagtcattgtttgtctacagcgttcagatctttcagcatgctctgtagctggttaccatgttgttggtgcagtgtgtaggttggcatttgttcccttgacaactgtgtcctttacttttccctttcttctccacttttttcagaatagtctgattaaacgaataaagggtgaaaatgtgtatgtcaaacatagtaatcttatgttagaggttggtattggtatataccagtgcatgtctgtgtgtgttgtttttcttttagtgtaatacctgtgggctcgtattgtgatgcatgaactgtgtgctcatccattaataagtggggatgacttctcagcttctgatttgttattcgctcctagatatagatcccttttcctgtgtgtatatttattttaattctctcaggatacatgtgaattgtactctttatagtttgccttctaaaattcttttggtatccatgtttgtgtgaactagatttttttttctgtttcctttccatgggaaaatcacattttcaccagagtgtttgtggtagtgccatgagccttgatcaaaattttgttttattttgactactaataagattgacattacttttaaagcaaacaaaagagctgaaaggaacacaaatgtaaaacattgactgttggatactttatgttctgaatataggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagaggtcagtagtcaggtttgtggtcagactcgtattctgtttacccgccttccttctctacagggtgtggaattgcatttgacagtcttctgggtagaaaatctctcttcctacctatgtttaacctgagctgagatgctcagtgctccaacagaaaactgcaaaataaaatggttaaagtggctgaggagtgagtaatagcatcagatggtt

SEQ ID NO: 88658 - DNA, 1033 bp, Homo sapiens
tttcaccatgttcaccaggctagtcttgaactcctgacctcaagtgatctgcccgcctcagcctcccaaagtgctgggattacaggagtgagccaccacgcccagccaattttcttgaatgtatatagttaaaaacaaatttgggaggggagaagacaaatatggggcaactaagaaagtttttttttttttttaaaagaagtcagctactattaacaacagcatgatttcttttaaaggttttagatgggacaatttttgaaatttgaaaaaatacagttatcccaaagccacctcattctcctgatttttctaatttcaaggagtggtctaatccctggactgctttctgagtatcagtaattagtaagcaggccaagccacatgtgcatgtagcagcaaagctgtgtctctcactatggctcttggactcaggactggggctttatgcccttgtgctagaagaggagacccagaatgaaattctaggtgagaaaaggatcacactgagtcaggtgccttaagaaaatcatttagtctatctaggtctccctcttcttatttgccaatgggacaagactgcttactcttcatattctacactgaccactgttgtgctggccacctatagatgggacagagtttcatcagtatcacggggcaaacaggaaatttaaacacagtgctaatgtgctggtgacacacccattcttcagtgcatagggggttcacagctcttcattttatttttaagcttcaaagcctacctatgttataggtactcccttgcatgctttaaatgttacataatacattttaaaactactgtagaagtttaaggtattattattaaaatatttttcatttatagcacacattaagattccaatgaaatttactggatgtactaccctgtggctacatgtaactaactcttataaaatcaaggtgtagctttgttatagttggcaaagaaaattaccaacttgtaatagatttatatatgattgcttaaaagaatctgcataatagt

SEQ ID NO: 88659 - DNA, 1011 bp, Homo sapiens
tttttctaaaaaaaaaaaaaatgtattatcagtctaggcaagtggttctcaaaatatgtcctaagatgtgcagagtcaatatcgcctgggaacttgttagaaatataaatcctcaagtccacccccagctcttctgaatgagaaacatgaggctggaatcctccaggtaattctgatgtaggccagagtttaagaaccactggtctagacaacaaaatacatatttaactccaactgttaaagttagaactgatctccattacaacagctcatatgtggagttcttaaacacagagccaccccacaaggcattttcggtatgccactaccagccactctcagccaaaataccaacctcagtggcagtggtctccccgtcggctgcggtgtccgtgcgctcactgtcagtctgttgaccacagaagtgatcaggttccaggaggaaggcagggacagaaagtaaaccatctggttaaacacgctctggcacaggtcagacaggtcattttctttctctgtgatttctctgtgtcacactaccttctcacaagaacacaagttcaagcaaagcaacagaagggccagagctaggtgtcatcaacagagccaactcataggaatacctgaggcacactcagcctgcaggagctggggagccacactgacctgtctggttctatgtctcagggaaaccgatttgtcatccccacacccttcctccaacttttaactaaaaacctcaagcaacatctccttaaaatgtttaatgcaaataaaattgatgtttatatatattttattctagtaatatttcatatttgaaaggtaaatgaaaatgtcaatttacagaaaaagctactgtaacagtcactggactttcagcctctcatttataccattatgataatttatatccatctagggccatcaggctgtctgcattacctgtcaattataaaaggcacatgccagtgactcacaggcatatattttttatgggaaaaacataac

SEQ ID NO: 88660 - DNA, 1070 bp, Homo sapiens
gctgtgggaatagacgggagggaacaaatgcaagagagaggtttcagaggcagaagcagcaggtcgtagagacaggatagaggaagtaattaaaagagggaaaagtccaggataatcaaaggttttcagtttgcatgattgaagccaatggagatgacattcggcaggagggaaaagggggaaaatttcagaaaaacaactgaaatccctttgaaacagattttcagggagtaactcttgcataggaaggagttgaacagagttatcaactgtatatattttattcaaggccttagacatggaataaattactcaaagagcaaggcaagttagagaaagaaaaggcccaaaactagaactctggataataccactatttgagaaagggccaaggagctgaagaaatgacagccagagaaataaaagaagaaacaggctgatggatgaccaggagatgagtttcagaggaaagtggttagctagcagtatcatatgttacagaaagggcacgcaggatgtggactaacaaaagtgtgttgaacttaacagtcaggccccatgatgacatttcagagttcagaagggcaacaggagcacctgccaggtgtgttgaggtcaggagtaggtagcagaggcagcaggtcgtggcttctgcttcctaaagtttagcagtgaggagtgagatggggttgtggtgctggcataagcaggctcagagagagctggtttttcactcctcttctctctgcttttacaatcctatttacagcctgagaaaagtgagtgagaagaaattggagacacacagactctgaagaagttgaaagaaattgatataaaacacagagaaatagatattaataaactattaatacctattcaggtagtctaggagcctgcatcatccttgcctacagaggttggcagagactcttcccagcttcttgcagcagagtgcaagctgactcttccatataacccctggcattggcgtaatatgtgcatattagttgcaggatgaataaatggatgatgatttagtcacaagccacactatgtctgtcttggct

SEQ ID NO: 88661 - DNA, 1239 bp, Homo sapiens
atgttagaagaatatgtctttaagtttcttttagactgtgctttattaataaaaccctattatgaacgtcgacttgcttctaaatgcctttaaatactgtcttttgtaaccaaatatttttcccttctatctagaacaagtatgtatgaagtaaatatcaaaatatatagacgctagaaaatttatcctagagaggctgttctacagggagaaattatttgcccacgatttttaccaagcgacctccttttcctgtatcctcatgctgccttcgttgtgttgtgcttttggttcctggaaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacaggttagaggcagaaaggtgttcatttaagttgtgccttgatgggagagtgtcccgcacacaacccacctcttcccagtactgatttcagtccattaacggcgagacgtgagcatagtgtgggtccatgcacagtaaaattctgagatgggcaagctctcactcagagcatccaggtgttcgtttgtagtgctttcttgcaaagccctttttcttgttattcttttctcatgtatctgctggtgcctccataggacttcttatgagatagcatggaactaagtgggaaatattgcagcctaccagggaagggaaaagcatcattgtaacatatttttcttctcatcagaggaatgacgccagcagaagcagagatgcatttcttggaaaatgccaaaaaattatcaatgtatggggtagatttacatcatgctaaggtatgcatctttttaaaccctaaactttcaatttaatattatgtaacttgatgttgttattactgtaagctggtgatttttacttcagttaatgtaaatgaaacctctgagaattcaaatctctgcttgtcttttaagccctactccacgatacaacaaatgtagctttctgatatttactgaggggtttgctctttgtgtctcaaacttgcattactcctgggcacagccttctgaaagcccgtgataggcaaagcctctgattgccttttgatgcagttagaa

SEQ ID NO: 88662 - DNA, 1037 bp, Homo sapiens
gggagccctttcagtgctacaggcccacagtgaacagccctggagtaaggaatcctctcatcagcaccttcagagaacttgatgaggcactgctttcaggcgactcatttgtgtgccagggagacctttgaaagaacattctttatagtctccatccattgctggtgaagagataaaagtggatgcattacagtaaaaacagaataattaaacacttggcctcacatttgtattgaaggatgaaaaaaaatgccaacagtctgtcagactctccaagaatgccagaagagtcctccatttcctccctctgtaagaattgtgataaattctattgtgaacacttagttaattaattgtggggcaacaaagtcaatgatatagaactgtggggaaaaccaaattccattaatttggctttgggctacagaaatggcctagaaaatgttgagatcgaaaggagtgggtaactgatcaagtttagcatattctatatgagggagagttgaaagctattaattggtgttcgtttctgtttagtgcagtataccataaaacagccaaggggctttaggggtcagattgaattagatcccatttcccaagatatcatttgtagacttgtgacttaggacacatttaggttaaatgaagctgatacattcattcattcattcattcattcattcatttaaatacttaatgacccccagtctgctgataatggttacttggtaggattttataagtattaaatagaaacaataatagaatacctggaatttttctatgtattttatttcttttctgtagcgatagaattggctttttatcatatttctttattgatttgatcaaacattattcatgctgtgtgagtcttcagtactcacctcctggcactcctttaaaaggcaagatacaaatatttacaggcagcttgtcttcctggatccctaaaagttcctactccccctcctttgttttctttcttgttctcaccacacgttcttacagtgactagttttggggacctgcat

SEQ ID NO: 88663 - DNA, 1029 bp, Homo sapiens
caccaaggacctccattttgcttacctcctgctgtgtggccctgtccttggcacagaggttggggtttcatggaagacagtttttccatggacgggggttgtgggggatggtttcaggaagaaactgttccacttcacatcatcagattctcagaaggaatgcacaacctagatccctcacgtgtgcggttcacattctcacattctcactcaagaatgtgaatcaaatgccacttctgatctgacaggaggcggagatcaggtggtaatgctgactcacccaccgctcaccaccactgtccttggcccagtggtggggaatccttgttgcagaataaagaaaatacaaagagctagagaagatacagatggaaacatctgctaaccttgagctaggtaactgtgggaggagtactctatttctctaggcaaggttccccagagtgaacagatgacgatgctgcctacctccaggttgaaatgagatctgtgtttgaagacatctagaaccagtctaatgagagtatacacatagtacatgttttctcatttcagtagtatatgctgttgtcctctttgcttgtttttagggacatgtcttagtaattgtaagatccaaagatgaccctcaggatgagtgtagaattttgtgacattccaccacaaaacccgtaatccaaaagatggccctctatgagaatgcagaattttttgagtatgaaactccagataacagtagaggtttgcaaagaatgagacacagtggttatacaacagaattacctgatgagtttattaaaaaggaatttttggggaccaatccacggattatcatctaatagatctgcagttggatccagacctccttatgtcccgacaagtactttggtgaaatctgatccaggtggtcccaggaccacattttgagacacactgtcttaacgacttttgtcttaatgactttccagcttcttcactattgtcaaatgagcgtttaacctggaaagaagatataatataaataaatag

SEQ ID NO: 88664 - DNA, 1103 bp, Homo sapiens
tgattggttaaattgcatactttggaattgtaagcttctattagcaccaattcttttgtaatttgcagtacagagaaaaagctgacaacttaatttttagattgctgacattttgatacattgttcttataaccctgccttacaaactaaaaacagagagagagagagagagagagagaaagcagaaaggtctatattagacctagaaaacaaatgtaatatttaacctgccttgagtatatatttttctctccagttatattgggtgggtgcttgatgaggatagggagttatttctcttcaggtttctttcccaaaccaagtaaaggtctagacacttaaagcattcagtaaatacttacgaaattgtataaaaaatggggccatttgtaacttacgctttactaccaaaaaaaaaaaaaaaaaaaaaaatcttggagaaagcttaaaaagcactgctgctttatttaaaaatgagaattaccagactcatgtatgtagtcattatttttaatggcgtggtcctcttcataacaaggttgttacctctgtctgtagctcaaattggtagatcctagaggttttgccatatcagggaagagaattctgcaggtaccaagagaaaagaagaatggtttctttgagggaagaactgcagggagtcggtttcctttcctgccagctctaattggtgtcatggaggacatcagtgtggagggtgtcctctgaagaggggagggatcaaatggtagggtgacaaaagctgaaaaggattagtgctgggagatgatattgatctcctagcattcaactaaagagaggaaaactattttctgttttagctctctcttctttggtcatttttgtacatgcctgtgtttacatcctcaaatagcgagtttctttgtatttgattcaagccccaaatttcatcatttctaaaagaaagttattttttcacatttaacatctctgaaattgggatatgtcttacatggctctcagccatgttgcagagaaaaagctggcaacttaattcattgtttgtgaatatgcatcaaaaattggacattggatgttagtggattggagaaaatcctgga

SEQ ID NO: 88665 - DNA, 1573 bp, Homo sapiens
ttaatttgtaaaccgcttttagctgaaggattcaggagctgtaggtcaaatgtcagtgtctcaatgaaatatttgcgtttaatttttaagacatttcttctgcatgaatgcgatttaggttaaaagcaattttttatcagttcatgtacactgcttggactttggacaactttgtgttgaaataaaagatcaggattttttttaacttgatcggatgcaattttatttataattgttttttaaaaactggttggtcaaatgtattaaagggccacctaggtagaagagaggcaactatccatgtactgagagatgtgatgctgttatcttgtgaatcttttctggacttatatagtatattagattaagtgtggcaggaacttgctgtaaaagtattttcttccgtgttgtatgatgtgcattcatcttttaagttagtgctttccctaaaattcacaaattagaattcatgtccactccagtaaaatagaactccaagagtagactgaagaataaatgtttcctttctgtgagaatttgagtatatataatgaagagagagactttttttttttttttttttttttttgagatggagtccttctgtgtcacccaggctggagtgcaatggcacggtctccgctcactgcaacctccgactcctgggttcaagcaattcttttgcctcaacctcccgagtagctgggattataggcgaccaccaccacaccctgctagcttttttttttttttttttgagacggagtctcgctctgtcgcccaggctggagtgcagtggtgcgatctcggctcactgcaagctccgcctcccgggttcacgccattctcctgcctcagcctcccgagtagctgggactacaggcgcccgccaccacgcccggctaatttttttgtatttttggtagagaaggggtttcactgtgttagccaggatggtctcgatctcctgacctcgtgatccacccgtctcggcctcccaaagtgctgggattacaggcgtgagccaccgcgcccggcggagagagggttcttgagtaatctaccctggccgtctttaattcccatagtctcccctaagtaccccatcagttttccgtgaaatatagactcaccattgaaacctatgaatcaaatttatctttagcaccacttcagttagagagatccttaatcgtgcaatcgctgcatctatttctttcaaacggctagctagctgctgatttgttgggaattcatcaggcactcagcccgggagggttctgctgttatttgatttgccttggctgtggggaattctgtgctcagaagcaaggactggagcagtgaagtcattgtcctgcctggtgttgtgacatcactatggctcaaaggaaacaagggtggggcaggcaaaaccagaccatctgaagcatcttgctggctttaaaactttgcctgatcaatcaatgagactcctttctcaagttgaactgcattgcgaggtattgtttggagaattgaaaggtgtaaatgaatataagactgcatgggaaaatgtgtctccaagagtaag

SEQ ID NO: 88666 - DNA, 1043 bp, Homo sapiens
acttctttaccatcaaaatgagaacttggtatgaaaatatacagagtttaaggaccaattttacatgaaagctgcggacaggcattgaaaaatcctacttaacataatttgtttaatttgtccgatctttattttaggcaataaatggctggagaacctgaagccacaggtcctctatactagcttcatttcttttcaaaaaatcacctccgtcatcaaagaaaatcaaccactccgaagtgctattcttctttatccctgttagttttgcttttataaatcatttatgataatggagttacagtttaatttagtaattagtttgcaaaggaaaaacattcagcttgcatatggaaaggatgaggaaaacatcaaagaaaatttgtttttcataatcattttagtgtaacagatgtaaatacctacttaagaatggaactggatttctgggatagttctaactgccttcatgcttatctcacccctgatacaaccagtttcttggactttctgggggaaatttatgtgaggtcaatgattcgtacttgttcaaaggttactctgctgcgtaattcagctgtcagcagaagtttgtcttgcctggcccaagattttgtggaaatctgaaggaaaaaaacaacaacacacactacaaggttttattacacagtgaactgacagatccctgcaggctatgtcagcagaagcatggggcaagagttcttgctgctggtctgaactttgcacttccagcaggttgggttgcaaagccagccctgggatagcacagggggaggcaacttagcagcattggagggaggtaggggtggttttatcctacagcaatgactgatcacctaagtttgatggtgttatctctgaagccttatctccttctctagttacagtccattaagagtctcaagacttagagcctatttttaactgcaggtcctgcttaaccataattgaacatgtgatttgttcagttcagaagcccttccccctcccaacgtcttcaaatgcctgcatattcctatata

SEQ ID NO: 88667 - DNA, 1029 bp, Homo sapiens
ttggttttcttatttgtttttttgcatgtatacgttgctagctgtatggcataatgcctactggtttggtcagtaagggattgctttcttaacaacaacaacaacacatctggtgtgcccgtcacactgtcatggcttactttctggggtgcacagagtcgcagcatcatcaccaccttccttccaccaccatcccgattgctttgtctccaccaggcactcaattatggactttccaggagtctcatctaattttcctacaacctgatgatacaggaacctttttcattgtctaatattgtggatgaacagactgcagcacagctaaacctgccagaggccactgagcagtagaagaaggggtctgtttttcatccaggagtctgattctggagtcatatccattgaaatattttcaccagacacatttccttttagccagtttaacatacttttggactcttcctggcccttcaaaggtagaattttggtgcatcccagataatgttttgccatgcacatctgaatttgtcttttatctggcagttacgtaaagttctttcatgagtcaaaactgacagttccgtggtggcaaggttggggaacaggggggattatattaaagaaatatatgatatttctgtctctagataagtgaagaactttgcacctgatggtataaacatattttaatggaatggatggtaacctaggagtaaaagtcaaactgtgtagaatctaacttttttctaaatccagacaaacccttgtacctgcaaattttatttagattttcagctcttgttattgagtgttggggcttcaaaatctaattgtgagtccttctctaataggtaattcctgctttattagtcagggtaatatggcctttctcaaaagcagagggacatgaaaagcagagaattatcttggtcagctcgtcttgcttgcctctttcaaggaactcgactgtcaagtgtagacactcatagagcctcgccgtggaagggctcagccagaatgaggctg

SEQ ID NO: 88668 - DNA, 1090 bp, Homo sapiens
gctagcccagagagcggagtctcagaagctagaccttgctcgccctggggaaacgcgggggaggggggggccttccgggaaggtgcgaacctcgcagatgaggccagagcctccgcctccatctcagcgtttcagcccctgctttcctgctttcaagtggacagtggctctgacctccgcattccggcttgtggcgtggggggcgctagcggcagtgtgtgtgtgtgtgtgtgtgtgtgtgtgtgtgtggtgtgtaaggatgagcgagtgcgatcctccgggaggcagaggcgcaggagccagttcccccagcccggcggagccgcagggaccgcctcccctcgccgccagctgcgcgcagctgcaccccggcaactccgcgctgccggctcctctcctccagctccagctcccggtacccccacgaccaacgcggaatcccaggattaaaatcatctggccaaagggtgcgggtgggggatcgaggcgttcccgaggcgaatgaggctgtttttcaaaatccgggaggcgcccctcgcccggcgttgcatcttcccgtggctcggctgtaaggacctgcggtggaggcttggcggaggcgggcccgcgctccagagagagcgtcacgtcacccgagaaggcgacgctgggggctgctgagcctcccaactccctttggcgcgtcctgctcagaagccggggagctcctggccggcggctggcggggaagcgcggcgcgggaggtggggtggcctggctggtgctgcgggagggcgccccgggcgcgtcaggggctgcgtgccgcggctggagggcgcgccgggagctgcggcgggctcggggcacccgagtggcgctggaagttgagccggggtccgcagggctcggtgaccgccctggcgccgccgctgcggattcgggagcagcaaccacgcggcgcgttcggccgccccctcggcccgccggccgcgtctttcgctttccctctgcagaagtgaagccgccgcctgggctcgctcgggctggcgacctttgcgccagaaaagcctgaggtgctggaggcgaaatcctcccgggagcgaagggcggc

SEQ ID NO: 88669 - DNA, 1093 bp, Homo sapiens
gcattggtcactttataggcattgtattatttaatctttacaacagctctatgcaattgagctcattattttaggggctaatatttagtcaacacttaagaagtcccaggcatttaatccttgcaacaatctcatgaagagggaacaattgtcctgttcccttagctgatgagaaatttgaagtttaaaaggccatgcaacttgactgaaggtcacacagatgtgagctgtggaggcctgactaaaactgagttcagtctaacaccggcatctgagctcttcaccccccaaccccgatctcacagaccaagttcatgtcaccatcagtgacagaaaagaggagccaagtggggttgggcagaggccagttacctggggatgggtatggcaggggctggagaaatcagatgtagccacagagcctgggactggagaaggacaaaagaaattagctcaacaagctcaatggccatgtgtatgtgtgcattcatgcatgcattgtgcgcgcgtgtgtgtgtgcatgcatgcattgtgcatgtgtgtgcatgtctgtgtgtgcatacatatgtgtgtgtgtgtgtgcatgtgtgtccatgtctgcctgtgtgcacacgtgcactgcttgtttggaggttatgactgtggaggtggtgatgtgcgtggtgctggggtggagagggctccacagtttctgtcctaattttggaaataggtattctgtttccatggtggctagtgcctcagagaagagtctggtggttttctttcctagagaattaaagtgcttggggacaaaaaccaaaacccgactctacgtcccaaaattgcacaggaaatttttaacatggcaatttattttgaaattttaatagtctctgcctggaattataaaacatttctgtgcatatcattaattttcccaaatggaactaggaggcctgcatggcagcccctgtcactgcctgcccaaggtccccactccaggcactcctaatgaacacgtaggcatggcacaggacatgcttggcctaggggtgttctctgccctgagcctgctctgcctgagtgagggctgggccacagactcaaggca

SEQ ID NO: 88670 - DNA, 1032 bp, Homo sapiens
ccttaataaggggtcagaaagctattatggcagagtgttagtttttttaattgtaattttcccatatgagaaaaagatctttctcttggagattccaggggacttctcaaattccctgatgaaatctgacacatgatacctttaagggagttcctctgagggaggaaagaaggccagaaggaagagctcagttacataagcagttacctaaaactaaatattccaccccaagaagctgtccagatgttgctgagaggagagaagaaggctgtgcaagggatctgcctgcacatagctgtaggaacaggcataggtgggagacaactttgtgaagggatttattgtcagagtattgcaatatctctgctgcttccccagtggtgaactctctattaattatctgaagtaaataaaccgcctgcctgccattatatgacctttgattttcatccagtgaaataaattcctttgtctttatacagtagtaactttcctgactgttttagtgactttgggccacacattgacagattccccagcttagagagacttgaaactcctgtgacagctcccttgaaaaatcttccaattcctgaaggactgagggaaagaatcttgacagggaggtccttaaccactactttgagtccctacatttaggttttactaatggttggaactccattgttcatttcaaaccctcatattaccatggagtgtgtggaggagatgggtggggagcgaggagaagaaggcatattctcagatggttttatcaccacatattagttattgcaatgttttataaccacctattagttgttgcaacaacgtttcccttccctagtgtctacctggctccagcctctgtacacggccttgtttcagttagtggataaaggccctggggtggggggcacacacggagtgggatctgggagtagggcagctgcagcgtgagatgtcactgcagccaagctgacaccctctgactgtcttcctctgctttgcagcaggaggaggtggctgagc

SEQ ID NO: 88671 - DNA, 1606 bp, Homo sapiens
tggctcattccattgtttttggagggaaattgtgtataattccaattttaaaaaatttattgtaactgagtttttggccttatatatagtctatcccggggaatgttccatgtgcatttgaaaggaatgtgtagtttgctattgcgtggagtgttctgtatatgaggctgagatagttatagtgttgttccatgttctctattttctcatgtatcttctgtctatatgttctatttaccattgaaagtgagatattgaggtctccaggtattactgtgaaactgtctacttccccctcaatcctgtcagtgtctttttttttttttttttttttttgtagtcagctatttaattaggttcttaagacatttagaacaccaatttgtgaggataaattccattcgtcagagcaaacacagatcgcaggtagccctggagctgaggaatagctttgatttttggtaaaatttgtgagtccacagctttctgatcaatcttgcgctgctccgtaatctcatatttctctttttctgtgtcgaagatctcaccttcctggtgtctgggcttccgcagcttcttcttcttgaagtaagcatcagtaagatgttttgggatttttacattgctgatatcgattttggttgaggtggcaatgacaaatttctggtgtgttcttcgtagaggaactcgattgaggaccagaggtccagtcacaagtaataagccactagccagctgcttcaggaaaaccaccctcttgcccctgtggcgtccagtgaggatgatcagaatggtcccgggggtaatgctggctcgcagttttctcacgtgctgactgaagggttttttgccgtggctcaacagctttcgaggcacatcttcagtaggatactatctaggcattttgcgaagtttaaccacccgggtaccgccgttcttgtcaccaccaactggttttgtaacagctgcaagaaccttctccttctttttcttttcaaccttggatttagcggctgagtacttcctcttctacatggcctttctggaatacatggcagatcgggaatacctgccaattcctctgacaaggacagggttgcggctgcaatggggcttccccttcttgggctttttagctttgaggttaccctttttcaccttgccaccagcatcaaccttcttggcttcgggtttcttctctttagtatctggcttctcaactttttcacctgccatcttgcaagatgggaaagagcagtgtcttttttagactcttttctgtgtgacatatatgtttacaattgttatatcttcttgatgaaaggaccctttaccaatattagtgttcttctctgtcactttcagcagctattttactcaaaccctgtattatgtattagcatagccatcccagctgtcatttagttaacatttgtatgaaatatcttttctctaccctttcacttttaacctatttgtttatttgcatctaatgtgaatttcttgtagataacgtaattaaactacggtttttaaaatccattctgctaatatttgccttttgattgtaatgcttaatttatttactttcatagtaattacagat

SEQ ID NO: 88672 - DNA, 1036 bp, Homo sapiens
tggggaaaacaagcaaataagttggtataatttggtgattaaatgcatgctgagaactaggaacacatgacttggttttctttttttcttttttctttttcttttttttttttttgacagagttttttgcttttgttgcccaggctggagttcagtggtgtgatcttggctcactgcaacctcaacttcctgggttcaagcaattctcctacctcagcctcctgaataactgggattgcaggcacccaccaccatgcccggctaactttttttgtatttttagtagagatggggtttcatcatgttggccaggctggcctcgaactgctgacctcaggtgatccacccacctcggctttccagcatgcagggattacagccgtgagccatcgtgcccggccatgacttggttttctgtctgggagtgttaggtattgaatttgggaattgtggtggatgagcagattgtggatggggagacaatgagtttgacatgtgaaatttcaacctttaggttcttgtgggataattaagtgtatatgctcagcagacaggtggctatacaagttggaagcctaggagggagatcaaggctgaaagttctaagctatttattcatgggagacttcagcatttgggggatggttaaaactgggcttggatgagatctggcaggagacagtaaagtctctatagagacagcagtggaacaaggatggaaacttgagtaatgccagctagggaaggacagggcttgggagcctgtgacggagaccaacaggatgagagcattccagaagcaaaggcagcaggctcagaatgatcagacagccacatcaaaagtagctaaatgaacaatatggtaaagaaaatcatccaccagattaagtagtgtggatatcagtgatggtctttgctattgtgggtttaatagagttgtagaggtgggagccactttgctgcaggttgaagagtgatgatgagataagaaaatacaggcagaaagtagatatgattccttctaaaagcttagcta

SEQ ID NO: 88673 - DNA, 1051 bp, Homo sapiens
tttaagctctgactcttgaaataaaaagtgaaattgaacaaatgtttattgaacctctctatgccatatgtgatattggatgctggggctacaaaaatggttaatagctggtccttaagtgagaaatgtattcatgattaatttcagctgcatccagagttccactccttgaggacagaaactgtctcttatctctgtatccttagcattttagcctactggcccagaattgacactcagtatgtgaatggttcaatgaatgaatgattgaaaaaaaaagcataagatactctgggaaagcagagaagatgtaactaacgtttagggctcgggttggtgagagaagggttaacaaaaacttcttggaggagtcgatagctcaattaaatctaaagagtgagcatgagttagtaggggggattttaagagttggaagagtgtttttggccaaagaaccagcgtaaggaagaggcgttgcagcatgtaaccacagatgctggtattgctgataccctgaaatatgagatgagggtgggagagtagagaccatttaatgtgcactttgagtaaaatgattagggtcagactgtactcagtgacatacccaatttcttcatctggattatgaggggctccattagttgacctcaagggtcttttctcatgcttagattctatttttccctattattaagttggaagtgagggtaatgagataatcctagatttttaactaaaacacatttttagacctgtgctaattttatgataacacctttctcccctctcattgaactgtacttatttaattgatctctcaggtacttttgctgtctgtacagtagcatgaaattgttacctaattttagttcattcaattactcaaagtggagcttggtttatttcaactaagctacctaagtccagataatatattagtaagatgcttgtgtttaaggttttctttgaaaaatgtagcctgtccaataagctgaactgatttttgtttttcagatgattgtgaattggcaacttaattaataggaatttt

SEQ ID NO: 88674 - DNA, 1054 bp, Homo sapiens
tggttgtattttctctgtgggaactctactgttgttatcgagaaagcaaccataaacattacatgaaccaatagggttgattgtgttctgataaaactttatttagagaaacaggtagtagcctggatttggcctgtgggccataatagtatctgactcctgttttagacagctttctactccgcctactcatgaggcttgtgtagcaagcctatcctagcaaaatacagagaattagttttccagaatacagaaagctgaaaggaacctggggttgcacctgttacaatctctcatttttaagtgaaaacactgagtctcagagtagtaacttttcaaggtcacaaggaatcagtgaagagtccagacaattcagtctttaacagattctgatggatatgagtcacattacttcaaatatagtgtcatgttgacatttggagaaactgtcttagctcatgtgttttaaaggaataaaagagaaagagaaagagagagaaacggatataggaattcatgtggtagtgttctgaaaacttaaccaggggtcagccaagaaaggatgagagttatacatttggcaagtagattgattaatgaaacaaaaaacagcactgtatattgaacactttgtctaagtctgttttaaaattatatatgtatgatgaatgaataataaataattttaactgagaaaatagagacctctagattctctgatattcagttcattcatccatttattttcttttttttttttttttagcaaacattaatcaaatatcttctcttgaagccaccatgaaagagcaaagctaatcaagacagagttcctgtgcttgaggagcttatattggagcccaggagaactgggaaccatttcttgtttagtactgtatcctctaaagaggaaacagggtttgcttcatggaggacatgatacttgagttggacatgtggatatggtgtgatgtgtgtatattggtctatagatgaaggtagacggtagggagagggagtcaataattcagtcaataattcaggttggatgtat

SEQ ID NO: 88675 - DNA, 2003 bp, Homo sapiens
tgccttccttgcattcccctgtggctgtgtgatctgcacaggagaccgtcagtcactagtcttgtgtgtcaagatggaggcaaaacatatttgtttatgtaaatgtttatgcatgcaatatgtttatgcatatttgcttatcctcattctaaggttggagataaagcttctagcacatctctgaccaatataatcataacaacattagacaaaaatgtttgagctaaaagtcaaaatcataacattagacaaaaatgtttgagctaaaagtcaatcagtgcaaacaagtgatctgatctgtttgtatgttatccattcagtaggccatagtatactaaaaatagaaattcaagaaaggctagctaaaattataggtagcaaattaatagcatatcttataggaaagttagaaatgtaaaagccagatattactctctctcctacaaatattccttggtagtattgtttgacaaaatgctggactggagagatattttcctttacccagggttttatagtctgctttgattgcatataacctgtccagcaatcagtttataggacatttgagccccaaggacccatagaaaacatctaaccttatttttcaaatgaagaaggtgagatgttaatcaactcaagtctccaatgttctaacatttctataccatttttttaaatgggaagatctcatcatgctttttcacattgtattcttaccattccttccatataatatgtggcattagagtatagcatcactctatccacagagcgagagatagcttatatgtatgcaaaaacagatttttggggaatgcttagcatccatagattcaggattgtactctttctcaggccttggtatagatgacatatttagagtagtaatataatcagtctgccctttgaaaaggagtattttaatgaaaatgagtgttctattttaaaattaaaaattagaacataattaattttcactgacaggttattctcaaatagtaaagtgtaggtagcttcaaaaatataccctcagtgtacatttaaagttcagtgaggattccaagaaggaaaaaggggtatcttcaaaatggcatttgtgatgatctccaactcagttttcttttctggttccttccttctgtctattggacttttccttttggagaaggcaacttaaactcccatgccttactgggtgcctactctcacgtgtctctgggtctgtgtgcgtggtattaattgctaacatctactgagtgcttcctataaagcaagcactattccaaatgctttacatgtattaaagcccctagggtttactcctatgaggtaggtgtttttttgcttctaattttacagatttagaaactgagatacagggtaactaatcggcccaagtgaagtatggtaatgtcagcctaaaacccaatgctgctgctgttgctttttaaaaattgtggtaaaatatacattccacaatacagctcatgcctcttagccatcacactctgttccctttctatacatcctacttcctttgcctgaagagcctcttccccaatcttcacctggtaagtactatagtccttggagattgggtcatatgttactgtgttagtctgtttcctgtttctataaaagaatgtcaaagactggatactgtataaagaaaataagtttgtttagctcatgattctagaggctgggaagtccaagtgcttggtgctgtgtatggccagggcctttgtgctgtgtcacaagatggtggaggacatcacatggtgagagggaaagagtgtgccagctcaggtctctcttcttcttataaagccacagtcccatcgtggaggcccaccctgattaccttacctaatcctaattacccttctaaggctctacctccaaatatcaccaacacatgaatttggggattaacttttcatcacataaaatttaagggacatatttaaaacatagcacttgacattatctagaaagcc

SEQ ID NO: 88676 - DNA, 1044 bp, Homo sapiens
aaatgatacaccaaagaaacacagagaaatgttaatctacgtcaggttccacatagccagctcctaatattttccctttgtcagatttttatctcttgtaaagaaaaaaaaaaaatcccaagaggtgaaagagaaaggaaatgcttttgtttttcaactgtgaaactggagtttccatgacctcattgtgaggccatcgctcttcttggaggtattaataatttgtctcttgttaaagtgcagcatcttaatttagggctcagtgacttaggatgatttagaagggatcagaaaacataattttaaagactggaaaatgatggccatgaggaatatacatggaaattgatattattggagctggagtatagaaaggcaaaattctctgtgctaattgcatcaacaagaagaaaatattgtcccacttgtgggcacatacaaactggttctctacgggggtgtccacccctagagtgaactgccagccctggcaacagcagttgctccctgctagcagcgtcatagatcacaaaataaaatagtgctgtctctttgtaattgtgtaagccataacatttgctgtataattttcttttctgatttaacttgattttctgtccttgaaatttcctagggttataaacataattggtgattgctaagacaagaagccaatttttctattataagaaatagcaaagtaccttccgtttttgaagccttgcttacaaaacttaaaaaaaaaaattccaggcatctgggaaattcaaattcataaaataatgtttaattagaaagtaaaggaagctacacttgtagaacagagtaatttgattatattttaactattaaataattttcaaggtggtcattattatatgcacttaattgacattagattatattaagaatttaattttagctccctttacaaattggccaatgcccattcacccttggtagactaataaggtttctactgagccgtgttttttattaatcctcattgctactctcagataaaagacacgaataggaccaatg

SEQ ID NO: 88677 - DNA, 1058 bp, Homo sapiens
tatttatctccaacagaggacttacactggaaaaaaaaagactcaacaataattattgctacaggctttagcagtcagacacaagatgttacaagctaatactagatttgatttgctaatgttttgctgaggatttctgtgtctatgtttgtaaacgatgttggtccataggtttttgttctggtaatgtctttgtacagatggttttggtatcattataatcctggcttcttacaatgaattgagaagagttccttttacctcttttctgtgcaagtttggtttcttccttaatgtttgatagcatattagtgaagccatctgggcttggagttttctttgtgggaaggttttaaattatgaattcaatttctttaataaatatgggtcgatctcatttcttcttctgtcagttctaataaattatctttcaaggcatttgtccatttcatataagctgttgaatttcttggcatggaattcttcaaaatattcccttattttctgtttgtgatctgtaggatttttaggtacacggctctttttttcctttccaacactgcctatttttggctcaagctgagctataaatttattaattttacttatcttttccaaactctgctttttaaaaatttttttctattgtttgcctgcttacagtttcattgatttttgctcatcttaattatttatttgcttctatttacttttgacttaatttaatgctcttcttttaatagcttccgtaagatggaagcttagataattgattttgtatctctcttctattttaatataaccatttattgctataaaattccctctgaggattgctttagctgcatcccatatatattggtttgttgtcgttttcttactattgagttcaaaatattttctaatttctcttgggatttcttctttgacttttcaggatatttaaaagtgtgttgcttaatttccaatctttggggattttctgggtattaaaaaaatcaatttctaatttaattccattgtggtcaaagaacatactttgcatgaattaagtcctt

SEQ ID NO: 88678 - DNA, 1047 bp, Homo sapiens
tagcttgtgtggttcctgacaagaagtttgcagttattcttatctttgttcttctgtatgtaatatgtctgttttttgctactctgctgctgtcaatattttctctttatctctgtttttcagcaattacatcattatatgcctgtctgtggttttgtgttatctttcttcgagttcactgagtttcttgaatctgtgatctatagttttcaacaaacttggaaaattttcagccactatttctttaaatcagttccccgtcccaatccccatcctagcactccagtaccacatatgttggactactccatgtcatcccataggtcactcagactctattcaatgtttccaaacttttgttccctgtgtgtttcagtttgagtattttccatattttgtctccaaatttattggtctcttgttctgcagttgattaatgtgctaataattctatctagtatatttttcatttcagatattttgttcatttccagaaagttttattttcttatctcccatttctctcctcttatttttctttttaagtccttaaatagttgagcatatttatgatttctctttttatgtccttatgtgctaattccgccacccttgactctgtcatttctgagtctgtttttgagcctcattttcttgcttctttgcatatatgtagttttttagttaatgctggactgttattttgttgttgttgttcagtgcaaggttttattgcctttcttttaaagttttgttaagggaggtctagagtagactttacttaggctgatttagtttcactaaagtgagagacttctggggttttgagtaaaaccccaggttctcaacaaagactttctattctgattggtccaaagtcaaatgcctcccagccctttaggagctctgggaattgattaacttatggaagatccttttctggggggtcaggggctgctctatgaagttgacgctgcacatgagtgacttaatatttagcaacaaatgcaaggagacccccatatggattaattgagctctttgtct

SEQ ID NO: 88679 - DNA, 1050 bp, Homo sapiens
aaattcatttttgttttgttgcaaagtgtacataagcagtaattgcaggctttgggataatgtgttctatgatatttgttccttttagtcatggacataaatgatcttctcttacaagactgatttttgtgttttctgtagcatcagataaatatttattaaaatatgatatatgggctcaaataaggatagaaatagcacaagaccctgtaatcagtaacttgaagttatcctttcatttgtgaaccaaatactcagtgctgtcttgattaaatctgtcaataatctgggcaataaagcaattctacaggaaaaagctgaccggtgcattggcatccccagggtaggatgtcagagcttttgggtgcttccaaagtgttgttacgttagatgaagaaaaaagacttgactcttggatggcagtttccacaattcatccccaccttcccctgggatcaaacatgctcgtcacaggcagcatttaagccacatctgataaccttctatagttgagctctcttgctccacatagactgatatttgtcaagccagaggctacttgtaaggtgagaaagcctggctgctggaagctgttaaaaaatcgatatcagacttctttagaatctttaattattcaattaaaaaatgcctccagcccttgggcagctgagtgaaggggagagggaagaggtgtgggaggtggggggtggggagccatattgccccagtgtttgaaaccttgaattcagaaaaacataaagagaatgaagacttgtgaaagtcagtcagttttgtttttatttgaccatactctgttcttagagattctttttcatcagcccaaatctgtaaccttcaggttcaataattatgaaactcttctccatattttggaactaaaatgtcttcattcagagtgagcaactttaaatctttttttgttttgttttatttttatttttatttttgagacagggttttgctctgtcacccagcctggagtgcagtggtatgatcatggctcactgcagccttgttctcctgggctca

SEQ ID NO: 88680 - DNA, 1066 bp, Homo sapiens
ttcttttatcatctgtaaggaatactccccatttgagtccctgcatagttcacataaatgaaataacacagattccagattacctcagcaagagtagtagaacactttttcatatcattataacttttaaaaaagaaacagtggcttagggctttgaatattgatttaactgttcattcattcaagaggaccaggtgtgtcactcaaaatttaactctttcctcactccttcctggcactataactcagtggtaaagatagctccatcactctgggttccttctttccacctccaatgcatctttctacctccaacaagtccttctttggcccaggggtcccttagatcagcacagttgcttcctcctctttgcttccttagtttgtaagcacctgggacttggattggcatctgtgcatacttgcaggaattgatgcgttgactgtggtcctgggcccctggtatgttgtaacccttattgtatgataaacgactaagccaaccagcaggtttgagaattccaaggaagtgggtgcagttgagaaactgagaaagggattaccgtgcctgtgatgtataaatgagtttccatgtagatatgagcactagactgagatggacattttcaggctttacttagttttccagtggctaataccatacggtgatagtgcatgaaattagttgagttggtcaatatctgcatttgaaaaaatgaaatagaaaaggaaataggtcagagtatatcacacataatgagactgtttcatgaaacttttgttacatgtatgaggtatgtgtgtgtactgggtagagatctaaattgtgtttcttcatatgggttgacattaaacattttttggaaaacactccctgaggagatgtctgtttgaaattaggagaagttctattgggaggaacaattgggagggaggtttatgtctttaaatgggagaagaaacgtcagttgaacaaaacagtattttgacgtggagtgaccagcgtagtgatttccagagttattcatttgtacaagctaaactgcaactagacattagtcctatt

SEQ ID NO: 88681 - DNA, 1094 bp, Homo sapiens
aagctccacctcctgggttcacgccattctcctgcctcagccttccgagtagcttggactacaggcacccaccaccacacccagctaatttttttgtattttttttagtagagacggggttttaccatgttggccaggatggtcttgatctcctgacctcatgatccacctgcctcggcctcacaaagtgctgggattacaggtatgagccaccacgcccggccaggcatttctttatagcaatgccaggatggtgtgccagactgtatcagagacaagtgatacaaagatgaccaagatacagtacttgcccaggaagaagaattcctgtggccacctctgtcttatatcaagagataagtgtgaaacagagtatccacaacagtgtttgggaagacagtgtgagtggctcccaactctaccaacaaaggcttcaaaggagtaatgacatttgaattgagtcttaaaggataaatgtattacttggcctgacaacacagaagaaaaggtcatttttgtcaaagaaatcaaccttgaaaaaatgccgcagttcatgacttgtaccagtgaaggtagcaaggtctgtgtgttggtgatgaatttgcaggggatcaggctgaagaaacaagacttgggagagaggatgtgagacctttttatgacatgcatagagttggcacctcagcctttgcatggtagggagctagctgaaggctacctccatgacagatgtacactttgaaaagacaggccgggtgcggtggctcacgtctgtaatcccagcattttgggaggctgaggtgggcaaatcacttgaagtcaggagttagagatcagcctggccaacacagtgaaacctggtctctactaaaaaaaataaaataattagccaggcatggtggcgcacacctgtaatcccaactattcgggaggctgaggcagaagaattgcttgaacacgggaggcggaagttgcagtgagctgagatggcaccaccgcactccagcctgggcgacagatcaagactccatctcaaaataaaggaagatacagctaatctatatttctttcaccagagatcaccaccactaaca

SEQ ID NO: 88682 - DNA, 1092 bp, Homo sapiens
acacactgtgttaataagacaaacatggttcctctatattctagtggggaaaatagacccccccaaaacaaagtaagcaaatgagtgcatgaagtgtttattattgatgaatgagaagcagggaaccccgagagctgagacagcgaataactggaggaatgctacattagagtggcctggaaagggatcccccaagaggtggcatttacattgcaagctgaatgatgagaggcatcttgctgcagaaattgcttggggagaaagaaggttgcaggaagaaagagcagaaagagtaaatttcctaagggaagaaagaacttggctttttagagaaactgaggaaagattagcatgcccagtgctaatgccgtgggagagtgatgtaaggtaagactagcaaagaagttttgaggacagaaggtgctgaaccttgaagtcacagaacagaattcacatttacttataactgcaaggggaagctacgtgtccccactttgctcccagtaactctctccattgctgtgcaatgagacgtacaatactggctttggctacttcgtggggtgcatataaggatcaaatgatgtaatgcgtatgacagtaactcgttatgtataaacctctccataaaataacagataataaaggcccatagagtatttcatagtaagaagtatgtcttttaaaaatatttttttggaatatacttaacaactaaacttgtggttacacagagcaagctgtgcataaacaaatgcaactttttaaaaatatctgttatgtttacaatgttttgtgggagttctgctaccagttaggatgtagactagtttgtgacagactaccgttcccactgtagcagctagaaaaaaaaaggaataaatataaaaatctatattttaaaaactatgttggagagctgtggatacaaagaagtctgaaggagccaagttccagggaagaagaactcttgtgacataagcagagccaagtggtcattacctccctgggcatgtctgctccctgagtttctgcagttctgggccaaaggtcatacctgtctaggtggagggactctaccgggatgaggag

SEQ ID NO: 88683 - DNA, 2304 bp, Homo sapiens
ttaaagtagtcacattgggtagttgccaaggcggctcatataggcccagttaacctttgcatttgtgctaacagtgtcctagaatagcactgtcctttagaactttctatagtgatggaaatagtctacttctgtccagtatggtagctccagatacatatgactaccaacactttaaatgtggctagtgtgagaagttgaatttttaatttttcttaatcttaatagatttaaatatgaacagtcacatgtagcttgtagcttatgtattgaataacatagttctagaatcttctgccatatataatgatataacttatggtaagtgcattttgagttctgagctatttggactttcaacctagtgtaaacctgtgtctttctggatggtgggattgtctacagctgtaactgagtaaaggtgacttccacaatgtgaggcaaggacattagctacaggtgtcctgaccaagatgcctactgtagtaaaaggttgccttgctggtttaaattctttgggcctgacatttttgtatttttcatctgaccatccgtatcagatgttcttattcagacatcacccagcagcatcatggtttatgatcagcaactgtggtccttatgtctagtggcacttagagttctttatgctatgatactgcagcagtaccaagggatgattttatgggaaattgggatagactccacaacaacaaccaaataaatgaaggacaagtaacgtgtcttgtgggttttgaaaaggctattatacttcttaacaatctttttgaaagtcttcagggactttctacttgagaagcagtactcaaatgctttgttttagttagattcacattaaccagcataatttttttttttttttttttgagacagcgtctcgctctgtcgcccaggctggagtgcagtggcgcaatctcggctcactgcaagctccgcctcccgggttcacgccattctcccccctcagcctcccgagtaactgggactataggcgccagccaccacgcctggctaattttgtttttctatttgtagtagagacagggtttcaccctgttagccaggatggtctcgatttcctgacctcgtgatccgcctgcctcggcctcccaaagtgctgggattacaggcgtgagccactgcgcccggccataatttttttagattaagagttagtgcaagtttctaagtcagcctcccccttcacttgcattttatttggtgtttgaagaaaggaaagaggaaagcaaatatgaattgtactatttgtactaaatcttcgagatttattgacaaatttgtttcagggtggtatattagaaaaaggaaaactttgtttcctaggctgaaggtctaattgattaatacctttgacttatgatgatcattcctgttcatttgacttatgatgtgcatttgacttgtcatgatcattcatgttcattcgaaattcatctttctaatggattttctttcaaaataaatgaagagcaactctccttctttccacttttaagcattcagatatggcaagctcagatgttctgctgggttctagctggagcactgggatacccttctgttctggtggcttctttcttcctttcttgtatcccccgaagtggatcccaaagatacacagtacctagtagactccagctggtgggagactagaaaaactgcaagtgggtgatttgctattactgtaaataaaaggagggcctgagcctgggaattcttctgaaaacaaaaattccctgggttatttttcagttgtgtccgggatcatcttgagagggtcctaaaatctttgcatccatgctgcctttctcacttctatttccagatgcttcagactttgaattttgcttttctctaggaaactgcatttctaggcttttcccaaatcctccatttactcagtgcattactagagaatgcataactgttctcttcagatttcctaagactttggacttctagtaatgtaaaaacagcaaggtaaagggtattttttgtgcaccttcttctttcatttagaccacgaagggaaagatatagtgctcagttcctcaaaatgaaatttcttttgcttcactgagacaggcaaatggaataaactggtgtctaactcctggaaagaccaaaagagggcctaacagggtgcatttgtggtgaggagtgaggaatggcccagggttcttccttccgtctgccttcctctctttcctcccagtcctgctgctgaagtctcagttctagagagaattgagaatggggact

SEQ ID NO: 88684 - DNA, 1054 bp, Homo sapiens
atgttttttatgtgtatcaatttggaggaatttgttaactttggtcttctcagctgagctcactcagaaaaatcccagaggtttgatgacgtggcttaactaccgtcttaacccagaagttccttttacccacaggataaattcaaaaccttcatcttgatgttgaaggctctccactatgccttagttctcaggactcactcatgcaaactctttaccttcagatgaattcattcacttggtcttaagtaacagaacttgtacttttgttttgtcaaaaatttttgtcattccccctcccgtcacccccactgcgaatccccattcattgtctctgagcaggagctctgcagggaggatatgatagaccctccacagaagacagtgagagaccccatcagatgaggcaattgttttccagtggctggttgatggaaggcagcagttagcacaacagccactcagatggaggtggcacattcaaaggttctgctggggcagtttttcctcaacccctgtccatttcgagaaacaaggagctgatgacatttacatgcatgacacattcctaggaaatccctgttgtttagggagataatgctgttagccccacataaattaactttgctgttgtgtttttagatttttgtttatggtattgttttgttgcacagtgatcatgtaagaggaataaaataatatgagtgacttttatcattgattaacttactaataactctgtaggttatggcataaataggctgagggttacccacaatatctgacccactgactgtaaatcagctcttactttcccattcaagaccaggcattgggatgcaaatgagtgagagtgtctctgctttagacgtcatctcaaattcatctcacttattaatgaaaacaaagtcagtcattcacaaagtctggtaactgttcgaataaggagtgacctgcagtagatcttacacagttgtgctattcccttgtgactggggactcgtgccctgaggacttgcccaggatcctttatcttccaccacagcttgtggca

SEQ ID NO: 88685 - DNA, 1005 bp, Homo sapiens
gtagatttagaatctcttgttactgatcagtctgcagaaagagttatagtaatcagatcttaaaaatggttaagaggcatgtataattttagagtggttaagagcacgaacttgagtcagtgccgttacttacgaggttgatcttgggaaagttgtataactgctataaatctctactttctcatttgcatgtcggaggataacgttgacgtcataggatggttatgaacatttaacacagcattcaagtgccaggcaaatatatatatgcttggtaacttattgattcatgtcatcattgttactgtttcatatgtttatgatcatatagaggtacttattctggtaatatatcattgctttctagttttttgagaaagttgaggaatcaggtctggaatctgaaggaatttttcgactttcaggatgtactgctaaagtcaaggtaccgaacattttgtctcttcctaggtagagttctaagctagctagacccagttcacacaagcatcggggatccagatatttgttgttgtttattagatattatcacttggtccttcctagtattccttggtacctgtggtaaaatgtttgttccagagttttttcatgatccagaattttaaaaatcaaaacggaaacattaaaaaaccaaaaacaacaatgaaatagcacatcaattcaccatcaaaaactgctgcttgcctttagtttggaaaaaatgaaatagcacatcaattcaccatcaaaaactgctgcttgcctttagtttgtaaaagttgaaacgtctcactgctgttttggaggttaaacaccttagtttgttgtgctcctctcagccgtggaattcactaagccaatgttatatgagtctttatttccatcattcgttggtttaaacattctttggctctccctttagtgaaagctcttacaggaatttgtagcaatggctataaccactagaatactcactcagcagttccaaaacccagttccact

SEQ ID NO: 88686 - DNA, 1119 bp, Homo sapiens
catctaaaaccagctgttcagtgtgaatcttattcttttgctttcttacttccatgaggtggcaaactctacagtacaataaagcaaagaactgttagaaaagaaaagcttttctcataaaaatccagcaaaacatcccactgtgtctgcgggtaggcatacaccatggagagctcattcctgtggttggatcactccctgtcttgcagatgtgaaaacctgagcagttttaaaagctggatccctgagcaaacagtctcaggggcaggggaaaaccaatgtggtaatgtttatcaaaaagacatttgtagaggcaaaacagcatctcttcattaattcattttggtacatgctttgggaaattctatttgtatcagtatcagagtttttatatagaagtgtgacgagaggtttttctaagtggaaactgagaatagataggctgcgtctattggatcctccagaaagcagatgctgagatgggtgaggagcggaggagagtcacggcggttctgcttctgcaggatgaaaggggcaggaaccaggattggctggggtgaggctctaaccacggtgcaggtcagacaattcctaaccatggaggagccgtgtgctgggcagaatgggcaaggccctggtacccatgcctcaccccgtcgtgggctggggcttcctgcagaaaatatggctgagccacatccagaaggggcccacagctgggagagtcggctacctgggcttttgcacgtgagggcaaggtcttccgtgaagcgaggtcggagcagggcaccagggcatcagggctccgggcatgttgaggggttacggcttccctgagagtggagttggctgaatgctggcacaagttcttgtggaaggcagggaaatgcccaacggctccttaaggtttatgctttctagggtgcatctgctttctgtctccgtttctcgtgtgtttcgttcttacatactcttctaaaaaaatgtatcctacaagtaaggatgaaaaccattacttattttggttaaatctttggttatatctgcagagtcagagaaccaaaatgaaagaaagaaatttcctaaacagaaacagattccatctcttgaaacctctgt

SEQ ID NO: 88687 - DNA, 1033 bp, Homo sapiens
ggtttcctaagtaaaatgaaaatggattatttgccaaattaaacttaacttaaaagagcttcttaatttctctgaagttaatggaaacacagtggtcccaagcctacatctgcatctcttgtttttttcttccccagagttgtttttttttttttttaattgcgttggaagattagagacagtcctcagcctgcagtttatgcactaacattatgtcttgtctgcccctaaatgctttgcactgagacttgctcttaaagtttctattattcaggcaagctcacagcaatgtgtatttgctcttttcagtaacatcctggacctgcgtcattataaatttgatacaagttatccacaaatctacacatggatttttcttcaacaatatgatcctccctctctccccatattgcttggttgtatacacttgtcatctactcctgaactctagcacgcacagctccagtaacctactagcttgtcacaagtgtttccactgctatacagctcagttaacttcaccagcagctgactgccttccagccattgaatagaaatagattttccttcaacttgagaactccccagagattccagaacataatgctttcctccaagaactccccaccaagacaccattttgaagaaaatacagagggacaaaggaaagcctagattctctggtgtattctaaattttcagcacagctggtcgtggattatccagctgtggatggaatccctgagtataaatgccaaccctctggcgccatcttgtgtcattactgaggaagaaaatactcaacaatctccaaagatccaactacagtcatcaccttccctaagtgtccatggaagatctagaataagtgtcatagatcataaaagtaagagcaaatatgtagaaagataactatgtacaggtactgatttaaacactctacatgtattaactcatttaatcctcataacagcctgtgaggtagatacaatgactattcctattttacagataataaagtagatgcaacagg

SEQ ID NO: 88688 - DNA, 1051 bp, Homo sapiens
ttgaaatgaaattgagataaggatgagttgaaaagagatggtaattttgaggccagtaaacataatgctgaaaacaaagatggttcttagtgctgcctcttatcagacatttcagtgtggtaaggaccttcctcctacacagcgaaaatatctatgtcaattataatatatgtcggtcatattagatgtatccttgaggcaaggacagagatcagctatgacataaaaatgtccttttctaatataattcaataatttttcaaaaactgaaaatttattagcttgttttttcgctttgtctacagagtgttcttttatcaaaaaaaaattcatctgttatcaaatatctgagtcaaaatgtcatctaccctttcatacaactgaggatgcagcaattatcaaataattcaatacatttctaacaaaaggtccccccagaacatcacgggactggtgaggatgttacacacatgcactgtctctctctctctctctgtctctctaattttttattctaaattgtgactggagctaggattgcagctggtgtgggttagaggtcaagaactctagctgaagaattggttcccttcgttcagatcctggctctgccacttaagctgaacaaagctgctcagccgcactccacctcggtctcttcatctgtaaaataataatagtacctacctcacagggtttggaataatgatgagtgaatatatataaagtactaagagtaacgcctggctcacagcaaaccctcaaatgaatgttaactattattactatttagtgctgtttttctcattgcaaatactgtacagtggaattcaaacttggaaaaccaaagagcacttcttttggggatttcagtcgtcttggtgaatttagtatttatactttgatagcacagcaaacttatattaagctttctcaattctttattttttttaatgcttagaagacctgcacacaaacatttgcttttggccagctgtcaatttcaaagttgaaaagcaatagaaaaatagcacccaaaaattcaattttt

SEQ ID NO: 88689 - DNA, 1027 bp, Homo sapiens
ttttaaagcatattcttctatgagcacaggtcctcctagtgaagcttagtttgacaaagggtgtcatatgctttcctaacctgatttgtagttaacattcacagagcctacattttctcattacggttatgatgctcagtatctttccaagtgccaggcacgggcttccttttctgatcaaacataccattttttatatttcacaactatagacagtcacttctgcagtcccaatttaaaaatgcagaactgctttatccaagaatgctgaaaaatactgttctatccaggtttcctaaactataaaagcagattttgcttttgtttgttaatcataggcatggccgagcattgtggattagcctgaggcttaaaatcagatgcatgtctggtaagatgaccactgtctcactatcaagagcctgcagagccattttccagacctgtgattgcccagaacacatagtccccacgtttctaatttggagcaaatctaaaaggtgctgagggattggacagctctgactttcctcgagactatggatatagtccttctcagattagctggaaatggggacagagttctcatttatcccagatatatacattggcttttttggaatctatagattgagattttgatgaatttatattggttttaatgagacccaaatgactctctcttaacaattcaagcagtagacaaagttgctcacaaatacagaaaacatctttttgtctacttcgcaagtctcaaaacgtgataatatttaagcccatttgtagaagaaatcttgtatatactattattacaccttgatatctatacaaaacatcacttgtattaaaatatatagataactttctggcatttagaattttgttccattcatttaatttgttcatctgagaatttttttttttgcctgaaaacccattaaaagaaaacgtgccttctgtataagtttatgtttattcctacattttattcatttttaatgtatgggtaattggtggcacatgactt

SEQ ID NO: 88690 - DNA, 1048 bp, Homo sapiens
ggctcaccgcaacctctgcctcctaggtttaagcgattttcctgcctcagcctcctgagttgctgggattacaggcatgcgcctagctaatttttttgtgtttttagtagagacagggtttctccatgttgctcaggctggtctcgaattcctgacctcaggtgatccgcctgcctcggcctcctaaaatgccaggattacaggtgtgagccaccatgcccagccatcatctgaatcctttaaaaggttacttttcaaaactattttctgtttctcctagttagctctccttttaaacataatgctgcaattttatctactccaagagcttatacaaatggactgtgttccttaaatacacaaaaactcaccaagatatttgcttttaggtcttgttccatgtcaacaatggtgctggcaggataacagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctggtatgtacgggtacctgctcttccactcaaaaggggcactgtccctggaggaagtcttggttcaggtggatgtagaatagggattgagaaaggtacatggtttgggtgacaaatcctttaccattttagaaaggctatttcaaatatctaagaattcttggataacttaaaataatctacatacacaagttaatcattgggtaagactgtgagaacattgggtctgatataaaggcagccgtatgactctaccgaagtaaatttcatgactgtcagacttgggagtcattttagggctagggaatcgttttaggaaacaaacttgtgactcatctctctggtcaattttggattagaattatgtattttagatgttccaaggaattgttgcaaataataaacacctgttgtatgactttttttaagttataactat

SEQ ID NO: 88691 - DNA, 1140 bp, Homo sapiens
atctttgttttaaactgtcaactaaattcctcccatttcgggaagggactgttatcatctttgatttaaagttaaactatccactaaattcctcccatttccagaagggactgttatcatctttgttttaaactatcaactaaattcctcccatagctaggttgaattagcaaagacagcttatgaggttagaagcaagatagagtcagttatgtcagattcctcttgctgtcatttttctatgtcagatttctttcactgttacagtttttgcaaaggcagtttcatacctgcctcctttcttctgccaggctcatccacttttcgtcaccaactgtctaaaaatttgaaccttcctttagcattgcattcaggttgttatagctctcagaaacagatgttgcatctgttaaagtttatacatctgttaaaagttttttcagattcctcaaaaattatgcatgttttcactttgctgtaggtcaagacagactatgttaaaagaaaaggcttcataactgtcgacggccgagagtctcccatggtgactgtggtgggagatggaaccatgctggatgtggagggtttgttctacctaggaggcctgccctcccagtaccaggccaggaaaattggaaatgtaagcagcattttccatactgacattttaccttcgttgtgttcgtgtttattttgtagaagagcatacctcacggcatctttatgtttaaattaccttgtttgaacctggggcttgtgaagaggtttactttgcaggcatgtccacagatcgtgtgccagggccgcccctcagaacccgatcagtctttccagcctgttagttaatgaacatctccctttccgcagccacgtggccacagcacaattcagggaagcccagcaaatgcatattcgcacattagtaaactcagcattttttgatttccacaatatttcactaaaataatagaaaacacttccactgcattattagcaaagatactcaaatggtagctctaacttagacattcatgtgaagtattgtggcaattaaagttttaaaacaaaaagattacattttaatgtgttttgctgagaccagtctgatgaagtggaaggaaaatgtgtccaaacccttcc

SEQ ID NO: 88692 - DNA, 1048 bp, Homo sapiens
gagcttctataaggactcattatcaatttacatttagccaggaaagcatgaaaataagtacttcatgtaaagccattgtgcacatatttgttgctttaaaaaaaaaaaaagattcaattcattaggaaaagccagttctggccaaatattttgaatggcagccattgctatttttcatgttctccccttttgctttctctgtttccctggtttaaagtgtgcactctaataatttagaagatggcagaagcattcaagagcaggaccttctgagcagggcgaggctttgagttcggggcagttttcatggtagcatctgcctgtgctgaagcagaaaacagcatctgggacccccatgacttgggcactcttaggacagcccgcagatggttgcgtggggttcaggggcccttcccgcctggctcctcttgtctgcatcctgccctgtcagtgtggacctaggttcacactctgaggccctgcaaaacatgtcacctgtgggcacctccagttttccagtgcctggtccgcagctcgtctcggcagctgcatccttagggccattcccaaaacctcgggtcacggcgggggcctagggggacagcaaggcctttgccccttaagcctgatgaaaatttgtaggagagacttcagtgtccttatgaatttcagtgaagccgagtgggattaaggtgacagacagaagctctaagtgctttcttcagggagataaagcgctggcgagtgcatcatttaaaccgaagatggagtgagcgccaacaggcactggtggttgttgctgttctaatgggattgcttcgtagatggcccttcatggcggaacacgcgtgtgtcagtggggttcgggctgcgggtggcggctgagtgtccctgtgtgtctcttacaggaacagtgtgtggtggatgcagctctggagtacgttcccggcgctcaccagtttggtctcacacaaaacagccatttcatcttgccttttaatcagtcggctgtcagaaagaagtaggtatcattctaacatccttatgc

SEQ ID NO: 88693 - DNA, 1064 bp, Homo sapiens
caggcacctttacagcaaggccccattttaactccctctgtcctaggccctcctttgctgactggacctgactgatagtaaaggaagccgctcctactggaaaagcccggggctctggcaagagcttgctgtcctctgcatcgggagccagcttaggcctttctgacagccagcaggtgtccaggtcgacttgctcatggccaactgcactgttgaaatccaaaagtctaggtagaaacaagagagtgttttcaaaattaggatatcacaaaccagtccatgaacccaagtcatctgataactgtacaatgaaaatcaattaaaaaccatgtatatatttctcttagagtaaccaaagtgccaatccttcactgtgactcagagtccaaacatgctatcttaatatttcttgtctgaagcttctgcttgcaatggcacccagcctagcatatccccatgtcagaccctggccattcctgagcaccccccaggtcagctccgatgccatcgcctcctcctgcagccttgactgggctgcctcagggacacgtttttgtctctagttcccaagcgctgcacagtgacctccacgaaacactgatttcttgtttacgtgcttccccttgccaggaggttgtgggctacgcttgtcacatgcactttcactctgcagctcctgtgctgtgtcctgtgcctgcgcacgtccccctggcactttcccgggcacagctgggaactccacagaaacgtttctgctctaccgagtccacaaacccatgactttcaggagcatgaggatgcctcatgaatgaatgaatgaatgaatgaatgaatgaacagacaactgggggaataaacataaacctgtgcaaaaatctaaaccagagctctgacattatgattgtattcaaacccaacgctatgttttattcttgcaaatttcagggactcctaagaggtaatttcacagataaggacactgtgaccatgaaagatccaagtctttgtccaaggtcactagacaagtcagtgacccagccaggagggagcttcaatttcctgat

SEQ ID NO: 88694 - DNA, 1012 bp, Homo sapiens
tgagcagttcattcctccttgctcaccctctgcctctggacagggtgctgatgggacacaagctgtgctctgctctgtgggaccagcatctgcccaggaacacctggaagtgccctgggcatcaggaaattgaagctccctcctggctgggtcactgacttgtctagtgaccttggacaaagacttggatctttcatggtcacagtgtccttatctgtgaaattacctcttaggagtccctgaaatttgcaagaataaaacatagcgttgggtttgaatacaatcataatgtcagagctctggtttagatttttgcacaggtttatgtttattcccccagttgtctgttcattcattcattcattcattcattcattcatgaggcatcctcatgctcctgaaagtcatgggtttgtggactcggtagagcagaaacgtttctgtggagttcccagctgtgcccgggaaagtgccagggggacgtgcgcaggcacaggacacagcacaggagctgcagagtgaaagtgcatgtgacaagcgtagcccacaacctcctggcaaggggaagcacgtaaacaagaaatcagtgtttcgtggaggtcactgtgcagcgcttgggaactagagacaaaaacgtgtccctgaggcagcccagtcaaggctgcaggaggaggcgatggcatcggagctgacctggggggtgctcaggaatggccagggtctgacatggggatatgctaggctgggtgccattgcaagcagaagcttcagacaagaaatattaagatagcatgtttggactctgagtcacagtgaaggattggcactttggttactctaagagaaatatatacatggtttttaattgattttcattgtacagttatcagatgacttgggttcatggactggtttgtgatatcctaattttgaaaacactctcttgtttctacctagacttttggatttcaacagtgcagttggccatgagcaagtcgacctggacacctgc

SEQ ID NO: 88695 - DNA, 1049 bp, Homo sapiens
actggggcccagcataaattgtctttacattggattgattctgtggcaaatagtagtacactattagtaaatagtattatatcaatagtaaatagcattatatcaacattcctgtatatttccctccaaaatatagactgaatgctttaaaagcacactgggcattttcatcataggtaaagaggttaaaaaaaaaagaaaaagaaaatctctccaaaaagcaatctcattcaatggatatttaataacattccattcgtttctgaaaaatcttcagttgtgagttttaattttcaagattcacctttttggtcacagacagtgtcttgttaaaatgaacctttagggaacttttattattcagtgagaacttgtgggaattatggactaaaatggaattattatttcattatgtttaaagcttttcatttattttctccattggtcttttagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggagtaagtgtacctgctctctgcatgttcttgcactttctgacctttcatggtgagtgctaacactaatctgaaatctcattgtactgtttgagattgaaaactttgcaaattcccaaataatgagtgaaccccattgttctatcatgtaagtctccccagatggattttattggattagaatgttagacagatctggtcatcatactttaaaaaccatcgctgaacattagctctctgtggctgtccataaagagccgggattttaatatatttttgacatgcatttgaaggaacatagggattttgtgatgtaagtctcttgctgtcctgagagcattgctttgaaggagctgtttactatggggctactagcagcttcaggttatcaatggcttccccaaaaacaatta

SEQ ID NO: 88696 - DNA, 1743 bp, Homo sapiens
agaagaacaccaagtagaaactagccttctagtctttatagatatcaattcaacatttgttattaaatttcgagctcaaataatatgtcttgttctgggttcactgtgaccaccgtgacattgtttgaattccatccatgggaatttcatgttcttgtttgcatctcatgggctggtgatttctgtctttcagtcttttggttttattttttagaacgggccccttgtcagtctcaatgaaaaagatacgaggagattccacttctcttactgaattgtggattttggtaacaacagatgacatttcatttatattagtgtagtgttctagaaagccttcgtgggcatttttggtttcgtagccgatagacctctggctgtggggccagatccagttttctcagtttgactttagaaggtttcagccatccctgacttgaagggaaagggaaacctgggataaagctataacctggggaactgtgttctcttttttacagaaagactttttatccatcgagctgtttcgtggcagagtgaaggttatgactgacctgggttcaggacccattacccttttgacagacagacgttataacaatggaacctggtacaaaattgccttccagcgaaaccggaagcaaggtagggacacagatggactcaccagatgtcggtcaccctcataagaatagaaatcttttcaaaatcagcattctttttttccacagtagtttcctgggtattgaatgatagtctacttggaagccagtgttgtctttggaatactaaccaacaggattcacattttgctggaggagggttatacttgtatttgcctgtgatttccaagtgtgttatttaacagtaaatgctggattggaatcaagaatcaaatccattctgttttcttccacatgcatactgctcttatttagcaatgtgtattgactttgatagagaggattttcacttgtccttcaatagccaagaacattagctgatcaaattcgcagaatctaaaagaatatgcatttgtaaatgagctttgttgccagaagtttgcattttaccttaacatggaaagggattttccttttcttatctcttgcctgtgctctccttttaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggtatattaaactgcagaattttcatgtcgctgatttccaactttattagcttgctagggctgagaatggactgtatcacaaaccaggtggcttaaacaacactaatttattctttcccagttctagaggctgcaagtccaaaagcaaggtgttggcagggcttgcttccttttgagggctgtgagagagaatctgttccatgctcctagcttctggtcgcctcagggattccttggcctgggtcctgtgtccacatttcccctttttataaggacaactgtcatgttgcataaggacttcccctaatgacctcatcctaacttgattacctctgcaaagaccttttccaaatgaaggccacattcacacataaggaggatcaagactaccacatcttttgggaggacacggttcaacctgtaacatctgcttctatttattcagagtactctatgccatgtgatttgagaag

SEQ ID NO: 88697 - DNA, 1002 bp, Homo sapiens
tcaaaaaaaaaaaaaagttaggaccagaggtttggtgattgtagccttaagattgaaaaagaatatagggtttggagtcttgagtttctcaggcttctggcccaggtcccccaccaaaattttcttccctgactttggataataagtctcttcacctcactgaggtttggtttctttttccagaaaagaaaaatgatcatcgttcttgtcttacccacctctataaatcacagtgatgaacacacaacatgatgcgtgtgaaaatgctttataaactggaaacactttaccagtcttcaccactggtctcctacagtgatgtggctttgctttgtagataaatgtcacaggatttttttttgacaataaacgtgtgaaaaagcatggctttgtaattggcagctatgataaaaaatgctgttgcctcgtgaggtaatgacacaccctgctctggaacttcagtggaaagagcatctgaattcaggctctctgatccgccactttttccttattctgtgtttccagcaaggaactcttccagcaatttagtaattctaacatgaaaaacaccccgacccctagactctatcccctccactgaccccagatcattaacctcactgttagaaagaaaaatggttaacagaaattaaacatttctagtatgaaaaagtccccctactttacctgtgaccatatcctctattttcatcagtcatttccagaggtattttgaaatcattgacgtcaagctacagcactgaatgaattgaatgatttccggctcttctttttttgttgggatgaggaagtcagctttttaggtggtcacatgttttgttccccttgaaatacctggcctgcctccggatttccacacaccctggacctttgggtcaaagatgctgccctcctgccaactcgagactggctttttgacggagggctggccacccagctgagtagtagaaccacattgactcatcagctcaaccaaactag

SEQ ID NO: 88698 - DNA, 1013 bp, Homo sapiens
tctagctctagttagtggtcaattaatactaatcagtgtttagcaaaaaagcccaccatatttattttattatatcagttctcctctcaccaaatataattgtgttttttggatctggttcaatgctctgaagtgggagtctaggtctcaggtccagctgggccctcactaccaatcacattctctggctctctgttttctcactcgtacaacacgattctctccatcaaccctagtcactgagatgatctttaagatcctgcccagttgttactcattctaggattccacttcataactgaaaggaaatccagtgattacaaactggcttttttctaatgtggctctctcaaaatttggatctgttagattgaagctcccagagagaagttttgtgcacttggagaatgtattttgcttggtcagcttatatattggttatgtttgtttgcttgtttgcattagaaatctcctgctgtgaaggttactcattttaaaggctgcttgggggaggccttcctgaatggaaaatccataggcctatggaactatattgaaagggaaggcaagtgccgtgggtgcttcggaaggtaagatgtcgtcacggtttagcacatagtatgttattctgttaacatctgagaagtgctgaaagaatgtattaatacatgcacgtcaaggaatagagtttgtgatatcgctggtaggtgtttagctgccaattacaaagccatgctttttcatacgtttattgtcaaaaaaaaatcctgtgacattggtataatgtagattataccaatctacattatattattatattatattgtcagatgatataatgtagattagttactgagagaagcacaggtatcatttttaaccctttaaaaagaagtgctctttttcctatgtcttttatgctttgatcatggatcataaaccctaaacgtttcagacaatttctcaaacaaccttctgtctcagagagccacaaccaaatctttataaatcac

SEQ ID NO: 88699 - DNA, 1016 bp, Homo sapiens
ggcagccaacctggtaaaattcctcaggagagaggtgtaaggtgtggcatggtagacattgcatgtggctggcagcacattgcacttaagtcaaggacagaaaataaggatgcaagtggggggtgcattttcttaaaattcaggcacaaagcaaaattcttctttttaaaatccttcagaggtaatcacttttgagcagctttaagtgtatgttttcacttttctataatattatggtttgttgggatttttttaatttacaaaatgggataatatttacggagtagacatatcttcagatacagtttagctcatctcagatgttttaagcagggacacaacatgatgaaatttctgtttcggaagagacactcttgaagatttcgggcagtaggcaagactggaagccaggaggccagcaggggggtgctgttgcagggcccttggggagaagcagatggtgggtgtgaaggaaacgggattgtatgtgcgctgactggaaattctgaaaatttcttttgcaattctttgtaacccttagatttggaaacattggttcactgagtgtaaaggaaatgagctcaaatcaaaagtcaccaacaaaaacaagtaaatcccctgggacagctaatgttctggatgtaaacaattcaacactcatgtttgttggaggtcttggaggacaaatcaaggtaacattacgaaagttcttctgaacaggactgattgactgattttacctatatataaaagtcatgggccgggcgtggtggctcacgcctgtaatcccagaactttgggaggccaaggtgggcagatcacctgaggtccggagttcaagaccagcctgaccaacatggagaaactcttgtctctactaaaaatacaaaattagccgggtgtggtggcacatgcctgtaatcccagctactcagggggctgaggcaggagaatcacttgaaccctgggaggtggaggttgcagtgagctgagatcgcgccattgcactccagcct

SEQ ID NO: 88700 - DNA, 2044 bp, Homo sapiens
cagacatgaaaggaggtggaggacatgtttcatgaagctgagaaaggagtgatggaaaaggacccaaataaagaagttcagcttattaagatgtaagacacagctcacacagcgattggccattacttttgtgatctcattgtttattgaaatcatattccagagaagtattaacaaaaattatttcatttgtccctaaaaggggatagtagagcatatgatatgcagctttaatattgccattagaaacaagaagctcttagttcattgaccactgcccaaaagaaaaaaaagcaaacagacaagcctcagtttgtgttcagcatcagtaatatgacaataatatatttctgtgcgaaattacatttgttgtcgttttattcttttctctgtgtgtaagcaccagaagtgcatgcttttatatacatttattttaggtataagagacaagggagccaaaaccaaagagctggccacgtctgcaagccagagcgcggtgagcacgctgagggacgtggcggggctgagccaggagctgctgaacacatctgccagcctgtccagggtcaacaccacattacgagagacacaccagcttctgcaggactccaccatggccagtatgtcagcgcccttccttccagtcatgatcgtctgcgtcatgcagacgtggagctagctaagcacacagtggtgcgtttttcacaacattcctgaaaagtagaagtatgctaacatctggattagcctttattaagagaaggaccttgggaaatgcatgctacttgtgcagttttcatctttgtaccacaatgtcatggctttgattgttagggtgttgttttaccaagtgcattgttaatggacaattaattatcttgtttttccctctccccaactttcttgccaccccttgccttcttgtatttgttagctctgttggctggaagaaaagtcaaagacgtggaaattcaagccaaccttttgtttgatcggttgaagcctttgaagatgttagaggagaatctgagcagaaacctatcagaaattaaactgttgatcagccaggcccgcaaacaagcagcttctgtgagtttggggccccgtggctttcgtaactgggctctcagtcatgtggggtcccagggaattcatgcagacatggccctcagtcacactgcgccccttagggcttccaaagacccagatcccaataatctgggcttcctcatagccctgtcttggtatatttaaagccaataactagcttcattttctttgagttctgcttttgttcaacatgcttcaaaatgttgttagcaaagagatttccatgtctttatggagatttatcattatagactaaatttaaaactattagcctggacagtgcggaacatgtcaaatctacgtgttaacatcactcttaagtttatgggttgcatgtggtgttagttcttcgttttaccaacttagttttaataatccaagtattccttaaaatgtttgtgtagtatgggcctcatccttgaggtgtctgagaaaacagtttgtatgcaacgaaggctgcacaaatccaggtcactaaatgcctgaggcactggacacctggagcagttcacacatgagaagatgttttacccatggcacatggcactggctgtgccctaagggaaaaagtttccttttgagagaatgtgcagtcgtcatgtgattggggacttcgagaggatgaatgcagcctctgggcttgcatttgtccacctgaggctttctagggaagagaaaggagcacagggctctgtcttttccaaaacctcaagtgtccttgctattggaaaaggaatgttggtttccatgagctctggcttgcatctgtttcagttacaattgctaaataaatacaggctgggcctggtagctcacacccgtaactcccacaatttgggaggttgaggtgggaggattgcttgaggccgggagtttgagatgagcttaggaaacataataagatcctgtctctactaaaaaaaataataataat

SEQ ID NO: 88701 - DNA, 1875 bp, Homo sapiens
aaaactggtaggcatttatgatttttgtgagtgaattggcaagtttgatttagtttatcataacgtatctaaatatgctgctttgatagtggccttgaaaacatcagaaatgtgtccctgaatgccaccagtgcagcctatgtccattacaacatccagagcctgattgaagaatcggaggaactggccagagatgctcacaggactgtgactgagacgagcctggtaggaaacgacgtggcttctttttctgggctctgtgggagatttttctgtaccgggtttgagcagagattcagtggccccaatttctgcctattaacattcttttctggtggaatctgtttctggcttctgtcatcatatgatctgtgttttaattttttaaggtcataaatacttctttatacagactagaaaccagtgtggagatgagaacaatctcacatttccttgcgctaaaaatgatgatgctacttgatacctactggagacatttttctataaccatggtgaaaatctttattgaatggctggtttccttccttatctacttaaaaatgtctttgttttctcttgcctcagccattttaaattgtccctacctggtacctggctgactttcttgctgggaatgtgtctgggggctactctgatggagtcacttcctctgtccccagcaggactccaccctgccctgctctcaccacgcttaagtggttctgttttccagctctcagaatcccttgtttctaacgggaaagcggccgtgcagcgcagctccagatttctaaaagaaggcaacaacctcagcaggaagcttccaggtcagtatgtggctcggacggtgtagacaggcagagtgagcgtgagcgtctcgctgagcagcctctaagaatgttctccttgcatgcagcaacttgaagcttagcatttctgtgtcccatttatattccaatttcctatcatataaattttcctatcgtataaacttcctatcatataaacttcatataatttggcatttttattctagtgatatctgttcctttattgtgcagtcatctctatctttaacctgtccataatcctccactcattgccttagcttggagccttcactgttcttcctagtgtctgttgggttatctttgattgcgtgtgctcctctagtttttccttgaggagatgtattatgcttgatatttcttttacctttctcatggaactaatatcatattagactcatggtaggttctcatttaataatcattaaattaaatcctaattgatttagccatttttcaaaaaatacctatgcagtttagtttgtcctaaagtttcaagaaagaatgacttggcatatgtaagagcaatccatccaataaacatgaaccaaagtggcagcaggaatctgttatgtaagagaaactacgtaggcctacaattttttataacaaataatgtgctttccaccttaatatattctaatagatcaaaaataccaagatttctggaggagtaaatagtgggccaggcacacagctcataccctttacaggtgacttacttccgagtctaacactggatccttccacagctgtctgaactaaaggcttggatatgtacataatttttttttctcattgagtgacacagtttaaaatttatgttgtcatctcacagtatcgaaaatgtataatgtgttgatgggctgtaatttcagtctgtacaactagaggtacttcataggtagtgaaattgggagcttgctggcaattaaaatttcacgttttaaccatgtgctcaaaatccaaatgtgattgtatgttatgaacagaaattttaaaagtaaaagctgtgatcaaacttgag

SEQ ID NO: 88702 - DNA, 1032 bp, Homo sapiens
aacgtaagcaattaaaagtgagccctggcctggctgggtggctcacgcttgtaatcccagcactttgggaggccgaggcaggcagatcatgaggtcaagagatcgagaccatcctggccaacatggtgaaaccccggtctctactaaaaatacaaaaattagctgggcgtggtggcatgcgcctgtagtcccagctactcgggaggctgaggcagcagaatcgcttgaacttgggagatggaggttgtagtgagccgagatcatgccaccgcactccagcctggcaacagaatgagactccatctcaaaaaatgaaaataactttaaaataaaataaaagtgagtcccatgcactaacttctgcacgtagcattaggcaccaaaggtcagaagcagggttgcttttatgaagcacccttaaaatgccgtttctgctgcaggataaaaagctgcatgttcaagaagaacaaaatctgacctcagagctcattgtccaaggaagaggattgatagatgctgctgctgcacaaacagatgctgtacaagatgctctagaggtaaattacatctcagcacagccacagtacagtttttaaagaatcttcacacatcttttctatatgcacacatatctgttattaagtagatgtgcatatatttacaatattaatttctccatgtagcacttagaggatcaccaggataagctacttttatggtctgccaaaatcaggcaccacatagatgacctggtcatgcacatgtcccaaaggaacgcagtcgacctggtctacagagctgaggaccatgccgctgagttccagagactagcagatgttctgtacaggtaggaacacgcctttgtgggaactcaagagcttgcagtctattgatcggagaaatagatggatgtttctattcacagtgatgggtcactcttcctttgtgtaaaaatgagcactcctgttttatttacctggcaagttggatttccttgtgtctgctaacatagtttaccattggcctacatat

SEQ ID NO: 88703 - DNA, 1225 bp, Homo sapiens
ttgagaggctgcagatgagcatcacaggtagtgtgggcagtgtctagtttgaagtatctgtgcttatctagtaagaagtcaccattgctttattaaacatatgaatagatgtatatctcttgcatcgggtttccggaaccagaggggctggaatagtttggggatcctgagatgtgcaaactttagtctttgactgagagttttagctttaaaaaaatgcatatttctttttttattttctgcattatgcctaaaacttagatcctaattctcaagccctgttatggtaaagttagtatggtagctctccatccatttgcccagaataggagctgacaggatttgggacttcagttaggtaccaagtatatccatcacattagaataatttaatcacttctcagttgggtgtgctgtggcttttagcatactattttcagttttctggctaccagaaacatatgatcgctcttctttttatattatagtgtaagggcttaaaaagtacagaatccaataaaaatcagactttatagggcaaaaggtaaggaaattattagaacaaagtatacttaataaaaaaagtaggatcaagcattggtggtttatttatgcagtaaatatttattgagaacatttatttttcatgtgcagatgtctctgccaggtacaaggaaatgctgaggttgacaccatgtccttgcctttagggagtttattggtgcatgagaagactttgaaatagaccagtaatcccaagttcatgaatgtttagttaggggatgtgcagagtacactgggatatgccaggtggcctggcctgacatggaggtccaactcagcttaggtaaacagagcagtcctcagcagagaagtttctaagttcttcacttggtactagccacttttgagaggcttattaaataattgatgaattttctccatagaaattatggaaaagacaactttaaatcagactttggatgaagatttcctactacccaattctactcttcagaacatgcaacagaatggtacatctttgctagaaatcatgcagataagagacttcacacagttgcaccaaaatgccacccttgaactcaagtaagtttctaattactgtgtgcaatgcaaccaagtagagagagaaacttgcacgctatctccaaaggagaaggaggcatcgtggaagaaaagtgctcactggaaatgaaatatccta

SEQ ID NO: 88704 - DNA, 1034 bp, Homo sapiens
ctttaggtgcatccgttctccagttctgccttacttccttgcctttgcttccctggcttgccttcctcgcctttcattacagtcaataaagttcttttcgtcagcgtgtgttcacccctcttccccctgctgtttttcatgcttgctcatagttgtttcaactctcttaccaccttatcacttagtaagcaaagacccttttgcttactgggcgccactcttggcctcagctgtttctttctgtgtgacctctgggaagttacttatctgatctgagtcttggcgtcatcattgaataggggcctagcacttcctgccgtgccacccatggcacagttggagtgagaatgagatcagatgtggtgcacggggtcttggagtgtactctgaccgcatgtgtcattttcacaaaacaacttgcgcaactccatgaaaaaatgggcagaccacatcgcattaactttaactctcctttttaaaaatttgtcttgtagcctgtgatgatgagtgtgtaggtgtgctgctgaatgacttggatgagattggtgatgccgttctttctctgaacctcactggcattatccctgtcccatatggaattttgtcaaacctggaaaatacaactaaatatctccaggtaggtactggaaatacagagatgaacagacacttgtatcattaagggatatagtcattgggaatggtgggagtcattccatgtgtcctccccacattgtgagagcccaacttccatcagcccctgcgggcaggtgtccagtctttccttgactgtgaccagtgacaggcacttacttacttatctcacacgctagcttgtttcacggtgggacagctctcatcatttcagtgctctctggaggactcctcatcaatgctgccctctgtggccctcattctgccttttgggataaggccaagtccacttgctcttctgtaagacaactttgggtatttgcaaacagctgccctattagaaaagcagaaaataggccaggcacggtggctcacacctg

SEQ ID NO: 88705 - DNA, 1293 bp, Homo sapiens
tttctgtgctgtttgaatattttacttctgcaatcataaaaaggttataaacatccccaaagtccgcattaataaattaaagtttgtgctatcaggaagagattgtcaggttgtgaacattcttgtgtgctctgaatctcagatgccctaaaacacacgctttattttctacatattttgtttccactgaagtctatccctttactattttaaggaggaaaaagagtcggaagtggtatggggctgataactgacgctggaaacttcatcttgctaacgaaaaggaaccagacttggctctaactggttttgttttttattgttgtctccagtagtttgcatgcacccagctcagcctctagatggcacattggtaatttaaaacgtgaaggcagagggtagaggatgttgagaaaaaggagtaaaacaaaagcagaaatccatgaatgaggagatcaaatcccagtcgatgattaaactttgagaggctctgtcattttgcttatggcagcctaccacataactccctgcctgcctttaggtgcatccgttctccagttctgccttatttccttgcctttgcctccctggctttccttcctcgcctttcgttacagtcaataaagttcttttcgtcagcgtgtgttcagccatcttccctctgctgtttttcatgcttgctcatagttgtttcagctctcttaccaccttatcacttagtaagcaaagaccctttttccttgggacactctcttgttgggtggccaattagtgataatccctaaggtcagtcttcttccacttaacattcacatgattgtccctggacagggtcttatgaatgtcttttggatacaagatgtgtgtgcacttactgattacttttattttccttctttttgccaggtagattgtaagctctaaaaagctatgtgtaatcacataactttgagaccagtatggtgtatcctaagagtaatgaataagtaccttaaggaaagatggaaattgtatatctgaaaattcaaaaagaaattcttttcctccagttttagtcccacttgtgtcttggaaggggaccacgatttccgttgtgacgcctgtctcctgggctatgaaggaaaacactgtgaaaggtacatgggtggattgtcatgtggaaatccctgggcactctgtttcttttataaggtattgggcatatttactatagtaatctgggagccattatcaattatcagtttggatgtgcttgattgaaataagacctcattactgttccagaacaagttt

SEQ ID NO: 88706 - DNA, 1004 bp, Homo sapiens
tagtggatgaatgcagccttaggatgaatgaaagccacagagcgggaaatgttttcaggattttaagaatatggaggaaaatgctcccctttcctgaagaatatttttaaaagctagctgatataaaacgtggcagtgcttagctattaccagataagaatgatttctaacaatttcccattttttcccccttcctttaaatgtgggctcccagaactgtggcgataacacagcaggtgaccattgtgatgtgtgtacttctggctactacgggaaggtgactggctcagcaagtgactgtgctctgtgtgcctgtcctcacagccctcctgccaggtgagtccccacaggggcagctggcatgctgggctgcccagggctgcttccagttcagcctcattttcaagggtctctgagtggtctgttgttaatgaatattctccattggttgcaaaaggctaattttaagaaaaggtgttcattctcaaaagcattggaagagaatcttttcaaaagcaaagtatctgttttggtattggatgtttggatggaagcaattaaagaaaggacttttaggttttgttttttaagactcattttagcccacagcatatgtatccaatctgcatggagataaattgctattaattttattgataatgatacaaaagaacccaattaccatttaagggaatggggttagagtttatataagggaatggggttagagtttatataagctggtgcctaagtgctgaaataccacatggtgataaaattgggactagtttctaccttgtacttatgatgcttgtacagaattacctgaatgcaaaagggaaccagaaattttaagtgggaattagaatatcaaagaatcctctttggatcaaatgaaaattataactcatcaataatattttattattgcttagaatatttggcaaggtattgaacatacaaagatcaaatgttaactcttggtatactgcaatgaagtattc

SEQ ID NO: 88707 - DNA, 1042 bp, Homo sapiens
acttgggaggctgaggcaggagaatctcttgaacccaggaggcggaggttgcagtgagccgagattgtgccactgtactccagcttgtgcgacagagagaccgagcaagaagaccctgggatcaaaattccagtgagattagcaagatctccaaaaacagtttgaatttcaaattctcaagaaatgtatattagttttatgtcaatttagtgggcactgcatcttaaattctttatcttggcgtactattttcaacctgcatagagatagtggtacaggagactttggacttgctcagatttgggaagtgtttattcttccagcagatgtttactggatgtttgctgtgtggctggcactgccttaggtaatgcatatctattgataatggaactgacactgcgcctgtccatggaggtttcaggaggtctttgtcagttacactcagtggcatgcacagaacatggctcatttctggagaaatttataaaagaatttattctttataagttttatgcctgtcagaatttggcctctgagcttaattgaatgtgtttctcattctacagaatttttggaaatattttaactctgtttctgaaaaacctgtcacgcgagaggattttatgtctgtcctcagcgatattgagtacatcctcatcaaggcatcgtatggtcaaggattacagcagagcaggtacttggagcttctagaattttgaccgttattttcatatttgaaagcaaactgaaagaatttgactcacttcacttccattacctactatttttattaatccatgtagttcagttccttaccaaaacattgttaaatattaatatcattatggaatgtgcgaattataacttaaagtatccacctagcatgctaatgtcgatataaaatataaggacataatgttggaatcttagctgaagataaaatgcaaaaaaaacaattgctgtttctgcacatgaaaactgaaatgcccatgtcttcgtagtgatgtataaagaatgctgtcacctactcatctcatac

SEQ ID NO: 88708 - DNA, 1591 bp, Homo sapiens
aataatatttatcacctggccggtggctctcacacccagggatcatcagaatcacctggagactcgaggcggcttccagagttgtctcgggacattctcatcagggactctgtattttccaaacacttccaagatgattctgttaatcatctgtgtttgagaatcactgattggatctttgagaaaactgacactcagaaagctccgggcctggctagaggaaactaatgtttgtgcatctataattatgtttaaaattatgtttgtgctctattttgtctctgtttgttcagaaatcacatctcttttttaggcaaaaacgagtcctttatttgctcccctgtaggaaaatgtctttggtcctcagtgcaacgaatgtcgagagggcaccttcgctctccgcgcagacaaccccctgggctgcagcccgtgcttctgctccgggctgtcccacctctgctcagagctggaggactacgtgaggaccccagtaagtcacacacagcgaaagtgttctgcttctaaccccactcccctgggaggtgggtgggggtgggaaacacagccaagtgttcacattaaattttgctcttatggcatccaaaattctaggaagctaatttgggttagaacaggaatcagagctcagcttctgctggccgaggaagtaaatggagcttgaactaaaggctgtccatgttgttccttagctaatctatgaaaagctttcattggagagaagatagaactgcaaaatctcagccgtcttctgcatatcattgaacgtttccccagcgtagcaacagtttggccctaaatggcagtagtttaaagcactttcagttcattttcttccagatgtttagtttaaaggaaaagtctttactgtttctgttttaataatgaagctgtttcatctgtgaaacaatgatggaatctaaagaatgaaactggagtggaaagttcgcattttgaagtgcactttcccctcctttcgtggtttaggtaacgctgggctccgatcagcctcttctgcgtgtggtttctcagagtaacttgaggggcacgaccgagggggtttactaccaggcccccgacttcctgctggatgccgccaccgtccggcagcacatccgtgcagagccgttttactggcggctgccgcagcagttccaaggagaccaggtgaggtgcacgcccagccgagagccagtcggtgcttcctaggatatacagaaattgtttaaaatcaccatagtctgggccggcctgtcatttaaagaagtagttattaatttcctcttttaagtgggatcagagaagtttaatgctcataaaagtctcctcaaatatatggttccttaaaatttttcattaattttaaaagttttttaagttcacgttatattaatttggttcttcctaaagcagtcattcaacagacatatacagtcatgtgtcacttaacaatggagagacattctaggggaatgtgtcattaggtgcgaaagttattattataatctcatgagaccatggtcgtatatgtggtttgtcattgactgaaatatcattacgtggtatgggaccc

SEQ ID NO: 88709 - DNA, 1082 bp, Homo sapiens
acctctgtatcccaaagtgccataattgcaggcgtgaaccactgtgcctggcctgatttctacagtaatttcgttagacttgttttgacctagtagatttaatttcagttcacaattctggccccgtgcgcatgtgccactaagatgcacagatttccggcaacacaatgcctgtctcctgttggcacatggcaacgtgaatccatgcagcaatagcaagagagagatggttcatttgtagaacttccccacatgtagtgttttcctgtaattcaaatatgtgtgcatttggaagcatcaaatctgcctttttaattgagttggttttcccttctctcaggcctgcaattgcagtctcgtggggtcgactcatcatcggtgcgatgtggtcaccggccattgccagtgcaagtcaaaatttggtggccgggcctgcgatcagtgttccttgggttacagagactttcccgactgtgttccctgtgactgtgacctgagggggacgtcgggggacgcctgcaacctggagcagggtctctgcggctgtgtggaggaaaccggggcctgcccttgcaaggtatttaccatccatcctcctctttcatcctgtctctggctcctcatcatgactcctgggctttgactacttacctaagcagccaggttttggatgcttttcctagtgagttcacactcccttccgcatctgagttcaaagtctcttatgctcctctagagtgacggatgatttttgaaattgaatttttactgttactagtgtcagttgatggaactgatttgaaaactgccctgaagttttaatcatatatcccagaggctgagtggctgcgtatcttgagtatgcaggtgaggtgggtttctcagggcttcgggatttgtgatgtgatccctgtgaggttattgggctcccgtatgtgctggccacattgaaggaaatcggggtttattattttcccaagaggtaagacttcaatgtcattataagttttgtgtgtttccgttagttttcccaatgtgctttgctattaggaggtcagagccacctcctctggtccttttcc

SEQ ID NO: 88710 - DNA, 1100 bp, Homo sapiens
agttttggtcatggctctgccgcctactaattgtgggagcttagattcattacttaactttgcttggcctcagtttcctcatctgtaaaatggggatgctaatgagaatctgcattgagaagttagtgtaagtgttctatataaagtcctcagcatggcattgggcctgcagtaagtgcttagtaaatattggctccctctgtgatcacctagtgagggctttttcactcttttctctatttcccctgtcctgtccccatttccccgcttccctcagcatctcctgagatggagggccggctacctccatgagacatggaggggtcttgggaattgtgaggcgtcttttaggagtgagaagagtggcttggactcttaataaaagggaaataacagcatcagctcttagccctttaatgacatcacccagatctgtaacccagcattcatctttatttcagcctgtgactgcccacacactcagaatacctgcgacccagaaactggagagtgtgtctgcccccctcacacacagggtgtgaagtgtgaagaatgtgaggatgggcactggggctacgatgcggaggtggggtgccaggtgagcactgtcatccacgctcttgcttaactgagagttgctttgctgtagcaagtttcaggcctgttcttctatatattttctggactttaatctgttgaatagctttgtgaatttaaaaaaaaaaaaaaaactcaatgtgggccaggcacagtggctcacacctgtaatcactgcactttgggagactgaggcaggaggatcgtttgaagccaggaattcaagaccagcctgggcaacaaagcaagaccctgtctttgcaaaaaataacgattaaaaaaaaatttagcctggtgtggtggcacacgcctgtggtctcagctacttgggagactgaggcaggaggatcacttgagcctagggattcaaggctgtagtgagctgtgatggcaacactgcacttcagcctgaacaacagagaaagactctatcttaaaaatcaaaaacaaaaacaatacaccttaatgcagatgataggaatcaaagtggaagacaggacacc

SEQ ID NO: 88711 - DNA, 1020 bp, Homo sapiens
agatatttttcattaaattatgaaatataatattaatatgtacttatttagattacgttttaactgagctttaaaatattgaatatgtacctgattggaatcagggcaaatggctaagttgattttgaaatctccattgcatgtttttcatgggaatttgtagctcatttaaaatatgtcgaggaagtcatgaaattggtgaagcgaattcgctaattattgtcttaatagcttcaatgtgtttttcctgtgatggatccttccactaaccctgtttcagtttactcttcagaaaaatgctaaacttctaaagttattgccaataatattatttttagttttgtgatttgaaacattgaaagtttacattttttttttcctttggggatgacggatcttatgataaccatcctcagaagtgagggttaatatgtctttgtgtgcatgtgtttagcctgtgaatgccatgtgaaaggctcccattctgccgtgtgccatcttgagaccgggctctgtgactgcaaaccaaacgtgactggacagcagtgtgaccagtgcttggtaagatgcatgtgactaattgacaccttagccttggtacagaggcgattgaatccatgactcagaaggagctaagtccccaagtgtattagtttgttctcacactgctatagagatactacccaagactggggaatttatcaacaaaggaggtttgattgactcacagtttcgcatggttggggaggcctcaggaaacttacaatcatggtggaaggggaagcaggcaccttctttacaaggcagcaggagagagtaactgtcaacacttataaaatcatcagatctcatgagaattcactatcaccagaacagcatggggagctgcccctatgatcaaatcacctctctcctttgacacatggggattacaattcgatttgagatttgggtggggacacagagtcaaaccatgtcataaagtgtggctgacaagtgccgtgcctgtctagagagtgg

SEQ ID NO: 88712 - DNA, 1046 bp, Homo sapiens
ttcacagtaaatctcagggaacagagtccgtctgatttattagccattcagggagtccctggatagtgcggtaaggccttaagtaactgcatttgtctgatcccactttcaatctttgatacagatgtgcagatggttactatggaaacccaacagtgcctggcgaatcttgtgttccctgtgactgcagcggcaacgtggacccctcggaggctggtcactgtgactcagtcaccggggagtgcctgaagtgcctggggaacacagatggcgcccactgtgaaaggtgtgctgacgggttctatggggacgctgtgacagccaagaactgccgcggtgagtgcgtgagcgtgaagtcaggtcagctgtttattgccataggaagtcttcaaccgtatagtcacatgtgtcacacagggccccgcctaggaggtcacactctcttgaggggttacttgcattaatgctgggtctctgatcaaatacagacccacgacccagttcttccctagctaccctatcctgagcttggttagtcataacccataggggtcagtggcctggaaagatgcagcctgccacccgagcggccagtgtgacttgacagagttccggctctgctccccgtgactgaaatgaaagtggggaagctcagagcctgtcacattcgtaagggagatgcttcagaggctgcacgaggcagatgggattccaagatgaagggtgggaaatggtaagactgtaaccccagaaactgcgtaaagcaccgtgtggtgcatcttagccctctgtgccagaactgcccgacccctatggcactctgctgaattcgatccttgaaattatggatcgtggagaaaactagattctcctgcacagcagatgacctggccggagggatgattcagccctcagattttgaaggagtgaaagaacaaaagtggcaattataaattattttgagtatttcatataaacgccagtcatactatggtactacgacatggggacacaagagggcaccagctgtacagaaaacatacttt

SEQ ID NO: 88713 - DNA, 1029 bp, Homo sapiens
caggaggccttcctcatatagctcagaggttggtgactggttttagcattttgtcttttttttttccgcttggacttcaagttgcttatagataaatctgaaaatcctttaagacaacctgagctgattcttctggtgcatgttcctaggcgtgtgcgcacaacaccaccggcgtccactgtgagcagtgcttgcccggcttctacggggagccttcccgagggacacctggggactgccagccctgcgcctgccctctcaccatagcctccaacaagtaagcctcggacctcatcagcggttcctgccagcatggccaggattcccacccagatgcgtactaatgacttcagagcaagactgtgtgtgtaatacgtgtgtgaattttgcccagtgacaattgatttggattaaagacagaggggtgggttattttcttgtaaaccaacgtttggcttatgaaagcaggcaagaagaggtgtgtgccagcaaggacctatacacgccgttttccctcttgattcctcttggtcatcagttgtttcacaagtatatgttgtctacttaccagtgggctaggaggtggagggatacagagaggaataaaacattgtccctcgacttagggagtttttgatctaatgaccaaaatatgtacgcatgaggctaaacaagagcagtctaaatccattcattgattcaacagatatttatggagtgcctactgtgtcctgagttttacagcaggtgttctgaatagcaaactgttctcacctggccgtgggccccaggggactcagtgtggtcgtgactgtagtgaggcctgtccaccagatggtggggaggagggagagcagtgtccagcctacctaggtgggtgcaggaagctcttctctcagatttgcaggagaaggagtttcacaggcagcatagacgggcgttctaggcagatggagctgggcgtgccatggcatggcagcaggaacaggcatcgcccatttgaggaactgcagcaggccatggaacaga

SEQ ID NO: 88714 - DNA, 1926 bp, Homo sapiens
tgactttgtaccaaacattgaaggcatttccagggaataatgatggctcccagataatatattgttgtgaaagacctttagttatttacaaaaatcacatcacccttttattggatttaagtctttttttttttttttgagacagagtctccctctatcacccaggctggagtgcagtggcgtgatctcagctcactgcaagctctgcctcccaggatcaagcgattctcctgcctcagcctcctgagtagctgggactacaggcacatgccaccacgcccggctaattttgtatttttaatagtttcaccatattagccaggatggtctcgatctcttgacctcgtgatccacccaccttggcctcccaaagtgctgggattacaggcgtgagccactgcgcccggccggatttaaatcttttaggagcccatcttcattgagatgtgagatgtatttgcgagcgtgtgagtcacataacaatctgtctatttgtaggttggagtccgtctctctggacatagccagctctaatgccatcgacctggtggtggccgctgatgtggagcactgtgaatgtccgcaaggctacacagggacctcctgtgaggtgacgcttctctcttcctgtctttttcctttcgttccttcctaaggggaaaacagtgcactgaaggggatgtcatggcaaacatttgatttttagctttagcagcccaatgtttggctcagtcttttttgggcaatagaaatattagaagtcacattgtttaaaaaaatcagattcctccaccaggaatgggctggagcaccggacaatattctgacttagtgctgccctcttgccttagtcaacaagaaacttgcaatactcatgccattgactgtgtttctaaggaggatggaacttgatcatatctgaacatttacaaatcaccagcatgtgacctgggtagctttagacaagccagccctattttgagaccttttatggcccctcgctattttactttggtgggctccaccttacatgtgaaatatatgaaaatgcgcttggaatcctcaatgaaagtaatctgttgctaaaaatattttgaaatcacttggacaaacatattgatattaataccataacaagaataggccgtaagactcattgcacaaccattacgtttttgtgtgtgtgtttctacctttaaaaagaaataaggaactggattatggtgatggttgcacagctcggtaaggtttttactaaaagtcattgaattgtacacttaaaatgggtgaattgtgtagcatgtaaatgatacctcagttaagatgtttaagaaaaaagacatttctgtactctggcaactgagcagtttctgtttgtaacgtagtggaaagaggatgactttcccttctcttgcagtcgtgcctctctggctattaccgcgtggatggaatactctttggaggaatttgtcaaccctgtgaatgccacggccatgcagctgagtgtaatgttcacggcgtttgcattgtgagtctctcactgtagttcaggtgccctctcctcctcaattcagagccatttgctgtgtacaagtgatttttttttaagtgcttcctccacggaataaccctagcctcatagaccccaaagaaaatttacagatttaagctcatgtcatgaaatgtttcccgtttttttttttgttttttttttgaaaaaagttactttggtaatagtggaaaagggatatacaacttcattatagttctttttattagattaatataaagtaattgtttttatttgctgagactataaagcaatagaaaggtaaaaaaatgttgtctacttattaaatacaaagcataggatctttagatgacagtgctaatatttatttatttatttatttgagacagggtctt

SEQ ID NO: 88715 - DNA, 1105 bp, Homo sapiens
acggtaaatcacttttgtgaacagcaacttgatgaaaagctggagctatgtttacatactttttctacttctgtactttagttaaagattagaggtgtcagatgggttgctttgataaaagctgtgggcaactgcacgactttctttcttttccaagatcccagcgaagtacacaggctttcagtttattaccagaacccctctaaaaataatacaatgaaacaccttttctctgataattctgggccaagagctgtacacaccattacacgtttgccacaagaagctaggcacgaatgaaaaaccacgttgctgaatacaaaatttgattttatttttattttatcattaaattgaatgacaaatatattttctcttgtttttaaatgttagggaaacggactcactttaagcacacaggctgagggtctgtcattgcagccttatgaagagtacctaaacgtggttagacttgtgcctgaaaacttccaagattttcacagcaaaaggcagattgatcgtgaccagctgatgactgtccttgccaatgtgacacatcttttgatcagagccaactacaattctgcaaaaatggctctttacaggtatgtattgaaaatggaggaaaaacttacggtgaaggtacttccattttatgtttgtttattcatatatatttaaagctcaacgtattttacattcattatattaaggacacagctacaggatctggctgtcttaagaattattaagtttataaatgtaattttattgaaaacgtaagaacagttatccacatcaagtgtatccagtagaagacagacttgacattaggatgagaaactttcaaagggggtttctgggaaatgcacgatgagttagcgattgtctggaccatgttgcacctggttctcaccatcctaatgttaatggtcttagcttttactcagtccatttaagtgaacgtatccatcgttggtcatttgattactttcgggaggacaatttctggcaatgccgtgccaagcataaaagttgtatgcagctaggctgggcatggtggctcacacctgtaatcccagcactttgggaggccgaggcaggt

SEQ ID NO: 88716 - DNA, 1025 bp, Homo sapiens
atcagaagaaacacctttagtcctttctctaactagcaaatcagacatattctttgttgtcctatgaggaggatgctgaaatgaaaatgtggagattgtagacatgggtcaaactcctcatcccctaaattacttaaccgaagtaaatatctattgtgtgattaacaaaagtttatagtaatttgccttgtggtctctaacaaagagtacatttttcttctgtgctttcaaacagtgtcctgcatgttggtaatattgattaaccaaaatgtttatgaatatactcccctttcactgcctttaatgtgaatttccttgtctgtcatggtcaaggggatagttgtagcctagttgtttgcagatggatcccagtgaccacttcctcttacttgattgttgctgtgattgtcttcccctttcgtgttcattctcgcttaaacatttcagctgactgcgtttggcggattcctgaaatacacggtgtcctacgatattccggtagagacggtagacagtaacctcatgtcgcatgctgacgtcatcattaaggtgattgtttttgctttgattctgctatagagcttagggcttagtgggctgatagtttatgactgaaagttactaggtgaggacatcccagcaaggagctggtggccaggtggccattcagtagaccctggacttgcgtggggactactgagatggtgagtgtgagaatctgtctttgagcccatttctggagttgcctcaggacagcacccgccactcttctcttcatctccagggtgtacccatcttttcacatttaaaaagaaagggagctgggcttggtggctcatgcttataatgtaagtgctttgggaggctgagacaggaggattgtttgaagccaggagtttgagaccagtctgggcaacatagtgagacccccgtctctcaaaaaatattagccaggcaccgtggcacgtgcctgtaatcccaggtactcgggagggtgaggcaggaggatggcttgagcccaggag

SEQ ID NO: 88717 - DNA, 1059 bp, Homo sapiens
tgcattaatatggtgccagtgaggggttttatttggccttacaatattaataacaatttcttcataattcataggacattccattgtacctatgtgcttattcccacctgtgcagtcttaggcacatgttatatactactggaaataatcttgagcatttatgaataagagaaaattctatagctctcttcagattttgaaatgctggaaagatcagtaaaaaaatgaaaaatttaaaacaaaacaaaacaatttaaatggaatgaccgagttctaagatctccagccttgttcttgagtacaaaatcaaattatatataattcaaaatctctattctggaaatattgactttatgaggcctcacctttactttggacgtttattcacctgtctctgtggatcaccgaacacctatcttgttaatgtcattttattctctctggacagacacattggtttcaaaagctaatcttttaccctaacttacaggaaaacgttgaggggaaggcctgtgatcgctgcaagccaggattctataacttgaaggaaaaaaacccccggggctgctccgagtgcttctgctttggcgtttctgatgtctgcagcagcctctcttggcctgttggtcaggtgggaggcgccatctgcgcggcgggatttaatgagcaggtcgtattgcacaagcttggcacgagctgtgtgaggaggaaatgaggatgacttcccgtgacaccactctcatcgctatgcaatgatactgacgtgggtcaaaggcagccgtctgcctctcaagattctttataggtcatgtgcttactcccacacacatttctctatggaaaaaacaggatgatgtggcactagagaacacgtcttgtttcaatttcttctgtggggaaatggattgggtggggaggtcggctctccctccgcccgcccctgctgctctcaggcctgggagcccagagggccgtggggccatggggattttccagctcaaagacgctaaggagtaggaggccctccagtggcgagggtgggaacagcggcacgtggtg

SEQ ID NO: 88718 - DNA, 1041 bp, Homo sapiens
ttaggagtgcagttgctggatcttatggcaactctataacttaacattttgaagaagtgtcaaaaggttttccaaagtcactctaccattttatattcccagctccctccacgggtttcatctctgttttctttctttaaacaaggaattggcaaactatggcccatgggccaaatccagcacactgtctgttcttatgaataaagttttattggaatggagatatagccatttgcctgtgtattctctatggctgtgttcgaacaataatggctgagctgagcagctgcaaatgagactctgaggccaaaaagcctaaaatagataccctctgaccctttacagaaaacatttgccaacccctgctttaaacctcttttgccttcatgttgggtcattgccattgttgtctttctagggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggtaagtggggaggtcagagacacccctgagcttcctttgagcttctctggaaaaggagtgttttccattggctccaatgatcagttcttgagcaaagtggtaaggtttaagcagaactccccttgccccttctctccaagccacaccgagttggctgtattatatatgcttggactcacatgggcatctggcttctttttttgtacctctggtaatggtgatatattccagaggcatttctgtgacttcttagaggacaccaaacactgcatacctttatattcccacctcctctgtgggcctcatctctgttttctttctttaaaccaggacttggtaaactatggctcgtgggccaaatctgacacactgcctgttttgtgaataaagttttattggaacagagctgtatccatttgcttatgtattttctatgactatgttcaaccaataaaggctgag

SEQ ID NO: 88719 - DNA, 1079 bp, Homo sapiens
gcccacatcgctttttatatttaacaatgtattgtgaaattctttccatattagcaattagaaatgctgtttttaaaaacagttgcacagaattccattatacaaatgtagtataatttattaaacaaccacctatcggcggttattttgatggttattagtctgttgtccacacaaacaatggtgcagtgattaaccctgtatgtgtccttctcaagtgggcaagtacttctgcgaaatataatcccaggagatggtttgctgggtcaaatgggtatgtgcatttattattttgatattaatagctcttcccaattgtcctccataatactgcccatatcttattaaaattacttattctaggattttaatttaatctaaaatcatagaacttacttagggaggttaagagttttctttgtataaggcatgctatgtaaattaattgagatgttaaaaatattctcctagcatgtaattgtcacaataaagccaaagactgttactatgatgaaagtgttgcaaagcagaagaaaagtttgaatactgctggacagttcagaggaggaggggtttgcataaattgcttgcagaacaccatgggaatcaactgtgaaacctgtattgatggatattatagaccacacaaagtaagagtatttctttgccattgctgatcttcatcatcttccccaggtggaaaagagactttgtcaagtcttaacctctgtattggagacttttgtaatatttcatttatatccttgttatgccagtagtgtttttatatatatatttcctactctatcctgcttttcttgctcaaaataagatgtcagtcattgttatttatcttgaattcaggggtccattagctatgtaatcctgggtcataatactaactacagatgtgaaaattcagctataactaaagcagctgtctcttgcctgtaggagatgttcagccaatcttttttttttaatttttattttttgagacggagtctcgctctgtcgccaggctggagtgcagtggtgcgatctcggctcactgcaacctccacctcccgggttcaagc

SEQ ID NO: 88720 - DNA, 1011 bp, Homo sapiens
tgcttcagcctcctgagtagctgggattacaggcacgtgccaccatgcccagctaattttttgtatttttagtagagatggggtttcaccatgttggccaggctggtcctggcatcttcccttttaaaacacttgcatgaagttacttcttattttcttctaatctttgtaattctttacctcttgaataggactattctgttatcgatgctgaaaaatctgtagatgaacactaagaaaattattaataggagtttctaaacccttaataagttccatgtatatttttaaaaaaagtttttattagctaagtcgtattctggttttgctttattcctcttcatttctgtttgtaaccaggttatttgtatatattggcatctaaaaattaaatgccagtttgctttgatgataatcatatatcctctgttgtgaggttcttgccacatatttgacagataggttctttttaccatgaaattaagaaacataagcagatacattttctaattcagttttggcttccttattgtgtagaaactgcagtgtcaatgtgagcataatacttgcggggagagctgtaacaggtgctgtcctgggtaccatcagcagccctggaggccgggaaccgtgtcctccggcaatacatgtgaaggtcagtatacttagaatctgaaggtcagtacagttttcctcttaatacgtcccaagtttatggtgtcttaacaacttttatagttagcaggtaacttgttttcttagaaatttaagtagtttccaaagctgcagatgaccttaaaattttaactattgtggcctaaatgtatctttatgggtttgctgttttatctatgagtcccccttcccgtatagtctattattctgtattaattttacttttgtttttgtttttttaccatgggatatgccaggttgtatattctgtattgatttggatttaagttttaaataagcaatatattcacaagattcctagatctaacaatatgt

SEQ ID NO: 88721 - DNA, 2200 bp, Homo sapiens
gacattagacaatcagggctatatttttgcatgcttaaaattgacatttgtggtcaggtatggtggctcatgcctataatcccagcattttgggaggcaaggcaggcggatcacctgagttcaggagttcaagaccaacctggtgaatatagtgaaaccctgtctctactaaaaatacaaaaattagctgggcgtggtggtgcacacctatagtcccagctactcgggaggctgaggcaggagaattgcttgaacctgggaggtggaggttacagtgagccaagattgtgccactgcactccagcctggaccaaagagcgagacgccatctcaaaaaataaataaataaataaacaattgacattcatctattttgatgccttcatcttcagattcatacatcactcatcaatggcagaccaagcgctgacgatctttcacccaagttgttggaattcacttctgcacgatatattcgccttcgcttgcaacgcattagaacgctcaatgcagatctcatgacccttagccaccgggaacctaaagaactggatcctattgttaccagacgcgtgagtatgggacggcagtcctgccaaataaaataaaaagattcattttatttaaaggaactattatttttcttctttcctttttggttgttctttccccgacatgttggccttttttcttgccagcagctgtatccttatttcatgtaagattgctatgttgttacagatgctgcctttaggtgatgggccaaaatcatatccttaggtccctcacccaccccgtccccatagtgccataatgtggtgaatgccatggtctttgttcttcacatcgtagtctggttccacatctgatcttcagcaactgagaattttctttcatatcaaattttaaagtttgagacataatttacattcaggaaagcatacagattttaagtatgtagttaagtgtgtaagactggtgtcgcaaaaattttcatatcccttcaataacccaggagtgggattactaagttatagggtagctggatgtttacctttttaagaaaatgctaaacttatataaaaagtagttgtattcagctgggtgttgtggctcacgtgtgtaatcccaacactttgggaggctgaaatgggagggtcactgaagcctgggagtttgggaccagcctgggcaatagagtgagacctcaactctatttaaaaaataaaaataaaagtagttgtgtccgtttttgtagtctgaccagcaatgtgtgagagttctggctgcactacacactgttagatatttagtgctatcagtcatttttatgcccgctgttcctgtgtgcgtgtattggcattttgtgacgttaatttgtgtttctctgctgactaatgttgacaatgtgcttactagtatacgatcagattttttttgtccatttttaaattggacaaaaaataagcctccttgttactgacttataaaagaattttatatattttgtatacgaatccttcatcagatatgtatatattgcaaacatatccgttctacttggtgtttgcttattcaccttcctgtgactttggatgagcagaggttttgtgacgaatcccaatttaccattttttcttttatgattaatgctttctatgacctcaaaaaatattagcttatcccaaatttaccaagatatcatggtaggctttcttttagtagctgtatagttttagcttttacatctataattcattttgtattaatttttgtgattggtgtgagggaggagtcagagttttttttgcttttgttttttttcctatatgtatatgcaattgttctagcaccatttgttgagaatgctttacttgttttggggccgttgttgaaaactattcaaccttattattgtgggtttatttctggactctctactgttctatagatctgtttgtctattcttgtgccaataacaagctttcttggttactgtagctttacagtaggtcttgagaggtcaggtttcttgtatttccttatgaattttagaatcagtttgttaatttctgcaaaaaaaataaagcctgctaagattttcattgggattccattgattctttacaccaatttgtgaagaattttataagacattttaacaatgttgagtcatccaatctgtgcacctgatatataa

SEQ ID NO: 88722 - DNA, 1039 bp, Homo sapiens
ccaatgtataccagttctctcaaggtgcacttttgtttttgaacagttgctactgattctattttttaaaaaaattattgtgtatatttaaggtgtacaacttgatttgatatacatatgcaatgtgaaagaatcatcacaatccagataattaatatatttatcacttcacatagttacccttttgtgtatatgatgagcatacttaagatctacccttttaataaataaatttctagtatacagtacactattgttaccatccattatatctccagaacttattcatcttgcataactgaaacttggtatgcattaaccaccatctccctattcccctctcctcgcacctcatggcagccaccattctactgtctgattctaagttcaactatcttagattctacctttaagttagatcatgcagtagctctcattctgtgcctggcttgtattgattctggattgagacttttcagtgtctttgtttcaggtctttcaagttgcatatgtcatcattaaagctgccaatgcccctcgacctggaaactggattttggagcgttctctggatggcaccacgttcagcccctggcagtattatgcagtcagcgactcagagtgtttgtctcgttacaatataactccaagacgagggccacccacctacagggctgatgatgaagtgatctgcacctcctattattccagattggtgccacttgagcatggagaggtaggtatggtgcccgctgcagcaagatctgtttcctcatcagagtctccctgtctcagactcaaaattgatctctctcaatacaaagatctttaatataactatctagctctatttaaagtggccttgagtcatgtctattataagtaatttcacaaacaatatggtttaccttgttgacttcctctcttcaaggaggctctcagtcttcactctgctgtgatttaataacgcccttggatcctccttcagagcatcttccccacagcaccagggcaagaatgtttgttgaaatattagaga

SEQ ID NO: 88723 - DNA, 1034 bp, Homo sapiens
ttcacagggataactcagcaatattatttatcaaatgcacttaactgttcatctaaatctcttttgtctgggaaaagtttatttccttcatgcaagagagaaaacatgccttcattcactgttcagttaccaccgtggaggcaggtaggttcttttatggagaattttcagaccggagtcatgcctggtattgagccccatagatttcctgagagcctgcggagaacagctgcactttctgtggagaggagaggcttcacttctgtctgcacatgggaagttgacctctgatgctggaaaattaggttatctgtattttttagacatctgtgcctgagatggatttaatatatttaagttaagattgaggcccacatgaacattcctgtctggattccttttcagaaagtggcgtttgatgtgtgcctactttatttatgtgacactgtttatgtgcattccagtgatcattaacaaaggctacttggtggaaaatcgtgatgaaagtggatttaaaaatggctgtatcagctgcaggtttagcaagactacattgactctgagtctagtgagaacccctgcatcatcaatttgtgttcagccaaccttaaatccagagaaaaggcagtttagtcaaccatgcaaaaaaagggcaaaagaaatattgtggactttattgggacaagggtttaatattctatatactggccaggcacagtggctcatgcctgtaatcccagcactttgggaggccgaggcaggtggatcacctgaggttaggagttcgagaccatcctggccaatgtggtgaaacctcgtctctactaaaaatacaaaaattagttgggcatggtggcaggtgcctgtaatcccagctacttgggaggctgaggcaggagaatcgcttgaacccaggaggcagaggttgcagtgagtcgagattgtgccattgcactccagcctgggcaacaagagagaaactttgtctcaaaaagaaaaaaaaaatctacatactaacagacagtccttcagtt

SEQ ID NO: 88724 - DNA, 1063 bp, Homo sapiens
gcaccatcacggctcactgcagcctcgacctcccaggctcaagtgatcctcccacttcagcctctccatggctgggaccaaaggcatgcaccaccatgcctgcatgattttttttgtagtttttgcagagatgaggttttgccgtgttgcccaggctggtctcaaatttctgggctcaagcagtctgcccaccttggcctcccaaagtgctgggattacaggcatgagccaccacccccagcctgcacactttttaaaacaacaatactattagtcaccctcaaatggaaatggtgacacctggaccgtgggtcagcttgcggggtgggctccttttgaaatcgcttttctaattgatggaagtcagaactgcttctgacaggtgtttgaagtatttctttcctatcttcagattaccgatcatgggttactatttacgttttaaatgggctcgtatctctgtgccctctatttgtcagcaatcatctctcttactttggcttttcttcaatgtccactttaagtatctcagcatggttctgaagggagcattcctagattgtctgagacatgaattttaagaattttaaggaaagaaatctgcttgatctaaatttatcactattggcagcctgtccctcctcccctaatcaaaacaaaaagcaaaaagaaaaggagcaaaaaagagaaaagttactggacaaggacatattttgttttgttttaattttgggacatgtttattttgcacatctaatggtagcaccaaatttaaagagaaacaaatcacgttttattctgaaatgttcttctcgtttatgaagctgtttctttttgtctgttgagtatgctgctcctaaaatgagataacagttaaaactgccaactgaaatataatataaatgacatttcaagtaattgctctgagaaatgtatttaaaatgtgtattgcagacatccttccttccctctcagctccctagcatctcagtttttgctagtttttgttgccacttcacgtgctgataattgactaagtgctttcgtgattgacacgctataa

SEQ ID NO: 88725 - DNA, 1964 bp, Homo sapiens
aattgaatgtaaagtacagagaattcccccacacccctctgtacaatagtttttggatcaaattttggctagtcgttgtttttttttttttttttttttgagatagagtctcactctgtcacccaggctggagtgcagtggcgcaatctcagctcactgcaacctccgcctctcgagttcaagtgattctcctgcctcagcctcctgagtagctgggactacaggcacgtgccactatgcctggctaattttttgtatttttagtagagacgaggattcaccctgttagccaggatggtcttgatctcctgaccttgtgatccacctgcccccctcccaaagtgctgggattacaggcgtgagccactgcgcccggccttggctattcttaatcacccttttaagagcaagtgactgatccagtgcagttcaacagtttctaagaccttttcctccgtagtatttacaagacgatcatgagaattgtcaatcatataatttaagaatttttgcttttcctactatttaatggtatgtaatcagaagatatttatctgtgttcttcatatgaaggaagcacaaaaaaatgtcagttaaataaccacttagtaggtctctagtgggatgaacaatatttagaatcatttacaactttataccagtcttgtatcagtcttatagactgagccaggcaagaaatggggctgcccgaacttgctgttcaggaaatgccaccaaggagaaagcattgtgtgaacaatgggtctttcactgtaaagtcctgagtttggggctctggttttgtattttgtgaagtatcatcatgccttgccagagctcagtaagaatgtgaccgaaatcaggtcatgagaaagataagatttcaaacatcccctcggagctgtttgcttgacctccactgacttaattggtttctatggagttggcccctgcctagaaatactacattcctactcattttcaacttagacagctcagtctttcacaaggttgaatcttcataccattcacttttcatctctttttttttggagggggtgttattataaaatatgcatatcataaaatttaccattgtaacctttttttgtattaaaaatggcatattctctattttgcatactttaatttcagaacaaaataaacaaaaaaaaatccacaatacacaacatccaatcctgctgtcagagtagggagggaatgggggcttgacacccttgtttcctgccttcaatacaaagacaggagagaaaaaaacactagacatcagcagggggagccaggtgggacaggggcacttgaggctgcagtgggagccattttaaccatttttaagtgtacagtacagtggcattaagtatattgtgcaaccgtcaccaccatccatccccagaactttttcatcttcccaaacagaaactctgtaccccttaaacaccaactccacgttcctctcttcccccagccctgggtagcctccattcagcttttgtctatgaatttgattactctgggtaatcaagcttacataagtggaatcatattctatttgtccttttgtctggcttatttcacttagcgtacataatgtcctcaaggcttatctatgttgtagcatgtattacaatttccttccttttaaagactgaataatattccattgtatgcatagaccatattttgtttagccattcatccatcaacgggtacctgggctgtttccaccttttagctattgtgaataatgctgctgtgaacattggtgtacatgtgtattcgagtccctgctttctcttcttctggatatatacctggaagaggaatttctgcatcatgttgtaattctatgtttaattttttgagggaccaccatactgttttccatagtacctgcaccattttacattcccactgcatcttttaaaaaaataaacaaaagcctt

SEQ ID NO: 88726 - DNA, 1026 bp, Homo sapiens
gatttcaagtggctcagctgatttggtaaattttcactttcaggcctgtttcctgccattctcaatcttgccagcaatgctcacatcagcaccaatgccacctgtggcgagaaggggccggagatgttctgcaaacttgtggagcatgtgccaggtcggcccgtccgaaacccacagtgccggatctgtgatggcaacagcgcaaaccccagaggcaagtgtcgcgcctttatttctgaaattcccatgggaatgtacactttgtgaaatgaggactgagacttctgttaggaagccataaacattgtgttcaccttcactgctctttgtttccactagcattacggtttagaacttaagaaatttaaagcaacagccgagaggaattcatgttttttattttctttcaacagaacgccatccaatatcacatgccatagatggcaccaataactggtggcaaagtcccagcattcagaatgggagagaatatcactgggtcacaatcactctggacttaagacaggtaggtgagcccagaaccattgaagagtgtctacaggctgctgagctgtggtcttctgatgacctttgggaaagtctggcttctttctgaacacatttacattctaatctcactatttccaccaggtgaaggcaagtggtatacagaaggagtccctggtgccatttcttgtcactttcatcattcccaggtgtcttcagggagatgggtgaaattgcttccatatggttgatgttcttcgaagctgtgtcaacagggcacactcatccatccagggtatcatgtcaggctgtttgctggctgccaacagatgcatggggagggagagggggaaaacacatgtatttcctaacttttagcttactgtcttgctaatgtcattgagtaagttattgtataaggattatataaggctagaagaaaaaaagacaaaacggtgttaaacctcttgactgtgtctcccctgccacatgtagtctgtctgggccaggtaagctgga

SEQ ID NO: 88727 - DNA, 1103 bp, Homo sapiens
tgcattgtattttgtgataaattggagttcccacccagccaaagttgccatccggtcctcttttgaatggctggtccagaatgacatgagccagtgtcaaaaagaagggacatttctgtttcgaagatcaaaaccttagctcccggcatttctttgaatacacagacaaccccaggggggttctagcattaaaacctgggtcattagtagccggagggcagtaacaccgaggaactccccacaggtagtcaggttgcctgagcaaccataaagccggtccccggactctggataacaaacccagccctggcacctctctgggtatgtggtccttcagcctcttagactttgtatcatccaatcaaatggattgcagttgatttgatctgggtaggaaccaaaatctgtgtttcaaaaaaccttttcccattttgtatccagaggcacaagaacctttccagttggtcttcaagcagaccctttgggtttctggttcaaatagttgtttccagaactcttcctgccactgcttgctttctgtccttgctgctgtgtcctgtgatgggctagcactctttccccacccgtcaaaatccacagtttgtctcttcagcccttttatctgaatctccaactctgccatttttacctttgcttttgtacaaactaagtttttccaactctttgcaacttcacccctggcttcatgggcatacttttgttcattctagaagtttggagtggggagaactggagataatgcatccacatatgaatgcttttggaagctcccagtgtttttctttaaaagggagttagctttttttttttttttttttttttttttgagacagagtctgtctcagtgcagtggcatggtctcggctcactgcaacctctgccttccgggttcaagcaattctcttgcctcagcctcctgagtagctgggaatggcctgccaccacacccagctaatttttgtatttttagtagagacagggtttcaccatgttggcggggctggtcttgaactcctgacctcaagtgatctgcctgcctcagcctcccaaagtgctgggattacaggtatgagccaccatgc

SEQ ID NO: 88728 - DNA, 1032 bp, Homo sapiens
atggaacagtatccctctgtccactgtcctcccctcatactaacttctttactggaccttgtgctggatattaacacatcatttagtaaatgtatgtacttgcaaacttttcaccttgcaacttgtccttccaagtagggctttgacagaaaggtattgttagagcagtgtttcctagatcttttggggtttaaaaacttgattgatttcatggcattgtactacttctaaaagtattgtttactatagtattaataagctatttttaagccatagagaattttaaaaaatatattttagaattttaagatttatgatatagagaagttgagtttgagaacaattctattacacgttaaggataagttaatgtattgaccaataagtatgacttattactggaacactatggcaggtacagaaaatatgtatttaaaaaaatttctaatgaagaagttaagtctacaccttgaatacagaaattaattgatagcgactggacagaactgtggaacttagaccttagctgaagtttttcgttacattcttcagaaatatttggatgaactagataaactatcatctcctaagaatgatgtatgtagttacttacaagtttgcaaataattcttttacttgttttatttctaaaatatcaatatgcatccatggacaattgaataaaccaaggcattgcaaaattaacgaggaggaaaaacccttcatagaagtaatttagttaaggtcatgaactttggttctgttggaacacgtctgtcagggagctatttcagcataaaacgccacacgatagctggattcattgtattttcatgtcctttatactgggtgtgacagtgcccagagtaaccatttgataataaatagcacagaatcttcccacttgtgtctttgttttctcaaggctggctcaggagagctttctttgggttaacttgttcctcatcttgcttgggggcaggaggcagacaatggaggcagagagattccaaatcagcttgggtagataac

SEQ ID NO: 88729 - DNA, 1057 bp, Homo sapiens
tgaaaaatattgatcgtagcagttggaaacaagggtatgtgtaacagaagcctcactgcccacctcctacatagcctggactttagtccattctttttttccttcttcttttccagacattaaatatgaagcctacatctgtagttaatctagcatgattgagaattcaaatgcatcaagaatattagaataaatacatatactgatctttagtgtcttgtgccactgctttataattgcactgctttataaactcatataaaatgcttctgggaccatttatttcagggtaatgatccttgaaatgccctaccattttatactaattcattcataaaatcctatggatattcattttcatgtacagtaaattgttatggggaaataacacaaggtctgtctttaagcttcaggtgtttaattctctggctttactagctatggcaaattggggacataacgtgtgttttagtttcactgtctgtaaaatgggaataataatagtgcctacctgaaagggatgttaatgattaaatgaaataatgtgagaaaagttgttagaccagtatctagtacagagttaaccctcaacaagcaagtttatttatgttcatcactgttactattttataaagaactatatatttttaaactatattctccaaaatgcataattgtttagaaatttgaagtctggatttggaatcaaatagtcttgggctcaaatgccagacctgtcactttaattagctatggccatggctaagtttcttaacttctctgaatgtcagctttctatctataaaatggatagcattgatactattaaataatatgtgaaaaatattagcacagtgtagggtgtgtcataggtactcagtgcatgatggttattactgttacacctattgtacttgctcatcatcctggacatcatctctctttcattgctgaaatccatttggtcattgagacttattgattttacctcctgaaaatctgtgtagtctctttcccttttttcttttttttttttttttgagacggagtctcgctc

SEQ ID NO: 88730 - DNA, 1025 bp, Homo sapiens
gaaataaaatttgaacgtaaactataatttcatcagtttgttattatggttcagaaaatacttttaaatttgaaaaatggaaaagcgaattaggaagaaagaataatatagtagtgaagaaggtaagctctggaatcatactgctagggttacaatagctgtgtgaccttgtgtaggttacctaagctctctgtgcttcaatttccttgttggccaacttgataatgctgtcataaggattaaattttttaaagaattcatgtatgagctcagtgtctggcatgtagtgagttttaacttatgtttttaagacaatacatcatattttcttttgttctgacatgggctgacaaacttttccttcagaggggccagatagtaaatattttaggcttttcagccatatacagtctctgtcatatattcttcttctttctatttatttatttatttatttatttatttaatcctttaaaaacataaaaactgtttttggcttgtgagccttagtttgccagcccagttttagcttgagaccataggcaggttaatatgtagcgttaagaaaaggttcacatttccccctttttggtctttttaaaaactaaaacatttaaacacccaaaaaaagtacagagtgtgccataatatccatgtaccattcatccagcttcaaaaaattttacattttgcgtatttcctttagctttccatttttcccccagactacacatggcaactatccagaagttcatatgcatcctctttgtgcatcccctcaaaaccctgtgagttcaccaaaatcagtgacctttcttcttgagcgggaggttaaaaaacagttcccagtcttccatgcagtcaggtggggctgcgtcactgcatgctggccacgggaacctggatgggggtgataacgtccttctctggacaagtagtgacgaagaagacatgcttgtcccttgtccttctccccagttgcccctggggagcaaaagaccccacgatggaattagccagagttc

SEQ ID NO: 88731 - DNA, 1089 bp, Homo sapiens
ggtagctttggctttaaaatgggcaaacctcctgctctcctggttcagaattagtgatttttatcctttcagggatcatgctgtggaacacacagcagcctgtggagtctgctaagcccgattcacaatggagcattgatccctgctgctgtgtggcaccctggcctctgcagcatacacatgcttgggccaggatcaattttcagtgggttttaggtctgacacactggctttagtttatagtaacatcgggggcttgtgtctgcctaaccccatcctttataaagtggggatcagtgccttacagattttgatgccaacataattatttataaaatcatcacattacataagatgtgctgtttttcttttttcacacaagaaatgattttcatttgatgtattgatcagtgtagttactgggaattgagcccaatacatttattcttttatttgagatctgctaaaattgtctcttccttcggaagactgaaaaatgatccaggttgtgaatgagttgttccaattcttttcatgccgagcagggctttacactaaatttgggacctgaggggccagatttaggatctggagggttaagagtgagacacagcggctgcctggccacatgccagatgcaggaggtaaggctggaggttcgtgaccagtttggacatagctgctgctctggtaaaacacaaacatcaacaacgaaaacttgattcctgtggaatatgtgctataatctaggaaacagagattctctggtatgggaaatccttgaagtcttggcattagtgacagcacctggaaatactcattccaattcaaatgagtctgaagtgggccctggaggggctgcatggggaaatttgcaagtggtgtctgtgccgggaatgttaagtattgatggtgatgctgaatttatgaatatggaaagaatgcgtgtactcagaaggaggatgcaaacagattttaaattttattttgacattaccttccagtgcagtgcatggttagcagtaactgtatacagaaagggccacagaggctttggtttctgaaagatgtctgggagctgccctgttc

SEQ ID NO: 88732 - DNA, 1064 bp, Homo sapiens
aagacggtttctactaattttttacattccatttttatgaaacattctcagagttccaaggaaaagagaatcctgttgttctgtgagattacattaagaaccactatattggttatctgattttctttttctttcctttgaagctctacattgatctctggaattaatgtcagtgagcttttgaggtctctaaaatgagaatgggaggcacctggctccttttcaaccccgagaagttgaatgaaattggtgtggggatatctgtggagtcagatttcctttggatttttcatttaaccccttgagccttgagctaaaggcactgattttgttcatgaagggcctgctcccattcttgcgtcccattcttgagccatgctgactggagatgaccggtgacaaccacatccaactgcccacagctgtcttcgggaagctggagaattagaatagtattgtctgctctgaaacagcctggagaattttagagctctctgggagcagggtggggtatgggataagggaagatgtgatgaaagagcagcctttcccagttagaacagatgtaggaagcaagcaaccccagaaacatctggaaaactcttaaagtgcaggctagtccctgtgcaccccataaggtcgactgattagaggcagtggaggcagatgtcagggtcagctctctaggatgcccttcataattcctgttttcttccccagggtatgtttgtgctattattaaatgattacacatgcttgttcattccttcctagtgtatactttctagctaatgtcatttcaagctaaaaataagtctggtccttagttagagttcctgagatttttctgcccagccgtctgtctttctcctgagatttgggtcttctcacatcatagtgaagtttatcctcctggtctgtctttgcatagctgtaaatgatgggagattctggatgatgagacaaagttcccagctcactacccagctatgacctgcatagggggacagcagcataggtagtcctgtggcgaagcgttggcctggaggacaggcctaggtgct

SEQ ID NO: 88733 - DNA, 1097 bp, Homo sapiens
ttttctattctgcagaggcgatagctctgaaatatagaagtgattgcattaaatccttggctggcaattttgtgtgggattgggtattgaaatgcagcaaagcaaataatgaaggcatatgtttacctataattcttttttaccttgggagaaggattaaataggaacagtttggttgttgtcaaattcttaacagttgctttcaagcatgaaacagtccccgggctctcggaggatttacttagcagtttgaatagagaggtctttactgctaatggaactgagatggcaggcttaagcaatggggtgctttatagcctctttagccacttgagaagatgtaacatcaaatagctgaaaccatcctgatctccattggtgtttaggaagttgtgcaaagattggtgaataaataattcagggttgtatgaatgtctggatgccaggaatgttgagagtatctaaaagcttgattcacagaggatttagttctgggagaaactctggagcccctccttgagcttggcaccagggaacatttacagatgatgacattttctaagaaagaaagaactttcacttgggattgactgggctttgtaaagcaacatttcactggggactccagtcccggaaaagtcttatttgtaaaataaagaatattttcagtacagatggttggcagttgctgctgtgtgtgtgtgaatgtgtgtgtgtttaaaatacaggatggtgatgattatttagggtcttaaataaccatttaagttctgtactatttaatggttaagctttaagaaatcacttgttgaagacacaggggagaagtagtcacagtttgtctgttgaagcttctgcttcacgctctcgtcatctgtttcagaccttagtaaagacgtcccgaatgtgttgtccaatgaacaggtgggcagcaggtgttggggacccactggatatatgaatattcacaaatattcggactctcctcctgcgcatagagtagatagcagttccctgttcatttggacataggcgtgaccatatgacttgctttggccaattaaatgtcacttctgagcagaagcaggaaagctcgt

SEQ ID NO: 88734 - DNA, 1079 bp, Homo sapiens
agggttttcaccttctttttcttctcctcttccattaatgtgtgcaaatgatttattcctttcaaaaactgattccaaggctggttttcccatgctaaaacagaaatgactcttatgaatttctcagggcaaatgggtgggaaaatcagatagaaccatagctttctgagggcaaattttctaaacctttatgtaaaatactattggatttattctttcatgggtatgtgtatttgtcttatgtatataggttggttccgtaacactttagagaccaagagttggcaaactgccctgctggtcaaatccagctcgctgctagtttttgtgtggcttgtgagctaagagtggttgttacatgttttaatagttaaaaaaaaagcaaaaagaataataaaattttgtgatgtgaaattcaaaatgcagcgtttacaagttttactgacacacagccatgcccatttgtttaaatggtgtcagtggttggtttcaagctacagtgagagtttagtagtggcaacagagactggtccacaaagcgtaagatatttatgccctggccctttatggaaaaatgttgctgatgcccgtcttagaccattttggcatcagcatgtaattgttattttggacccatggtttatattgttgttgttttctatattcatataattattaatatacaaacatttcacattttctctcactttcagaagatgtgttttctaaacattgggctatcaaaatcagtaagaaaaagaaaaaacatgattagagatttcctctatcattgccttaaatttgctatctcttgaaaagcatcgtgatgtgattttctttattttttagtacctaaatctttgtcacagtcctgtaattctaataagtgaataattcatcaagggctgggtgcggtggctcatgcctgtcatgctagcactttgggaggctgaggtgagaggattgcttgagttcagcagttcgagaccaccctggacaacgtgggaagaccccatctttataaatgaagaataataattcatcaagatgaatttaaaagttatgacagtgagagacta

SEQ ID NO: 88735 - DNA, 1025 bp, Homo sapiens
actttccttcaatcatacatcactctcgactctcctgtctgccccttatttttcttctcatagctgtcgaatcgatttcattaaagatagctgaagccttgtagcccttctggattttctattaaaattcacctaatggtagaggtaaaataaaatgtgcatcttcaccccttcactgtagcactccccacagctgtactctggtttacaagactctcccattctcttgagagcaaattacttgaggttaaggacttagggcttatctgtctttttacctttggaaaatagtgaatgtttaataatgtttgcatctttctgtgagagccttcgctccagcacatcaatgatcttgggcaccaagcaccaagagtcacctagatttgtacatcagaagccaaaatggaatcaaaccatacactgaatgttcagggaatctgtcttatctttatcaaggctactcgtcatggttgaactggtagtgttctgatttcccatgtgagcacgtgtgcccatgtcaatacatttatatatccatagtggacatgtggtccatgattgtcaggaggcatggttttctcacaactgtgggcgtgattaattacttgctagaaagtccacccacatattccacttgtattgttacagggctatttaccagacacttcaggggctttagagaggcactggataatgcccatgaccacaggcggttcatcatctggagcagtgtgagagtggctgacatgatgatctgaatcagcaatggctgataatccgaatcatttgggaagtttaaaaaaaattgtgcttgtataggtgtataaatatgtgcaagtgtgtttaatgtttatatgtggtcctatctcataattagtaaagtcaaatgaggcaggattgtagaattacaaagctttcaggatggttcagatgagtaactagttttgggaactaatgagttagaattcttttttttttctttttttatttttattttttaattttattattattatactttaagt

SEQ ID NO: 88736 - DNA, 1054 bp, Homo sapiens
catcaggagtatcctcaaggctaagagccccagtgtcttcccttaggctagagattgggccatatgcaagttaatctttgtaatcttatgaaagctcatggttctgaaatgaaaagtaaaactgaagttgaaattgcacagtggcatggtggactttgtcttcaggagatgaagtcggtttagagagctgaattttcaagatggctgacaactggctgcactatggtatcaggaaattttactgcttttaggtgaatatcactctaagctttatcaggcacctttttgccttactcaacataaattaacatgtttgtggtaagttaaggccatgttgaaaaacataaatgtttttctgcagatttgctaaagagtagtggcttacttatgctcctaactacccctggctgctgtgctgcaacttggcatgactgtattttatattttattatgtcttcccttttggcaactcagttttctcattgttgcttgggtgtctgctttagcagtctttctttcctgtgaatttctgaaggtgtagataccagataacataatttttgtgcatatggttgagtacaggctgtgagtcaactgaataaatgcatggatttgacgacatctgttttggctgctcagaggttttgttttggtatatgtactctctagtacttaattttctgtgtaactgaaagataccttaactctaaattgatggtaccccatcccctcctctcttcattacactgcctaccaatcaataaaaaatctgatagacaattttaaatattaaatcacctgaatattttttatttgaaatataaaatcactgaagattttttttcctcaacgatttaaaaatattctttgcctttagttcagctttctcctctgggcctggctgtagactctatggaagtaattctgcctaataaaaaggtttagagatgttgtctaaaacactttagaaaagaaccgtctctctggcagttaactctcatggggataaagtagctttcaaactccaacaataatggttagttttgacgtatct

SEQ ID NO: 88737 - DNA, 1026 bp, Homo sapiens
ggataatgctcaaagagacaaattaccttttaataatagattgacagttatttttaagaaatgaaaaccaattttgaattgatatttgtaggcccacactgtgcctcaatgtatgaaacctcacctaaaccaggaagcctaatgacgatgcgccctttcctcttaactgtttgcagcctgcagttggcactgttcgtgatgcatggtctggttgtgccctgtgctggcatggagtcacccttagaaaatggagagagatatgttaggtgaaagggtcaaagttagaaagaagaggggaaggcatgttaggtgggtgaggaaagtgaaaggtgaggaaagtgaagtcaaatgagactttttgctataggaagaaatatggttcaccctttcttgacctggggttttgagaaaatctgcaggtaatatcagtaatcactgattatgatcagtgtggaattttgggaagcaggagcaagttaaagggaaacgtgtgctgtaaattatagactgaaagtttggtatcagtcccaaagtattattcagatggtttgtgagcatttagagtacctaaagagcaaatcatggatttcataaacatgggagagactagaagcattctgcagcaataagtggaaaacatccttggccaggggcaaatggttgatgaatctaacagggtgataagtaataggaataaatctaaatccttcctgtatggttcaaaaaagccaagagtactggcttggaattagagtaatacaatttagcagcaatatgtatgaagaagagattgaggatttggcttcaatgcaaatgaatctacaatatcatccatcttgtataaattatccctgtgatgttagtgcctcaccatcccctgcaaaaaaaaaaaaaaaaaaatcctaaaataatcttaggttgcatcaggaaagcaaaatgcccatattgaaggaggtgatagccttactctaccagtgctgtttaggcttctcataattctcacatttatttctagttcctgctttt

SEQ ID NO: 88738 - DNA, 1108 bp, Homo sapiens
atatatacatatatggggtaaatatatatatatgtatatgtatatatggggtaaatgagatgttttgatacaggcatgcaatgcagaataaccacatctcggagaatggagtttccatcccctcaagcatttatccattttaaaatgtacaattcagttattattgatgatagtcaccctgttgtgctatgaaatagtaggtcttattcattctttcatgattagtatttaaagagtaaactttaagtagtgtccaggggataggtggactctagaatagttgtagagtttgaatgtacacaaaccctaatgcaaatgagttatttcagagtcgggatacatttcaaaaaactccaactgactgtccctgacagtgtaaaactttcagaattcctcagaaaagtaaacctttgtctcaaaattatgctttgaagtttgaagataaaaggagagctgtctaaggcccaatgctcaaatagatggactaaaaacattttagaaaaattctggagaggttatcagaatttgaaatgaatgtgataacagatcccctatagttcaagtcctcagtagtgcgtaacaggatttaaagcagcttagctcagactaacgcatacaagaaattaaagccttttacagggttttgaaatgtgtttcattttctcaggaaagagaaaagcagattccttacttttatgtacctggtcacttaggaatattttgtactgtatggttctggtccgttcttagagcaatacagagaaacacagtagaacttattcaaatctgtgattgccagctgttgcctgggcagtgtttcccattgccttttggtgccagaatgagctagcattgttttggtgaggattggaagcctgtgccctgacatggagaacagtacatgcacatccccagccaaggccggtgaatgaaggtgtcatggtctgtgagaggttcagccatagcacctggtgctagagtaactcaacatccatatgcaagtgcagggcaaaattgtgaactaaaatggcctaaatttagcaaatgttttaaaaattggaaaatatctttatagacactcatttataatggaggtctgagttggtgt

SEQ ID NO: 88739 - DNA, 1083 bp, Homo sapiens
tactttgtatgtattttaatagatatattagtacagtagttcatatatatttttagcatggttttatcattcagtgttatggttataacttgaatccatgtgatatataactgttacttactttcaatcttttcagtattttataacataacttactaaaccatttgacttgtttctcatttattattattacaaaaatcactgctttgtgaacatttttgtatatgtctcctggtgcatatatgcgagaattttactagggaatatacctgcacgtgggaccattgggtcatatgttctgtgcatcttcagctttactaaatgctattaataattttccaaggtggctctaccagtttacacttccacaaggagtatgtgagaattctcatcacttgaaatccttcctcatttcttttggaagagtaaaaacgtttatttaatagatgggactgagctctgtctaattgattaaaacttttaagaaaaaaaatgataaagttattcttttaatcaagacagtgtagctaaaattgtttaagattccagatttttaaagaaaaattgagtatatgtgtggactattaaaatcttttctctcaatagaaggttaaaaccaagtctagaaaaatctactttttaattgtttattacttaaacatttatttcctcccaccctcctttagtcccaggtgctgttcccactgaatccatacaaggaagtacctttgaagagaagatatttcttcagtggagagaaccaactcaaacatatggtgtaatcactttatatgaggtaatatatatgtttgttagtaatttttaattagaaatactcatgatcatgataatgtaggctatctagtatttaaaaatgcatacttacataatatattttaagaagtttaatgctttcagtagttataatggttgttatatagaagaaaattgtaaaaataagtttttgaattatatataatttgaggatttagctttacaatgagttggacctttccagattatatgttattatatgttaagacacagcattacatttaaaaattacctttattaaaaacaata

SEQ ID NO: 88740 - DNA, 1051 bp, Homo sapiens
aaagaatgtcaattatcacttcgtataataacagtgttagtgttcatgcacataaattacaagtaagtttacctatttaaaagcaagaaaagtgctcagttttgcaatttaaaactttcgaatatgccacattttaaaattatgtcattacaaccagtagaagttagtaatcaccactaaagtgcatgttcttgaatagttgatgaactactcatagtgaaattctttaaaatatcatttgaaagggtaggatttaaaggcacctatgttatatttattttcaaacacttcagactcatccaacatgctttgaatatctgttatgtagctagtatcatgaaaacttctagaactgcactgtctcatatggcagctactaatcacacatggcaatttaaattcaaattttcagttcctcagtctcactaaccacatttcaaatgctcagtaaccagatgtggctagtggctacatttccatcatttcagaaagttctattggaagacattgctctaaagaaaagaaattaatatgacccataatgatcactctatttgtagcatcaggaatgactggaatctgtctaggattccagtcattggagcagatgtcctcacccacattgatgaaaacacttcagtgccctcgttcccaataggtaatgatcctaagtcaaattatggccactagattaaagatgaggccttatccttgtcagtatcttatctgtttgagctagttgtatattttcttattttgttctaaacccattgtaatgtagttttacaaaatgacattttgaaagcaaacaacttcaaagtattagcttaaccccgaactcatcctgtatattctaatctactggcttaagttcccctgtctataaaagtaataactcagcagctttggcggagttccttcatcccttcagtggattcaggatttcaagagtctgagtaggagcttatcataaagtgtctgacagtgcatacatcagaagggtttattggataaagatgcaatctgagtccatctgctccagatattttat

SEQ ID NO: 88741 - DNA, 1041 bp, Homo sapiens
aagatggtatagactgaccactgattgtcaaaactagtccaaaataaaaccattcatccatacttacttctgccacataacttgcagatgccctgcagcaaaaataaattagctctaaattttctgttgagcacagtcttccgatggggcctctgtgtgaatgttcttcagtcattttgctgagggctaagagatgagggtaagacccttgggctataggagtagctaaaaactgaaatattcccaaggaaagattctacattagattcatggataattaaggcaaaacacaaatctcattcattctggacctaaataaccttttcctgctagagaactttttttaaaaagttgcagtgtttactgtctgaggaaggcttataaaggttatgcttcttgcatccagaatgtgcagaaattctacagctataaatgtctcagcagcaaatgggctgtgtggcatgctacagccacagcctgctaggtaatttacgttgctcagggactgtagtttttcaatagattgaactgttagttttcaggaggatttaatgaaatattgaaccagatgccactggtctgccatagatgtgggactatgagaaatgaggaaatgtcactctgtaaacagcttggacctctgtgagtaggggaaaaaattgtgtccttagtgaaagagaatcacaaccaagagaaaacatggcagtttgggggtaaatgtgtttgtttctatgtccatgtcctgtgttcatttaaaatgggaggctgggtctaggacggagatccagaaaaattgtctgaatctggagaaagctaaatagaggctgagatttttccgagtctttcttgttgtccagtggtaatcctctgaatggccctatacagatgctcctggacttttgataggattatggtccagtcaacccatcataagtaagaaatgcagttattgcacctaccctacccaacttcataggttagcctagcctcccttaaatgtgctcagaacacttaggttagcctaagtgttggggaaaatca

SEQ ID NO: 88742 - DNA, 1035 bp, Homo sapiens
gaggttcaaattggaccactcagtgagtagcaccaatggccacaggtggtgaatatttcaagatttgttgggaactgaccaagataaccttgatttggccaatatcaacctcatgttggagttactagttcagaagaagaaacaactggaagcagaatcacatgcagcccaactacagaatcttatacaattcctcaaggttgcaagaagaaataggagagagcaactgggacacttccagaaggagctaagtgttttggaagaggatattaaaagagtggaagaaatgagtggcttacactctcctgtcagtgaggatagcacagtgcctcaacttgaagctcctcctgcatcacacagtagtattatggattccacagaatatagccaatatccaggtttcagtggcagttcttagacaaagaaacagccttgatataacagcacattaacatcaaaattaaaatggcccactgctcattttgaagacctggagcactgttacttttctacaaggttgtctcgtatctcagatgacagttgaactgcaagccaattggatgaacttcagaaatgcttgtccaaggttactcaatataaatcaatatgaactttagccacattatcatgccctagtgatctctataatgattccaggatagtctctggtattgaatttgaccaggattgtgactattttgcaattgctgaggttacaatgaagattaaagtctatgaatatggcacagtcatccaggatgcagtggatattcattaccgtgtgaatgaaatgacctcaattccaaaatcagctgtatcagttggagtagttaccataagaacctgttagctagcagtgattatgaaggcattgttatcctatgggatggattcacaggacagaggtcaaaggtctaacaggagcgtgagaagaggtgttgaagtgtttcatttgatggatcctaaactcctggctttgggttctgatgatgtaaaagtgaagctgtgatctaccggtctagacaactcagtggc

SEQ ID NO: 88743 - DNA, 1070 bp, Homo sapiens
cgcgacagccgtctgggaaagaccgtgagcctcacagcatggcccagggaagagtccctgagtgtgcctggaccaagatgggtcactagagtggtagtattgtctaattcctaggctaggagagtgtttccattaagagcctttttatttttatttatttatttatttttgagacagagtcttgctctgtcacccaggctggagtgcagtggtacgatcatggctcactgcagcctcgacctgccaggctcacacaatcttcctgccgcagcctcctgagtagctgggactgcaggtgcacaccaccaagcccttttttgatttttagtagagacaaagtcttgctatgttgtccaggctggtctcaaactcctagtctcaagcacttggcctcccaaagtgctcagattacaggcgtaagccactgctcctgaccagtaagtgcccttttaaagtaaatgggattcacttgaactttctataaaagatccgtagtggaagtccttagggatttgagatgatgaactattatgtaaaattataaatgagcaaaatgttgttttttgtattgttaatcaaatcagaaactggtttaaaagatttacaaaattcacaagggtatgaaaaacagaggttgtatttactgattggtctgtttaatggaaattgtctaatggaattgtctcatattttcaaatgggattttgttttcatggaatttaattagtctgattataatttacaagttcttttaaaaagtacaggagcagctttttaaagtttgagaaacagaaaaaagtaattgactaaagaaatttacaactaacatgcctggtccactattttcctcatagcagtgcctgtatcacaagcatacttatccaccatgaatctgtgtgtgcttttgcaagttgacattattgcttcctgagtgaagctgtagaaaccatttctatctagcaatgccgaattcttgatcttggttccttctgtttgactctcattagttttagcataaacaggtaaatgtgcttttttaaaagtatatttcaaaaaacaactccataaaa

SEQ ID NO: 88744 - DNA, 1035 bp, Homo sapiens
ctgggggtctgcccttgaatgttaggcggcatgacaagtcaaatgcagtccaccagggtcttcacctggaaattgactacttgtactttattctggaaacttagggcagagatttttgttagaaaacccagaatgagcatctcatactggacttaaatgcttaactgtgtattttattttgctatactgtatttgtacacagtcttctaagccatgaccgatctgcccgtgtttcacttaagagagaattaaggaaaatcatccagaattcccactccaaaagcccaagctctgcagccctgcagtgtggttttgctccatctggagagaacctcacacagactcccctgccaaaatgatgtaacatgatgactcagggatgtgagcgtgagaggaaccaacatttagttcttatacccacatatgctgtgtgttgtgtgattaggtttatttaatgaacttaatgcaagctgagaggcttgacaaaacgtccccttttgtggactgaagtagctatctttcagagaaagcatgcagatttagttggtgttaggttgtttatgttgaataaaaatctatttaaagacctggctgaagtgcattcagcctttcactgtctgcacttacaataaaaaagaaagattttattatgcatgacagagatccagattcttagagattgcctctttccctctggtctgtggaatctgccagaagccatctgttaatggatcttggaactggctgtagaaggcagagtaggttcctttgagaactgataggtccaaattattctctatccttgggtgccagatacgttgttccaaataagcattagtttgaatttgtaaagaaaacagctttgtacagtagtcattctacaaatagttttaagcagcattttgtatttatataagacaccatcctgctcgaccttcccctgggcacaaagctcacacctggtttacccttttcagagaggaggtgagtcacggaggtagccataataagtgttagaaaagagtgcctcctgct

SEQ ID NO: 88745 - DNA, 2136 bp, Homo sapiens
acttgcacatggggagcagttgtggacagaagaatgttactttaatggtagctagtttggaacctttttgcctctattttcaaattatttacgtgatatcaaaactgtctccactaaaatgattgctcaaatgtttgtcttcatgtctttattttgtatgatagtattcaaagaaagcccaatatgttcataaccagatttgcacaatctgaaggcaggtcccctgcagacagttccagagcttcttggtggcacaatgtgactattactgcgggtgggcatactccttccggctgtactgctgattccacgggatgtgagcccccactaatgcctactagaaatgaatccaggcccctttctcaaatcacaattggaatgagagactcaaccagctgtgttataactgcactcagcactaagagctttctgttagctattaacctgttaacagcccgcaggtgctagcgacctgtctgtggaagaagggataagatctggtctggtggtctggcggtggcttaaaagtagccccattgaggtgctctgagaatgccgttttgttttgaatgctacagctgcggtgtactcagcttactaactcctcttggcaggtcaccctcagctctgattgtttgtccaccatgtgtgtgtttgctttcatctgcgttaattgctgcttcatctgtggcatcatcggtcacctaatgcttgaatgttagtgccatgtcttcattcttcatccgtgtccctgtctgggccgcagctgcagccaagccgcagtgcctgccttctggaggtgtctgaggtaatatcttcatttggtcacccttcactgtataacacacttctaagattttttgatttgggtttttgttcgttttcttttctgttgtgcatttggtctgcatattttcatttttggcttgattatgaaacattaggtcttgtctaaatacttgaataaacaacaaatagatatttcttcctgtgctagtcccgcagactttttgtgcattgctgcccagcttttaaacgctggaaatggcaacaaagtgtttggcacacaagctgctgtttctaattataagctctataaggtaaagaccatcttcacaaggatttgggatatgcctctctctgttcctagtacctgtgtgaggtactttctgatgagaatattgccccacaaaagtgatgtaaacattattagaatgtgtgacgcctgccttggtgacagccatgcctgatgactgtggcacatgtcttaattaatgcattaatacttccatcttcatctttggcggcagtattctttataaagtatgtccaaatgatttataaagtatgtccaaatgtcctggtgcctccctggagctctgcccactaagtctatgctggtgacattgtacactcctggaatctgactacaatgtccttgactctgagataagagggccctacctgatggaatccccctcggggagaaagtgagatactgtggctccacgaagagcagcgggcactcagaaaccatttttctcttgtatatgaaagcattctccaaatgacccctctccctctcctgattctcccttgactctttactactttttcattctctaaatctgtgcagctgtacagcatgggcaaagagcgtaactaagggaggaagaatgaaatggattggacttacggaatggttgattgcaagttttctacatggaatattccagtgactcttttcctgcaggaaggttttgaacagtgactcatatatctactacaggccagccattttgttgatcacataatactcaaaataagatttttatcttctgaaatattttatttaaaagatgaaaaccttttccttcattattgctatgcagcaggtaaaaaggaagtgttagaatcatgattgtaatttgtattactgttttaaagtaatgcgtggcttctttaggagtgaggcacagcccttgtgctgctgctggtgtaacctgctttgttgtgggcgtgttgtcgtcgtttcactctcatccattgagggcatagaaggcgcctgtgtagctggaaacggtccctcaaggaggcgcagtggattgtgctatgctaataatagatagctctgct

SEQ ID NO: 88746 - DNA, 1090 bp, Homo sapiens
ataccctatattggcgtgtgccctgaaaattagtaattaaataatttaagtggctatattaaatacagcaaataagaggctttgaattctccaagcgttgttgtatcaccaaactgggaaaacagaattgcaggaatttttcaattgcacaaaaaccagatagaaaaatcagaataaggtggcatgctaactgtagtaaacgatgattgagctgacgttcataacttgcaaacctctagaaatccgcaccttatcattacagtgaaaactcaagtttatggggaaaaagagggaaatattaggattctgccttttcatagaaaggtgaaagcatgatcagtgcattgatgtaatctaattttctgaaaaggagagatttgtgtgggatttttatggtgctggcacacggtagatatttaagaaatacttgctgaatggaatcaacatttcatttattattctttggccgtacctgatagtagataatttagtatgtaagggaaataaatcaagcaaaggcacttttgagaggaatagaaaataaaagctttctcaacccaaatattttgggagtgtggaatcgtctctcaaagaaacatgcttttctacccccagccttcagagccaggcccaaacagtggcatttaaggaatgggcttaaatggggagtgctgaactagttcatgtttcctcattgggatttttgtcaactaaatcagtttgctcatttgcgttaggacgattgcctcaggttttgaattttgaggtttctatcctctttctttacattggacttaaagtcagtagaggcagctgacttcttaatggtgagcttcttaatgtttctaagattcctgagtatgctattcatgcaaaaacattttaagctacatcaaaattgccttttactatccctgttctttgattgtttttattaaaactcctattatctgtaatttctctggttttgtgcctccagtttctggattcttaagtcattgaatgtgaatggaagtgcatgtgagttgacttatactgaaaaccagattaaaattacctagaataaaagtttattaaagtatgtaattcc

SEQ ID NO: 88747 - DNA, 1039 bp, Homo sapiens
tttatatttctgctgtcagtatatggcgatgcccatctttgaaatgtggcttcttttaaaattccacagtatgcttcagaagatgcagagcttctcttagttggaaataagttggactgtgaaacggacagagaaatcaccaggcagcagggggaaaaggtgagagggcgtgggaggcacggttgccacacactgtgcttagcgcttgaggtactgtttcttttaataaattacttattttaaaaattacaaagaaattatcaatacagtgataactcagtcacatcctcctaatttgtttgcacttttttgacttcgtgctcctttaaattcattctgaaatggagggagaaaaaaacacatcagtgtatacaacattattatctaacctgacattttatacagagaaacatattttaagccataaagttgcttttataatttactttaacgtactttaaacttccttggtttttgctaaggattgaatcatggagaaacgatgctattcacatttaaatgtcagatatgttacacttttagaaacttaggcaactgatttgactggaaggtcccggcatcaccttcaggatttttattgtcttttgttttgctagttgcttataatgtaagaatttgctacacttgtgaactttatctttgagcgtcagtgggactttctaccccttaatcccagcccttcccttgaagctgagcccagagacctcatgctcgcacgctggtctgtgaggccccacacagaggaaataggtgtgtgtttcttctcagtttgcacagcagatcactgggatgcggttctgtgaagcaagtgccaaggataacttcaatgtggacgagatatttttgaaacttgtcgatgacattctgaaaaaggtaaaaaaaagaatctacattataaaagtatatcatctgaaacctgttgtttcctttattgcttttttattgagaattttgtatttagaaaccaaaatacagtagttgtgctcaggcgcaagaaccaggtatggttgttaactca

SEQ ID NO: 88748 - DNA, 2013 bp, Homo sapiens
gataacataaacagtcacttaacacataggttgtatgttatacgtattttataccatgttcttaaagtaagctagagaaaagaaaatgttattaagaaaatcataaggaagagaaaatatatttactattcattagtggaagtggatcatcataaaggtcttcatctgtgtcatcttcacattgagtaggctgaggaggaggaggaggaggagggattggtcttgctgtctcttccgggtggcagaggcggaggagaaggtgagtggggaggcaggagaggcaggtgaaacttgtattgaaaagcagctgtgtataagtggacctgtgcagttgaaactcatgttcaagggtcagctgtatgtgtaccttgtaaagttaaaacggatttttttttgtttgtttatacgttagatgcctctggatattttaaggaatgagttgtccaatagtatcctgtcgttacaaccagagcctgagataccgccagaactgcctccaccaagaccacatgtccgatgctgttgatttcctactttggagacaaagtggaaatgattcctggaaaggggaaaaaacgttctattctgcactacaatcattttgacaatttcctttcgcactttgtaatccaagtcagagctatacactaacttgtaaatatgcatatatgcaatcctgggtaagttttggttataagttacctatttccctccaaattattatatttcattcattaccccagtgtctagtgtacatacactgggaaacctagtacttctaatatgaagaatgggagaaatgaaaggtataatgtttcttgaaataaataatataattgtccttattaattatattatgaggacagaagatattctgataagagagaacgtggtgctttgcttaccgttttaaagaaaatttgtaaaactaaagactttttgaaaaaaagctatcttaagtgctttttctttatttacaagacatttcccccagtggtagcatctgaagtattggagtgtttctgccacgaagcaaagctccattcatggccgtcatggaaggttatttattaatgttacataatggtagaatattactagttagagggttggatttgacttggtcctaaggccacagaatctctctcatggcttcctaagggatgtacctttatgcttttaagaactacaaagattcaataaagaaagaaatgtttttgaaactatagaaaaagattttaaaacacgctgctgtcctaaacaaatcctgtttaaaggaattttaaagagatgcattttactatatcaaagaacatacgtgtatttgcctaaacactctgtacctttgtaatgataaaacttcccccttctttacggtgaagcttattctgattaagcctagactgtgttctttttttttttttttttttttttttttttttttttttttttttttggtctgatgatgaatttgtgaactctatctttggtatatcttttattaaactgcactgttttgtttagtcaaggtaattaagtaattatgtatttgaataacttggtgtgtcttgagtgttgtggtatgaaaagcattgtggtctttctacactaatgaagtgcaaataaaattttgtatttatgaatgaagttgagttgccatatttatttatccaattataaattgtatatatgacagtattctccatgagctccacagcttaatccttttgagtgtttagacaggaaaagcatagtcctccactggggaaaagagtttgatgttttctcaaagggctgaacatagagctaccatatgatccagcaatttgacttctaggtttatatctaaaagatcgaaagcagagactcaaacaggtacttgtacaccagtgcccacggcagcattgttcacgagagccgaaaggtggaaaccgccccaatgtccatcagcaaaataatggataaacaaaatgtgtgttctacaaacaatgggatattcatccttaaaaagaa

SEQ ID NO: 88749 - DNA, 2683 bp, Homo sapiens
ctcacgccttcatccgatctggtgtttcccggcctgaggtttggttttagcacgcagcaagcacttccgttgaagcgttaatcgagttttattttgactagctcttccgtctcttccaaagatacctcctgatttctaccaccacacgccagttttgcagttgttgaatattatacaggtggactcccaaggtatcccattgctgggcttttacaaaacactcactggctatgttcctatcggctctggtatcggtggcctgtgagctactcactcacagagctcaaccttcctgcaggtaccagtcaggactaacttctggaaagagaagccttaatttaaaaacataaaaaataaattttaaaaaaagctttcctaccaaattcctgattggtaactgtagtaacaaattcaggtcggcttccctgaccttggcttctgacagtctgggattcgtcacagcttcctggatgagtctctagaatgttttaaaatatttttaattttcatgggtacatagagtctctagaatattatgagacgtgtatacaaaaagtccaagcctgggcaaaatagtgagaccctgtctctacaaaaaataaaacaatttagtcaggcttggtgacacaggcctatagtccccactactcaggaggctgaggcaggaggatcgcttgagcccaggagttcaaggctacagtgagctgtgatcacactattgcactcagtctgggttgacacagtaagaccctgtctctaacaaaaagaaaacgaaaaatccatatgtgataatccatgccaaataaagttaatcatgatcattacaaaatgaaagtaatttccgtgctttacaaaatgattcactattaagttactttaaatagtaagctctcttcctatgttttaaaatagatgatctaaatgaattgaaccaattttcaggaatatattcatacctatatcaaggcatacctgattggaccctatataatttttgttcatttatttatttgtccctcgatttgtccagcctgccttattgatcagccgccccggaggggaggggacttgggagtgaggtcctgtggaggaggagggggtgagaatggaaactgtgggttgtctatcttaatgtgattttcctgactcagtgggctggcgaagactgcttggcatttgagacatagctacttcttggtctgtctcccaactagattgtgaagtgcttgaggacaggggacatttcagtctgaatgtgtctgccaagaaaaagagcaggagagaggaaggaaggaagagaaaaagggagggagggagggaagaaggaagggaaggaaggaagaaaattgtatataatagccgtaatgtctgtgtaggtacataaatggatacatagatacatttaaaccacagccttacagttattcaagtattgctacttctttataatctgagacagagaaagagcagtcattactctctcatacaagcttctttttcgtattgtaacctgagaatttagcattaattgctacaaaggaagcaaataaaactcacttgtgaaaacacaaattgccctgctgccttttgctttttttgcctgttgatataaattgaaaaatacaccaggaacaatcaaacttgcagtcgatggcattgactggaagaaggattaggaagtgagagaacaggttaaaatgtggtccacaattctcagcgatggctggagatcaggcttcaccagggaggagggttagctcaaggctcaggctcgtttaaatattttccccttcctctccttcctgtgaatttaaccaggaaaacagcacagtctgtcacctaggtaactggctctcctgctgactggtggagattggaaaccgcaccctttctcactgcaaatttgcattcgcagctgggcttcgggtgacctcgccagaggacagaaagctaatccaatcctgctgctgaatgagggtgcccggtcctacctggtccacctgacaggcatctgcctctgtaaggagtctgtttaagggtcccgcgtgcccattgctttccttcagaaggaggctggaaaatgcttttgatttgaaaatgatgaaaatgaaaatggtccttggattgtcactttgtgcaaaaccctgtatttctaattgggagaacatcgcttctcccaaccatgttcccgaagagcctgcaggttaggctggctgagatgaggacaaagaccttgggtgcccagtttagtcatgttaattaaaataaaaaattgaagtggggaggcgtgaggagaatgtgcctggacaataggaaccccaggccgtggtcgtcagctcagtgtttgttcacagccgctcctttctttgccccattgtgctgtcagctcggtgacttctgagaggggctgggcgccagctgtatgcaaagtgcagaggccctggggcgggtgcctggggagaggggctgcctgcatcacttctgtgttactcgttttctcttctcctcatggaataacagctaattcacacctttatgtaatatcggcgaactcacaccttcatgtgataacggctaactcacaccttcatgtgataataacagctaactcacgcctttagttgtaggtgttattctcaggacttccgtgtctaaaatgacttcaccctgaccataataacct

SEQ ID NO: 88750 - DNA, 1029 bp, Homo sapiens
actactgtactctagcctgggcaacagagcaagactccgtctctaaataaatataaaataaaataaattatgaatttttgtctttttttcatatactcagactaaataaaggcatttttactggtgcattcctcaactgacttttcttctatgtgtttgtaatctgtagtagaaaagataaccctgctcacactgttctttcatttctgagctaaggaaatttgtaatgctgcacattttcacttgttaattaactgtctcatctttgggtggttacattttaatccaggtgttagtgataaagttcccaactttaataaggttaagagagtacactttcccccttataaatgataaatatcttaccaggtcctccagctaatattagagtgtgaaatgtttccttaaattgatggttgaccaaacttcatttagttaggaaaagaattgacttatgaaattttttagtccttcatttgcacaactgccattttctttttataaaatttaagcagaaatttacaaaaagtatctcaattctggaggccacacgtctagttttcatccctccttgaaattttcacctggagttacatgcccttaagtggcacagtccgtggggcttgacagtgaatgctttacttcttctttaggaatttcccaatgcttagaagagagaactccttaaagtaagacttaacttgtttttgtaaataaatgagagatagcaaggtgcagtgacaagaaaattgcacagaggccaggcaacttgcagtgaggattttgaaatattaaacctatcgaaggggcacttaatgatgaacaaaatctttttatatttttttctataattgaatgagagtgtttgtaaatcattgaaaggtgagtttacctatgagatttgtttctctctctctctcttttttccctagagacagggtctcactctattacccaggctggagtgcagtggcacaattagggctcaccgcagcctccaacccctggtctcaagcaatcctcctgcct

SEQ ID NO: 88751 - DNA, 1040 bp, Homo sapiens
tgtcttacacatggtcctacataagacagtaagacaaaggccgacggacacacagctgtcattgcttcccatccactcccaccctctcctccaccagttgggctgggggcagacacctgacccaggctgggtcagttggattttctctctcaggagctttggaacacaggtcctgagaaaaggagctgatgtgctacaggcaacagagctgcagtgtcatatgtggtcatagcttgagctattattgcagtagaccaaagccatgtgcagagaaattacagaaggcgagagaagccacgagtgggccaggctacatcgcttggggagacaagcagacacaaggaactccacagtgcagagaagacagaggtctctgattttccagcatgatgtggctgcacgctgtttcatttctcagaggcctgagggagtaactgttatatccttagtaaaaccatcttttacttaatgttgactcaagtgggcttgtgttctaggtgtaaaaaagtgaaaagtgtatgtcccaaatctaatctagggacagaacctaattttatgtgatgtaatccccaaacttctgggaagaaactgactttttttaatttaaattttttttttcatttttcttttaccatgcaagacttcatcacaagaaatcaacatttttgattttgaaaaattaaggcaatttaatattaaactttaatggggttaagacttgttctgggaaacctgtttctcactcacccagtcaagcaagacaaaggtgacctttaatcaaacatccttttcaggttgtatctggccccttgatgaccatctgataaccaccttttttttttccctgtaaaatgtccctgccaagagaaaactgtattattcttttttttttttctttttttttgagatggagtcttgctctgtcacccaggctggagtgcaatggcacgatctcgcctcactgcaacctctgcctcccaggttcaagtgattctcctgcctcagcctcccaagtagctgggattacaggtacccaccac

SEQ ID NO: 88752 - DNA, 1092 bp, Homo sapiens
caaggggagttggctagcagatcctaaaacccaggcaatcagcccttcctgactgtagattcccgttggcctcgcacgcacacacacatatacacatcttaatggtgatttcaggacacttaaaattccctttcagtttaaaaaacctttaaatgggccgggcgcggtggctcacgcctataatcccagcactttgggaggccaaggtgggtggctcacctggggtcaggagttcgagaccagcctgaccaacatgatgaaaccctgtctctactaaaaattcaaaattagccgggtgtggtggcacttgcctgtaatcccagctactcgggaggctgaggcaggagaatcacttgaacctgggaggtggaggttggaggctgcagtgagctgagatcacgccattgcactccagcctgggtaaaagagcaaaattccatctcaaaaaaaaaaaaaaaagctttcaatggctatggtggctagttgcaatggtccattcaaatagaagaattagtttccactgccttactcccaaagaacacacacatcttacagaaaggtgagatactactcatgtgtagggtcatttcggttcccatcacagaatgcaaagaaaagcactggaaattcaaactgcattgtgtcaaccttattggttccttcggggctgctgagaagtgtacttatgtgttctcagtgcacagaggtttgctaaggaaatgtagagtgtcagcaagaccagggacactgttttcttagttgagcgaggtggctttattcagggacttggacatttgcatatcagcctcacgattgcagggacagcaggagctggcatgaattaggctggtacttgatatgctaattacagttctctataatctttgaaggctgtttggaaagagaatttagaattggagagaatggaaacgcagttaggttaaatgacatgcccaaaggtctcagagctaatcaatgggaaatttgctacgtgtttccaatgtgcgaagaatactacatgcaatacctcctttaatcctctcagcaattctctggtgagtattttattactattattgccatgctgtaagg

SEQ ID NO: 88753 - DNA, 1047 bp, Homo sapiens
cttctagttagttcccgaccaaattaaccattatcaagatgtttatatttcactgaattcacgagctgtctgacagcaacaaaggtcatatgaacattgtgaaatcaggagtgaaaacatggatgtgtcttttttctatttcccccctcatttgagatttgcagcgtacttaacagcaactgatgtggtatattctgtccttaaatttaaaaattataaaagtaaacactcaggttgaatatttggagggaaacattgatacttttgcacagcaaaaataaatacatatatttctcctttattcaagaaatttctcagcaactggaagtgctgctgtgagacttatcctgaaatctgcacacgctgtggttattcgtgcaggagaaacgtgggaatgtgctggttcctacggcaaaggccccggttggggcttctccctcccaagctgtgcggtgacgccagccacacatgcaaggacagcaaattggaagttggtcatcactgaggacttaggagagcttgggtgggtgtgtggggtagatctgaggggctaaggaaggggcacaatgacagggatgggtgctggctgtacccggcatgcagtagatgctcaacaaaggtggagtctcaagacagatggctcagaagtctttggggaaggggaaggagagggagttcaaagatgaacctttggagcccaatatcaatttaaaggagcagaaaagcagtgcagacaaggaggcttctcatctctaagcatctgcctgttcctctgccttctagaagacacttcctgttagaatttcaggctcatgctcctggccttccctcttctccctgcttggatcagagtctcgatcagaacatagctcctgggagaccccactggccttcaagacagacaaacaggaatagggggattgtggcaagtctttccccactcagtaatgtggagaaactgccacgggagataagcagctgaaaatgtttccatctatgacctaataagccaagtcaatttcacacacacacacacacacacacacc

SEQ ID NO: 88754 - DNA, 1811 bp, Homo sapiens
gccaagcgcggctcccgggcgccacccgcccgcaccgtcggccccccgaccccggccgcccggatccctgccgtgaccctcgcggtgacctcggtggccgggtccccggcccgctgctcgcgcatcagccacacggacagcagctccgacctctctgactgcccctccgaacccctgtccgacgagcagcgcctgctccctgccgccagcagcgacgccgaatccggcacgggctccagcgaccgtgaacccccacgaggagcgccgacgccgagccccgcagcccgaggagcgccgccgggcagccccgagcccccagcgctcctcgccgcgcccctcgccgcgggcgcctgtcccgggggccggagcatcccgagcggggtttcggggggtttcgcggggcccggcgtggcggaggatgtccgggggcgctcgccaccggagcgaccagtccccgggacccccaaggagcccagcctgggcgagcagtctcggctcgtgccagcggcggaggaagaagagctgctgcgggagatggaggagctgcgctcggagaacgactatctcaaggtgagccgcgcctcggccgcaggtgtcccggggcgcccccggagggcctggctgcggcggggacccgccaacccctccttcccgggcctgtccagcgccttctccctcctgctctccacggtcctacccccgcattgtcaggcattggcaacttaagcccaaacttctggaaggagaagcaagacctgtgggaccccgccagttcgcaacccacttctcttttctcgcgtctagaactcttgcgtctcttcgctgatacttttacttttgttgacctgttggggcagaggaggctgtaatcgttttggggacatcagcggacgcccccatccccgctcagaacgtgccagcctcacctgtaggaacaggtgatccttcgccagggagctctagccgggccacgtgcgggcgtggcggttcaggataatgccactggagggcccccggctacggacccgcttgccccttctcctgcaattacggaaagagctgggggctctcagggtctcctgggctccgacatcccgggtagagggggccgcgccgttttcggtgagcaagctgaagctcagtagaggtccttggagtgtggcccgggttgaggagcaacggtgttgcgcgggccagtcctttgtaagcatccaggagccggctttctgtgtcaggagaggccacgccagcactttctaaggaatcgcggcgcctgctgcactctctgagtattttccggcagggcctgcgggcagtggcgtcttagtcgccttagcactgggtgcttaatccggctccatcttttctccacggagggggcctggtgctgcagacggggttcccggggtcaggacgatccaggtgacttgagagaaaataaggggagttgtattgacaccaactgttttatttattgtgatcttcaggttagtaaacaactccagtggcatcaatctgtgtatctgttaagtcttaatgagcagccaaccaaacccaggggtgtggccctgcttcttcagtgggttatgtgatttgagctgttttctcagcaaatgatgagctaaccaatacgggcccagtttttggctagtgagattgaggattgggctttaaggtgcatggtggtgaagtctgcagttcacacggaaatcagagcacattaactgctgggtgatctcaagcctaaatttcttatggagctgctccaaccaactgagccttgtggttattttactttgtgcaagaagtaa

SEQ ID NO: 88755 - DNA, 2343 bp, Homo sapiens
attgttagtcaattcctgtttttaagaataaatacaggattagcatgagtggtaaaaatccaggaacaaagggaatagcaggacgagaatggacaattagggtgtctgagtataggagagatttttttttcttgaaccttaatattaattgaataaagtaaatgggaataactgagtgcatgctattctggaggcatctgaaactatcaattatgaaactagtcaagaaaatccctagaatgtttccttaatcttcctccttccaaattgttcctcctttaaatcttgtgtaacccttcagtagagtgaatatctcatacctgcagctacatctgtgggtttgggaagaagctttcatcactgggctgcaagactggaacaaagcgagcgtgcagttgtgtctgatgttagtcgcctttctgacttggtgtttgtaagtgttcactggcgcacctgtgtattcattcagcaatatttattgaggacctaccgtgtgctccatgctgctcgggatgcagagaggagaaagacagacaagcttgctcccctctgaagcttaccttgttagtgtaggtgacagacagtaagtaggaaaaaataccaatactattagatggcactcagaggtgggaagaaaatagagccagcaagagactagagactcgggctgatgagggtggccaggggaggctttgcatgacgtcagattatgtgatggaatgagctctgcagagatctggagcggggagtgttttcagaagtgggaatagcaggcgaggtcttgaggcctgaagaagcaaaggtgcgagcagtctcagaccctgtgctagtcgtgggcagggagggagtgtggccaggaggcctggaaagaaggaagcccctggagggtttgagtagggagtgaggtggtctgatttgcacattaaaaggattactctgctgggtgggggacagactgtaggaggattagagggccagctgagcagtgggcacctgtgtgtctccacttacatctgtgtgtggctcccctcccccagggatggaggcctggaccagggtgatccatccggaaggggcgcagctctggctgagggcttggctgtagaatgggaggggagggggagccaggaatgaaatgactccttgggttcccctgtattcagggtgcattcctgtggacagcaaagagtggaggtgtgggaaagtcagaataggtgaatgggaaaaaacagacccaatgtgtatttaaaataatggaaaatgtctcatttgtggatagcgtcgcttagtcaatgctgagatgcgtcttgtggaacagaatttttgggacatttgcaggtatgttttagttccagggcaattagcacttgttatcctactgaagtttatgttctttgaaggcagggtccgtatgattcatcttagtacctagattatgccttagagataaaggcttaggtcaatgtttggtttgaattgaaaggttcaattatctgcagagttgattttatttgatcatgtagggagatgttgggagtgggataagttctgagaggccacaatgaataatccagttttttagcttctggttacataagatttgaacagatactcaattatattatctcatatgcaaatttccagaggttctggtgcctgtcacccaggcgtggccatgaggtgatgggtaagcgtgtaggtattcaatatttagtattgaggagcgggtatgaaggagagacatgccatccttttttgatgtacttggctcataaatcttctctgtctgatttgcataggatgagttagatgaactccgtgctgagatggaagagatgagagacagttatttagaggaagatgtttaccagctgcaggaacttcggcgagaactggaccgcgctaataaaaactgccgaatcctgcagtaccgtcttcggaaagccgagcagaaaagcctgaaagtggctgagacgggtcaggtggatggtgagcttattcgaagcctggagcaggacttgaaggtgagtgagggggtggtgcgtgcacctcgcaaggctgctgtggaccggctggccacatgcacgttgccctggtgttttttccctgcttgtgtctgtctctacagattgcagcataaacagtcttggtttgctttatggcttatagagtgtgtgtagttatatgactttgacaccccaaggtttacatttgtcataatatgaactttaaaaaaatgatgattatttgtgataacgaagaattaatacctgccaatgggtctgacaattggatagaaattctgcagaaactctgaaagatctgaaatattttttttaaaaa

SEQ ID NO: 88756 - DNA, 2021 bp, Homo sapiens
ttagcagatgggttcagtattactttagtgaatataaatgtttatttgtttattattattcgaatttctcgcttaaagcacgtgagcttgggcagaattggcatggttggtgatcatctgtgagggaggagggttatccaaagtgggctttaaaaacaatttatttattttaaagccatttaaatttagcagtttgggggggttggataccaactttagtgacactaaggttagcacgttctgataatgcaccaccatcagaccagccagagtggccttttagcccagatgttgatttcatttttaaatgaatctcctcctccttttaacaataagtcagttgtgtattgccagggtctttgctatgtggtgtaatatattacttaatgattttgcctctgatgttgtctgatagtacccttagcacacaaaaagcctcatatcctgataatgatctctgtgggtcgatgcaggtagccaaagatgtatctgtcagattgcaccacgaacttaagacggtggaggaaaagcgcgctaaagctgaggatgaaaacgaaactctccgacagcagatgattgaagtggaaatatccaaacaggccctccagaatgagctggagagactgaaagaggtaatccaaaactgtgggggtcctgcccccttggatttaataaggaggagcttggaactccaagtgcccccttctcattgtggtcgaaagctggggttggcaaatcgtggcctgtttgtttggctcataagttagattgtttttacatttttttcctagcgtggtaaacaaacaagcaaacaagcaaaactcacaggaaagaaagcccccaaaagcaaagaagactatggattcaatactgtgtgatgcttgcaaagcctaaaatattttctatctggccctttgcagaaaacgcttattgggccctggtctaaagctagtttttgtaattaccactcagatgagctgaccattaattcctttgatgtgtccaagtggagcctattattgctagaatacagagttaagaagtagcttttttctccagagtcttctccagtgagctggaaagtatgttatggttgtctgttaaagctgtgtaaacagacaatgtatgtaacaccacctgtgtagctaaaatgagttaaatatagacatttttaaattgtagggagtgatttttctagcaaagtagtctggaaaatgaatatatatttttttcatttgcatacagcaatgcaaatcctgttttgttattgacttccattataagattaaagctgagtgttttcttggaaaatgtcctgcatgtgttgaaattaaaagcctttggcgaaggctttaagctcacagtgaattctggtgtgttacctgcacctgccagcagccttgcttagcggctcatttttcctttggaacagtttcctgattcacacagttcttccctatccatgccccctcccatctgctgcacctggttccggcctgcatgggctctgggtagggttgtgcatgtgcagtgcaggccctgctctcaaggcgcctccagttcagtcaggcccacagataacaaaacaaacaaatcacagcaaagtagcaggcgtgcccctctctgcttctgcccccacccctcttctcacagctgcctcggcctccctgctcttcccatgcatgccctcgctggaatgttctttctccaggcactcacctgtggctcattcccttatctctttcgggtccttgctgagattcactcagcccctcccctcaacactcgtgaaagttgtccccatctccaccctggccagccctgttcaccttcccatctgacatacgtgttctgggacattatttgtctattgtcaccgctcatctgacaatgctgtgtgttttctttctctgtcttttatccgtcccctcctttactagtgccccttcgtatcacaagctctgtggggcagggacaggggctttgtctggctcactgtggggccctcatgcctggaacag

SEQ ID NO: 88757 - DNA, 1003 bp, Homo sapiens
ggctgaggcgggaggattgcttgtgcccaggactttgaggccagcttgggcaacacagcaagaccctgtttcttaaagaaaaaaagagaaaataatgtatatagcttttgactcccccaaaacttaactaataatagcctactgtagactggaagccttcctgataacataaaacagccaatcaacacatattttgcatgttgtatgtattatgtactgtattcttataataaagctagagaaaataaaatgttgttaaaatcataaggaagagaaaatatatttactattcattaagtggaagtggatcaccgtaaaggtcttcatgctcatagtcttcacgttgagtagatggaggaggaagaggagggtttggtcttgctgtctcaggggtggcataggtggaagaagatttgagtataagtggactttcacagttcaaaagtatgttgttcaagagtcaactgtagaactatattttataaaattttatatgtgtatacatttgtgtataactaaacataaatatatattttaagtaggtgaagattctgttgcatacatttaaatggatttgtgtaggatttggcatctctttgaaggaagaaatgattattgttactcttgacattcaaaagcaaggccagagtgagacaagtatcttcagagaacctgatgctggctcagggtggatgtgaggagagaacggagagggatcagccctccctttgtgggttagaattactgagaggaattgttccattggaatgaaataagtattttacttccagagttgcattcagggtggtgggaccgcatatttacaccaaacttctaaatgaatcatagaaccgacaggagtcccaggagcgttagatgctggtagattaaactggaagcagagaacgatggtatctcatgatacaaggttcaaaggtggtggaggaaatatttattggaaaatgccagctgctatctttgtgaatgggttctttttgcaaaa

SEQ ID NO: 88758 - DNA, 1027 bp, Homo sapiens
attgaaaagagtccgagggaaccaactaagagacgacttcttgcggctgcctttcctcaagctcagaaaatgacatagattccctgggtttggttgagacttcttttgtgcatagtaaatcatcagattttgtaatgattcctgtgtgcttgagacgaatgtgttttggggtgcagactttgatttaaatctgttagattgaagacttcaattgtaacccacagcaaaaagggcatcatcactcaatatacaactatacaaaggttttacaaatacacaaaggtttaacaaagtaatgcttaactttgtcatttggggtacactctgttattttccattcagctaaaaaaattttttaatggtggttataagattgatttatagttcattagtgtgttgttgcaatttggaaaaatgtattgactcatttgttcgctgtattcaaattttctatatcctttatagcttttggtcccattataattgcgcattttaattttattcttgtaatttgtcaaactttgcgttatgtattttggtgccattttctttttttttttttctttttttttttttttttgagatggagtctctctctgtcgcccaggctggagtgcagtggcacgatctcggctcactgcaagctctgcctcccgggttcacgccattctcctgcctcagcctccggagcagctgggactacaggcacccgccaccacgcccggctaattttttttgcatatttagtagagacagggtttcaccatgttagccaggatggtctcaatctccagacctcgtgatctgcccgcctcggcctcccaaagtgctgggattacaggcgtgagccaccgcgcctggtcttgataccgtatttttaagtgaaaacagatttaggactcttccttgtgatgagttattccctttatcagttggtaatgacctctttattctaatgtattgctttttgctgtaaattcttttttatctgctttcatcatctataccaaatttcttttgggtagta

SEQ ID NO: 88759 - DNA, 2073 bp, Homo sapiens
agaatgttgggggtgggggcagttaggtgtgtgtttgttccttgcatcgtagatatgctttcgtgtgaccttcagcagtgttcctgggacaaggggagcaggaaatggggagggcattcatcaggcagttggcatttgaacgtagacactgttcatctttgggtgcggatgtgctctggttgcccaggcaaagccgtgttcattgatcagacatctatctgtgtactgtttagcactcaacagttgcgggtagaccgttgccagttgttttcgcatcacacgtggctcatctctcctggcaggggggaggaaggtgagagctgaggacgcagtgcctgggagccagggcgcagggcagccctcgggactgtcagaccacctcgggggctgaggtgagacgaggccggggagtgtttgatcttctgtgtttattcatgggcattagtaaagctttttttcataaatgagagaaacaaaatcactgctgaaaaatcctccatgtattgtttctgtaaactataggaaacattaaaatttgaagatgatatggtttttcacaagtgcctgtctgtatctgtgtcggcctcattttttgtttgtttgtttgtttgtttttgagagggagtctctgtcgctcaggctggagtgaagtggcgtgatcttgcctcactgcaacctttgcctcctgggttcaagcgattctcctgccttggccttcccggtagctgagattacagatgcctgccaccacacctggctaatttttgtatttttagtagagatggggtttcaccatgttggccaggctggtcttgaactcctgacttcaagtgatccacccacctcggcctctcaaagtgctgggattacaggcgtgagccactgtgcttggccgttagtatcctgttaatgattgagaacctcaagcattggcactgaggaggctacaggagcgtcctcgcaggtgggagtgggccggccagctggctgggtcagtggtggggcttggccaggccgtttttacttttcaatcttgaagtaacactcagagtttcttgtttgtttccaagggttctcatgtgtaggaatcttggtttgggtttggatatgtcgtttttatcttcccttgagaaagagccataaacattattttgaacttatttgtaaacgaggttactcacagggtcacctaagtaataaggcccagttgtcatctaaccctcgtggaaacattacaggtgagggttgctagaggaatcacttgagtaatctgcttggagcagggtttctctgctgtcgttttagactgggtcctgcttcgttgtggggactatcctgtggactgcaggatgcttaacggtgttcctagcctctgcccactagatgctggtagcaccccccctccccaatttgtggcaatcaagaactcttttcctcctccaactccgttgaagctttggagggaagagtcatcgcttgaccctgagtactttgtgttgaaggatttcaactgtcttgaaggatttgtttgacaagattgtgggttggctgcacaaggtttgttctagcaccttaggaaaactctcttgtctcccttcttactgtctcaggtcacaccctgctccggagccatccccgtgaagtctccagcttggctcattatgtattttctgaagggtaccctgcattttctagctgattgatgagatgggtagaaggtgatacccatgttcacctttgctctcaaccttttgcaaaacacccttttaagtgactctagatgtttgggcccttctctgtgggaagattagagggcggcagtgccaggagcaggttttgacaagtggtttcttgtgccgtcacttttactgaggtggtgaaagattgtacagtgcgtgcctgggatcaagccctttagctggtgatgccaggccctggctgcacggtagcatccctgcggagcttttaagaatcctgctgcccaagctacaccctggcccctacatcagaccctgggggtggtgacccaggcatctgtggtttttagaacttccctggtggtttcaggtcagc

SEQ ID NO: 88760 - DNA, 1035 bp, Homo sapiens
gagtgtttcccgatgctcaaagcaactcagtgtcagggcacacctccccttgagaaactcagagctcagggagagtaggtggcgtgcccccggtcatacaacttgtgaatggcagacaggaccttgtgccagtaggagccattgactgtaggggacagaacaaatgctttatatatattttttttaaccaaaatatcttttccttttctgaaaagaaatggggaaattcagcagtatttgtgtgaaatgtataaatttgcctactatcatatattaaggctgtgtgtgtaggaaataaagaagacaaataattaagtccttctcctcactttttaatcctgtgtcacataagcagccggggtatagctgcttccatggacaaatcgtatttcacctgctctgccattgattgaaaggtacaccattaggagaaagtaaaacatgctgccaattacatgatgacatgccatagatcataacatgcagcctgatttcagagatgttaaaatgtgacatcatgcatcttaaaatcagtgaaatacggtatgtgtagatgctccttgacttatcatggggttacatccgataaacccattgtaagttgaaactatattaagtcaaaaatgcatttaatacacttagcctactgaatgtcatagctcagcctcgcctgccttaaacatactcagaatacttacattagcctacagttgggcaaaatcttctaacacaaagcctgttttataataaagtgttgagtgtctcatgtatttattgcaatactgtgctgaaagtgaaaaacagaatgattgtacaggtatttgaagtcgggtttctaccagtaatgttgaaaagttatacctggaaccatcatacattgggggccttctatatccatgtattttttttttttttttttttgagatggagtctcgctctgtcgcccaggctggagtgcagtggctggatcttggctcactgcaagctctgcctcccgggttcatgccattctcctgcctcagcctcccgagtagc

SEQ ID NO: 88761 - DNA, 2116 bp, Homo sapiens
ctgcccgccttggcctcccaaagtgctgggattacaggcgtgagccaccgcgcccagccaaggagattgtaaagaggaaaagaggaaatgagagtaacatttcttttctggctgtaattgaaacaattgctttgtccttgtaaaagatgttaatgtctcctgcagcccatcctgctgagtgaatttggaggcaggcatcatagtaattggttagtcaagaaatagtcgtatattgctctttttactcacttatctgtaagttgtttttaaagcaggttgttttccctttaatcaaaatccagtctttagagctctcttactcctatgtgtttagagaagcaggaaccctctgaagcatccggaaatccttgagaaacaagacaatggccaaacatcagttttatttgtatgttacagccctgtgaggcaggtggattattttatcaccctcatgggacagataccatgcggcccaaggaaatgaaataactcaattttttattttagcttattaattaactaattttttgaggcagagtctcgctctgtcacccaggctggagtacaatggcacaatcccagctcattgcaacctccacctcctgggttcaagcgattttcctgcctcagcctcccaagtagctggaattacaggtacccgccatcacacctggctaatttttgtatttttagtagagacaggatttcaccatgttggccagactggtctctaactcctgacttaaggtgatctgcctgcctcggcttcccaaagtgctgggattacaggggtgagccaccgcacccggctgaaataactcaattttagattactccttttatgaagctgtgggactctaggcttcctgagggcaggggctgtgtggtattccttgtggaatccacagccatagcccaaggcagcacctgggatgtcctagttgcccttacatttgttgagttgagttgaaaagtgaacaccagatcagatcttttgcctcttaggtcttctcaccacagactctgtgttctttccacaaagcaaccctaaattgtccccttttacataggacagtaccagagcccagaatggtgaagggacatggccaggattttcttgagtccccatcaaatgttcttactgtacagcttcatgcatgcaggtacttggggatggggaacactttgaagtgggatgggtggaaggagtttgaagattgtctgcatgaagttagatgtctggactgcaggaccctggttcattacagtgtgttaattactcaggaataattatgtctggctgcctggctgtccttttccctgccgtccatgtggaattaatgagaacactttggtttcagtcattcatcaatgttctttgttcagcttctgctttcctaactgcaaataaattgcttataatagcaagtaccttttattctattgttaacacttgagagtgtttaaaggatgggtttcaattggattccttaatagaaggaactggctgcttttccagggcaaaaattacctgaatggcaatagcaaactgtgcaactaagtaaaagattatgggatgggaaacataaaaaggatataacagctaaatggaaaactgtgactgagcaccaactcatgcacacccaaaccaggaaggacaggaaggaaataagaaaacaaaaatgatttacttttgtgccaagcagcacagactcgcaaatcagttaatgggtacggtaaatgatgatgtgcttgctgttcgggagtttatttctcagtggacttggtggccatccaggaactcatcaaatcaacttaatggagagttaaatggctcttgaaacaagctggcttgaagcagctgggagccagggcctgtgttcgcttgacttagtgtggctccgccgcagggtgggcatcctctggcagaagagcttgtttttcgcaaggaagagtgggtctgaggggaagctgctggaaaacagttgcctgtgtctccaagaaaacgcctgcttccttgatcctattcagacctgccctggtgtcctcaggagctctaatgcagggcaaaaaaaaaaagcactgtgctatggagccaagcctaatgatcttcaga

SEQ ID NO: 88762 - DNA, 1052 bp, Homo sapiens
aatgtaaggatgcgtgagatacctgtctccaacctttccacagactgcttttatctgttccctctcctgctctccctctctccctctctccctctctccctctgtattagtgcgttctcatgctgctaataaagacgcacctgagactgggtaatttataaaggagagaggtttaattgactcacagttccacatggctggggaggccttaggaaacttacaatcatggcagaaggggaggcaagtccttcttcacatggtggcaggaaggagaagtgagagctgagcaaagggggaagccccttataaaaccatcagatctcctgagaactcactcactatcacaagaatagtatggaggaaaccaccctcatgattctgttacttccatctggtcccacccttgacacgtggggatcattacaattcaaggtgaggtttgggtggggacacagccaaaccacatcaccgtcgtttcctttatgctgactatttcaaagcaagtctcagatacctacacacgtgttatttagtacttctgaatttcttatttttgtatggaaaatgtaaagcatataacaaatggaagcagtccatggtttatacagttttcccttaacaaagctcacctttagggaggaagtgtgacaccaataatatgactacaataatactgtggactttgaaaacacatgcaccactcatggacctgtatgcctttgactttcactttgaggttggcaatagaagttattactgttgcttttctacttatcacaattaaaactgtatcaccttattaaaactatttagaaaatttgaatgagttactttaactacttgggaaaattgagtaatttactttaaactgcttttggtggagctgcagatggagaagtcccgtgtggaggagctagagaagatagtctaattgtgattcattgatagtttcctgttccttagtacaggacattgttctagctggctagtaaggctgaacaatttttaaatgacatatccacatgcaaatatataacatacgtaaatgaatt

SEQ ID NO: 88763 - DNA, 4091 bp, Homo sapiens
gtgactccccgaaataaattcagtttatatatatgtaaataaattctgaagactctacatgtgtgtgtatatatacatatatatttttgtattaacgttaatagtaatattaacatgagttcagggtattagccagttctgtctttcgggatgaagtcactggattgaggcaagacttcagtgaaggaagccatgtggtttgtaaaatgaaactgacaggggacctttgtatcttatgttcaggtgatcacagctccttcttgggggtcatcacagtcacctaagagattgagttccttcaaagcagtttcttgtgcacaaggacagatggggtgtcctctgttcactctgctagcacatgatgctgccgtcaaaatggcacacatcatctctacttttagttctgttataaatggagaccctggacttgcctcagatgaccttgtgagatattttatttgtttggcagcattaaaaggtggagccttcgatcagccagcagcattttccattcctgggacatcccttcttatgcagcatctgcaagctcatttcataaaggcatgggagagcaattggagaatgacaggtgtgctgtggcacccccaaatgcagttgccgctgcctcaggccttaccagtaatgacactatatcagggtggggaggacagtagggacaggttaagagttggccagcctggggctgcaagccatgctgtcaccatagcaggaggcaaggtgtatggagaggccaggctggctgcggacggaccacatggatctagggtcctggctcagggtgttcgatgcactctgaaggcagagggtgctgtggttgaaaaaccacaggaggtttttcaagggagaatgatatgggcagttatatctttggaaggtaagtggaggaagagtgaagtgagaagacagagccagtggagaggctgtggccgtggcctaagtgagaagaaagcagagcctgagcttgggcagatccaatggtgggcccgagagagtgacaagagcacagggatggggtttggccacctgtaaatacctgtaagcacagtgcctcccactggccctggccctggaccccagcgaacagggcttagggcatgatcctggatcgtacagacatgggggcctattctttccttggcaactatgggacttcgggcaggttgcttaatggcttgaacttcagtgtctgcaactgtaaaactgagttgttgggacccagctataaacttgtttcgatgtttcagtaaaataaagctttgctctaagagtaactttactactaagactaacataaaactgtattttcagtttgtttctgttaacccatagggaatattaaagttgctgttagctggatggtaatgtcattttattttttatatttgtttttatttttatttatattattttgagacagagtctcattccatcacccaggctggagtgcagtggtgtgatcgcggctcactgcaacctttgcctcctgggttcaagtgatcctcccacctcagcctcccactgagaagctgggattacaggctcatgccaccacactggctaatttttgtatttttagtagagacagggtttcaccatgttggccaggctggtctcgaactcctgacctcaagtgatctgcccgcctcagcctcccagaatgctgggattacagacgtgagtctctgtgcccggccagtaatgtcattttatgtctttccctggtgtgactgcctaagcgaaatatgcctggagagagcccggtcctggagggtgcccctcctccagggtggggccccacctgctgctctctgtgccctgggcaccatgcagaaaaggctgggcagctcgggccagtgcattctgcgcttgtctcctggctggctggaggtgcagaggaaggaaggaagtttctatcttctaatcagatggagggcagggaggaggtgttgaatgctaccagttcttccttggggttaccaacctggaccccaaatgcctatatccagaggacactgccctgcaacggtcttgagaacatttttctaggcatgggaaaagttgtaacaagattatgaacatgctttttgaatgcattgcagttataatcagattatgtgtctgatttaagggagtcttggcttataagagtgctttattttcattacagggaaatgacttgctggtaaaactgaatttatttccgggagtcccaagctggtccccctttggcatagctgggagtgaggcctgcagttgccttctctggatgcgttgataaagttactggcaaggcggcctgagtgctgggtagggtggacagatgcagtgtgcaccgtggccaggccctctcgtgctccaaggaggaggaggatggggtggacagtgccctgggcagcgggcccccagaaggaccagtgggtgtgggcatctgactgcatgtgtgcatgactcatgcacacatcttttccgcacatggactgtgtctggattctgttgagaacaaaatatttatgcaaaaaaggtctgtaaggctcaggctgctgatgactttgcactttcacttggatgtttatgtagaattttcgacatgtttggacatagcttgtgtgtgttctgtcaaaagaaggctccagaaggatatttcaccaggtcctcagttgtctgttttaagttttgcatgcgtagacattaaacatgcctcttttggtgaccacccaggagtgaaacgcgatgcttgatctgtgcttctgaggatgtaagtgatgttgccgctactgttactgctcaaaagtgggccacctaaatccttccagaatagaatggtattgttttgggacaagataactgacattttgtgctatagtttctccctggactgcaatttttgacactcatgtcatcaacactctaaaaacaaacgctttttggttttgagggttttagctccattcccttcaatagtcaaggaaatccgaggtgaattttctcattggtctgagtcacctggtccagtgcaggacggggtaggtgtgaggcagatgtggggggtacagttgaagtgaggttggctgctgttgcagaagagggggacatcacaatacaaaaacaatcttttttgctgttatgaagactagacgaggttagaaatgctctgagttggggcagatggagccgtgggattcgcttgtgaaagttgtttcattgacctgcacacgaggtgttgaagacttagctcagggcagcggtgacgcggaaaagaaacgtttaaggccaagctgctgcagactgcactttcacttgaatgtttgttcagaattttagcatgtttggacatagctggtgtgtgttctgtcaaaagaaggccccagagggatatttgaaaagaggttgttgataaatctataaggctgaaaggtaaagaaggagcgggatggaaaggaccccagagctttgactctaggacatcccgatgacagagatagagatggctgatttggggagaagagggccaggtcagcattgacttgctgagtatgagataaaactaaatataatccagtgttttaagttagaacattaaaaagttttattttgagtaagatgtgtaaatattgtgactttataaaaagtcatctgcctatccaaagtactgagcagtggttttgaaaaatttgttaaagttttctcttttactatttaaacttccatgtactagttgaataggaactgatagttgttaacataacttttaaatcgaattttttttgtgttattgctttctttagcaactgtgcctctcttttttatgtttgatttgaaggaaagttttaagaaggcctggcctggcacttgtcccagaggaatgcatgtggcatagcaagttaaagagtgcaaatgtctgctgtcttagagggctgagtttgtatgctacagacccacagagtatttccaaggttcttggggggtaactatttaaaaatctttcttgttaccatcccaattgttaaacacaatagaatgatattgaaaaatattgtcataaagacagtctagaaatgatgaagaatcaa

SEQ ID NO: 88764 - DNA, 2959 bp, Homo sapiens
caacctttacatcctgagttcaagcaattctggtgtctcagcctcctgcatagctgggatcacaggtgtgcaccaccacgcctggctaatttttgtaattttaatagagacggggtttcaccgtgttgcccaggctggtctcgaactcctggcctcaagcgatctgcccaccttggcttcccaaagtgctgggattacaggcgtgagccaccgcgcctggcctctcctttatttttaagcaagcatctataaaataaccccatgtgtataagtgtataatactctaccaggagcttttgggaatatggaagaagtaaagggttcagttcttgcccttggctttataacatgttagaatgatgagacagcattacaggaaacaagcaaagtaaatccatcaagtgcctggtaatgagataccagtaatgtcagagagaaaagggaaccaagtcgttttgtaagattttgatggaatcttatgatagatgcagagttttaaatttgtatttttgcagccatagccacccaggttcctagtagctttagtatagatgcgtgcagttctgcaaaatgcctgctatctaatgttgcctttttcttcccaattctgttttatattctctcttgttctccatttcttggtccctgtctctctgatgtatgaagtaagtattagtggaaagagggcttagctcttcaatctttttgatgggaagaacatagcttgcaggtggagtacacctgagagtctccagctctgccctgactccctggtcctttttacctggtggcatcagagagcccctgatgtgagcagcctggtgcgtttggtcctgcaggggttatcttgaatcactgataatatctgggagtgcttcggtcacttttttgtgaaagtggctatgttagcgacacagcacatttgagtaacaccgcctgttgcaccaaatgcccccgtgccacggctgctcttgctgccactctgagttaaatggtaacttcttaatgcataggacgactgtggctcagcgccaccaaaggacttgcccaaggtcacacgcgtgacaggacgaggggcaggacctaggccttctcctgccaaggtcgcaggtgctatttgggatgtcgtttgttgcttttgttgttttaaccgggattggtttgaaatgaaaatgaccacatcagcacaaagcaccgtgtttagtccttgattttctcctcaacaggttggagtttaacaagggattgggtggtggcgaggtcgttctttggccccagtcttgcagcgtgtgtgagtgttactctttatgaaatgctgatgaaccaagccagctgtcatttctcccaggagcacttcagggacatctcacacgcttctcctcactctccctgggaccaggtctgtcccagaaaaccttcctgaggccatgcagcttctgagttccaggacatctctcgggtggccccaggagaacctgacctattttgtggcagatcatgactatttttagagtctaaaccacctttaaaagacagactatcatcctctttcagagaatatagtccaatcaagtcaacagaatgttcacagggagtggggcacggaggaggatgtggttttggaggttatacagtaagttatgaagcatgacacagatgtgattcttttcatctattttgttaggtctgtattcagagtaagaattattagccaggcatggtggctcatgcctgtaatccctgcactttgggaggccaaggcaggaagatcactggagcccaggagttcaaaaccagcctggtcaccatagcaaaaccttgtctctataaacaaaaacattacttaggtgtggtggtgcacacctgtaatcccagctactcaggaggctgaggtgggaggatttcttgagtgcaggaatttgaggctacagtgggccaagatcgcaccactgcactccagcctgggagacagagcaagaccctctctaaaaaaataaagaataaccatgcacaagatttaacacgttcatactggggtctctcttgtaggtcagggcctttctggaggtcgtcagaccatgcggtgacttctaacccatgtcacatttccactacagaacagtgtgagatttcagccttagccatgaaaaagaagtgtgtgtgtgtatgtatgtgtgtatatatatgtgtgtgtatatatatgtgtatatatgtatatatgtgtatatatgtatatatgtgtatatatgtatatatgtgtgtatatgtgtatatatgtgtatatatgtatatatgtgtatatatgtgtatatatgtgtatatgtgtgtatatgtgtgtatatatgtatatatgtgtgtatatatatgtgtgtatatatgtgtgtgtatatatgtgtatatatatgtatatatatctcaaaggcaagagatccaaattctcacttaggtggagtttcaggaatgttgaaggagagaggcaaacttgttggagaaaagaaaaatttagagcctttaaaggtgaggaagaaaggaaaaataggagtgtttttatctctttatgcagtgaggtccagaatccagccattgtcagttctgagcatctgggatgtggccaaaccgcagggtgcttcaaaaagcctctgaattcccaaagaagttgcagtgaatcccaaggaatatatttagtgggcaaggtctcctcttagagcccttccctgtgaagttagctggatttctatctcctagtggctgtcgttgtctaaggccccagtccctggtggatgtgacacttgcaaagcaaagggcactgcagacaccctagtgatgagtgaggggagcagcattagcaccgtggaactgtcagccagagagctacaaggtagggtccccaaagactggtaagaggaccccagacacaaggaagatgttgacctgcattctgtcattttcatataagaag

SEQ ID NO: 88765 - DNA, 1012 bp, Homo sapiens
tcctttcccgctgtgcttagatcattttgagactgctttttcccaagggcactctgagacccttctagcaggagagttggagaggttctcacttgtcacaacccaaaaacaatcttatgggaagaaaacttttcaaagagccaaaggccataatgaggctattacaagggagttgcccttccaagcccaggatttttaaagaagcatgtaattggcataaatttccagaaaaaagtgtgatggccacaaatgtcaacgtgttattataatagatttcctgtttctaccagtaatctagaaaatgccagatctgggtctgcggggggtcccagagcttgaagcgggatagaggtggcacccatcagtgagaggtgcacgtcctggcagagggagggtggcgtggtttgcgattcccggtttctccagggggccccaggggctcatgctcatggggccttggtgtcctgagggtgggtctgctccaccacagcacatcggggctatgctgtaaagtaggtcagaagcgactccagctgtatgagaagcgcttagacccctatttgccccctttgggagtcaccaaaatcccaaagccacagcacattccttgtcataccttcttctggaacatgggctcacctcatgtccatctggaacgcgagagcggtcagcaggaggtggacagtccctcagtgagtccaacctgcctccttgtaagtcccttctccgagatgcagtgccgggctatggagggtctcaggctgtgaggaaggagaacgggttcaaatcctggccgtgtggtgggcaagttacttcttctgagcctgttccctcacacaggaaatgagaacaagagtccccacctcatattggtggtattaggattcgggatctcaaatataaaatgttggctgtctaaacttgttagacgcagatgcaagtgccatgtttgctaacgcccctgacattctctagggcagtgccttgaggggtgtgttgtcatctcagcggg

SEQ ID NO: 88766 - DNA, 1033 bp, Homo sapiens
ccagcccagcttgtgtcacactcttatcagcgtctcaatttccatctaaacccaaagctcttgtatggaagaggtttcctaacttcttttccttttatttccctttcctttgcttcacgcttctacatatcctttggttcagtggtctctctcagccttattgctcatttgattttaatatgttgacaaaaagtcttgtcagttccaaagaggagtgtctgtcctttgctaattaggtcctaatagcaggggagagaacacacatcatcggttttctcctggtggtttgactcatcctataaattgtatgtgaaatcacttttgccattggctcttggcatacttaattgcattgtggaaaatctgacccacttacctccctgaaatgatagaaataatgccctcttactgtgggagcgaattttgttgttgaaatttttcctatgaattaacagattgggatttttatttcagactttatatacttggtgaagttagggttctaaattctgttctatatatagaatatatagaaatcacacagttgaaaaagttcatacttcaaacacacattttccatgcagagtgaaaaagcctgttttctaaacattggtttttctcctagagagagaagaaagccaaaatgattaatagtgggtctttttttctactttgaaaaaaaggagggggtgattaggacttgaaaatattaaacaagaagagaatcataattggcagggtaatattgctttttatggttatcacttgttaagcaaattacttcatttgatctttaaaagaatgctttatataaggaaggtactattctcacttttttttttttttgagacagagtttcgttcttgttgcccaggctgaagtgcggtggtgcaatcttggctcactgcaacctctgcctcccgggttcaagtgattctcctgcctcagcctcccaagtagctgggattacaggtgtgcaccacacacccggataattttttgtatttttagtagagacagggtttcaccatgt

SEQ ID NO: 88767 - DNA, 1038 bp, Homo sapiens
agatgtgaggtctgtcccagcagggagcagccacatcaaagaaggaagcaggcagagcttccagcaaacagagctccctgactgggcctctttccttctgtccactcagaaaccattagagtccagcctgattgcacaaatggatctagacagccccaggaggagccatcccgacacaatgctgccacaagtctgaataatgcacacattcacccttatgtacccacaggaggtcttctggatttttatagcttgcagataaagatccaacaacatctggattttctcagatgtgagaagctggtcatagattggtgtcatttagaagacaaaacatgagattgatgtgttttaaaagcacgcagcggatgctgcacacaagaaaggcgtggttaatgagcactccaggcctgcgtttcagcagggtgtgccaaagaatgatgcctcatgaggcctcctccatcatcctccatgtagcgcctgttgtgtgagctgatccaccgagctccccactaggtgaagcatgagttgtcggaggtctgggagaaaggagcagctgtctctgccgtggctgctgcagggacactgtgtaggctctgtgccctggtctgcatcagaggctggggcctggggcgccccagtggggacttgcagacgatagctttagctgttgaaaggctgcagtgaaaacaccagctctggcaactgatcctgcttttcaacattgtctgcaatgttgtgtctcataaatataatatactagcagagatattgacagttgagggtgttaactttcttagcctgtgtgttcattccagacagcaccagagataatcaaactgacttctttggttttcatcacatgaaaccatggctgttttgtttttctgctgaatgcctgctcccagctgtagccctggcccagccgccttcctgggagagggctgggcaggacagagctgagggtgggcaggtgcagctgggacttccctccctctgttctgccctatgcccatccttagtccaagggctgggtat

SEQ ID NO: 88768 - DNA, 1031 bp, Homo sapiens
agtgcttggagatgagaattgctgaagatttgcccaaggggcatcagtagcttttgtggagtaatgctagccagtgatgcttttgatatttcagcacagtttagtagatgatttatggaaccaagcagtggctccagatagcaaggatcctaggcaggtatgggtcagtaagtcggacagggtgttattaggcctccctagtggaagagtctcttggataggaagccttaagcctgggaaggcaattagggtttcagagtttcatttactgtcctcaaatatacattaagccctactttgtcctctgcacaaagatgtatttgatgatccccagtggcacagagctaatcctgcctgggggttaatcctgcagtttaatctcctgttcatttctgtctgacttgagtacccggggtccatcagtcttgtccatcatttccaggtgaggcggagcagaggtttaatggaggtgtgggatgtttgcattacgctaggtcaattccattgtccttaaaaaatgagaacctttctgatttgaaaaaaaaaaaaattaatcttgactatttgggggaatggaaaaaaaatctataaacaaaaacataaagtcatccataattctattccccattgataagacctgttagcgttttagtgtatttgcttccaaacatttccaagacaaaaatatttaatcttgttgagatgatattaagtatatatttttaatcctacatttaaaaggtgaatgttttatgaaaaattttgtcattaaaattttttagtaatcacgatttttaatggctacacaatattatattaacttttagtgcaaatgaaaatttatgtgcctgatttctttcttcccaacattttattttgaaaattttcaaacagatagcaaaaagagttctgtagtgaaaacacctgttatccccaccattcacactgtatgttaacattgtactatacttggtttatcacatgtctgtctacccatctttttattcatttacccatcgtattttttggtg

SEQ ID NO: 88769 - DNA, 1022 bp, Homo sapiens
tctcgctctgtcacccaggctggagtgcagtggcgcgatcttggctcactgcaacctccacctcccaggttcaagcaattctcctgcctcagcctgccgagtagctgggattacaggtgtgcatcagcacgtgggcccagctaatttttgtattttagtagagatggggtttcaccatgttggcctggctggtctcgagctcctgacctcaggtgatccacccgccttggcctcccaaagtgcggggaatacaggcatgagccagcgcgcctggccaggaacagaatattttctaaaagacacagccttatattcagtctgacaggcaaatgtcatgtttctacagacttttcaacttttataaatgcccaagggcccatctgtaggggtttctcaaatgtaggattctgattccatatttcctactatgctccatggtattgctaagtgccagcatggatgtgcacagagttgggattcttgcagtttgggggaaggatactttgtttttggtgcagtcatcattatggttttgtcatggtcatcagttacaatttttctttgcactgtagttataatttacagttttactttattacctttgatttagtttattttgcaatgtttggttcagagtactatgtgatagtatgttttagccaaaacatacctagttttttccaaaaactaggcttcaaggtacatatcacaaaggttaaaatgagccaaccagctcatattgcaaagcaaatgtatgtcatgttcccgagtttgcatgtgcaggagaaagtggcatttgctagggggtgtgctgggcatctgtgtccatcccaggtggcctggtgaccctgaccttccacttgctggccaggctgttgcctttggggccttcccaaactctttgacttggatgctgggaatcctgaaccatgctctggctcatggccccactcttctttagccaaagtgtctcaatgtaattttcctcttctttccctcatttacttataacatttgtcctc

SEQ ID NO: 88770 - DNA, 1215 bp, Homo sapiens
caccccctgccatgctgcgggtttctcatgccccttcatgtgcacagaagtgcccgtctccctgggttcatgctaacactgagtgccctacttttttgagtctataaatgtctaagtgaaaaaaaatcttgttttaattgtcagtaattgtgtttattggccgtttgtttattttattaagatgtgttttctgttgcttgcaagatactactcttttgtctgtcacgtgttagaaaaatcttttttccagtttgtcatttgccttttaatactataagtggtttcttttgatgtattctttttaaaagttaaaaatcttaccaatctatcaatcttttctctggatgtttctgcttttgtttctgtgtttataaagaacacacatcaattcatcttttttttctcgttccttgtatgtttttttgcatctaaaattttaattcatctaagatttatctgtatatagtgtgtgtctcaccttttttgatctcacaatatgtttagttgtttcaccaacacataccaaatagttcatcctttcctcactagttcaaaatatgacctgtattgattattaaaatctcatatattctttatttctgagccttctatttagtttcattaatctgtctatcttataccagcaccgaaccattgtattgaatttttatatctaatagcacaaatactgtcattatttttccttttcaaagtgttcttggcaattttcaccaatttatttttctaaattgaggtcagcaaagtagtttgaggctttgcaggccccaacagtttgtcactagtgctctactccgccctcgcagtggagagcagccatagacagtgataaatgaagctgtattctaattaaagtttgtttacaaaacaggctgtgggttgatttgtcctgagggccatggttcgccaacttctgttcttgatgagtttttgaattactttgtccattcttaccacactcacaaacacatacacacactcttttcgaatgtgtgtgtgtgtgtgtgtgtatttttttttaaggaatttggttaaaatgacatcatgcttacaaaatggtttggaagaaacatggcgtctttattacaaggtcttcccattaggcagcattaagcattattttatgctgatcttcaatgttctatggtttcttttatacaggttctgcaaatttctggtctttctttcttttctttc

SEQ ID NO: 88771 - DNA, 1735 bp, Homo sapiens
tgagccactgcacctggccaggaaacaccaattaattctcacattagcccaaacaaaacatgatttggaacgtgaaccagctccagaaatatgagttatctgtttcccaaacttcctgcctttctcctcttcttcttgccttctctgcactgttaaagttatcccagccactctcctttttcattaaactgaacacttaaggaataccccaaatacaataattaggattttaagaatcttaagattcagagacctcatctaacttctccaactgcatttacacattgatgcttcttgattctaaagcaagaaacaaatttacacaagttgtttcttgattctggtgggaaacagcctccgttcagtgtgtgtgtccccacccatggggacgatgtttgctaatgctggctatcacgtgtgagcccttggtcacagaatgtcacttggatctatttcagagttccctaaaaagaagaagcactcgggaaatgtacaaggagaagaaaacctttaaccaggtaagcagaggttttcattctaatgttacatctcctataagtgaagtcaactcattttgaatgtttttcagtaagtgttagctttgcctttaaaacatccaaagaaacattacctgcccaaacacgtggactcattcctaacctccacagtgtgaacattttctttgcaaacccacagctcctccctcttgtttctccctcacgctgacaagctggtgatttcttcaggaaaaagaactggctttgtgtaaaacagaattaagtgtagtttgggggcctgacagtacttataaatggtaaaaagtgttttgaccttcaaagtcatccacacagtgaaatgaaacagccactgtggtgtcgagtcattcataagacattgttttgaatgttgttgttttttaaatgtgcaagctgaacgatatcttgaatggtcctaattgaaggtaaaatattctcagccttttctagatgcacagtatgtattcttcaaaactttcttagcttttctgtaaagctgttttactggattctgtttttaaattgctgctagcattaggtggtggagagaacaaaggtgttattgggatatcagctcactgcactctgagagcaagtagtaattagagagacacaatgagtcggggtaactaagagctcagcaacctccaccgacctcctgcagccctgtccctgtgaattcccctctgaaggatcccctgggtttctccattctccaaactcactgatccccagggcatcattcaagggggggcaggcccctgcagcagcagaaagctcaactgttcccttccaccctccccaacctcccagtctcattttggaatccattaataacagggaaattaaagtctgccatcccgttgctgggtgcttatactcttctgggctgagagtgttttcagttgactggctcttgcccagggaagatcttttccttaaaaggggaaattctgccccattgtgaaatgaacagcatggagttgcattcgccctgagggtaaaacaggccaggaacaggagctgctgctccttgggcgcgtgtcagaaaccctggtacctgggatgcgttgagccgcccacccagccggtgggattattgaggaaggagtttctgttcagcagaatggtggaatggagcgccctgggaactgcaggcccgcaaccaaaacccaaaggaagctggcgccccggcgcaa

SEQ ID NO: 88772 - DNA, 1252 bp, Homo sapiens
gtgtgtcatatggaaagttggacttgacctactttcataccacattcctggggctatccaatgatctctcgaaaccagaaatgatatgcttcagtttagactcggccttgaacccccgcctccgctagactcttggcagagttttaagaagtctacggttacaagataagatgggcatccagcctcccgctgcctgagctgaagctgtgattccacatcttatgagaaggagtggcttcccctactcagaacaggccgagctcagcttccctcaggccgcccctctcctgtacacaacacccggcaggtgcagcgggccctgctccagctgcctcgacctcacggaagacgtctgactccttcatttaatatacactctcccatggcttccaggacagtctttctttcaaaccctgctttagtcttggtggcaggcctcatagtgcatgtgtggttgttaagtagaaatgacagcatgctgtcatgctgacagcttttttctttaaggaacgagaagacgttttggacattttatcaatcctcaggtaatctacaaattgacccttgttagagtatgtcataggatcttgctgctttaactgacctgggtttaggttcatggagacggaggagaattgttctatgatagatttgtagtggatggtggacagagggtgatggtgtgaggttgaaggtttccagaaatcaaggtgatttgagggctctatggggaccttctgcctgcatgagggggtgcagataagcacgtataacctccagcgtgtttcaggacccttcagagatcttacctccttccccaatttttcacttcaacttgttggggaagacccccaggggttggtcgtattaccctgagccttccttgtcatatcatttttccccttccgtggggtttgtggtgaacaaggagggaccaggcagagtgggactgcctgagtccctggtccacacgcctgtttgagccaaaagcttcccgcaccatgcaggcaactctgcccctcgcctgcacctcctggactggctccaccacatcaaggcctcaccagctgcaagtttccacggatgctggtcacagcaggcggccctgcccccaccttgtccagcccagtctcgagccccaggctcaagaagggtggagagtggggctgagtttccttgcagctggacaatgctgccctctgtgatctctgctgctgtggatttctctgctttagaggtggagatgggatca

SEQ ID NO: 88773 - DNA, 4277 bp, Homo sapiens
ttgagaccagcctggccaacatagcgaaacctcatctctaccaaaaatacaaaaattagctgggcatggtggcacactcctgtagtcccagctactcgggaggcagaggcagggggcaggagaattgcttgaacctaggaggcagcggttacagtgagccaagattgcgccattgcagtccagccagagtgcagactccagagcaagactccatctcaaaaaaaaaaaaaaaaaaaaaaaaaagaatgaatgaacagataaacgagcatgcttttcctctagtattagtattaaacacaacgtatgccttttacagcccatgtattctgtgtaggttctttcaaaaaatacgtcattaccccagcagcgatgatagcatagcccatttgcctcagtagttgtgagtagggcagacagccttacttcaagttagtcacaggattgctttttatgtctacctaacccaaacccaaccaaatccttcatgtgataagttctcagaactcaaagaccatgtgacatttatatgttattctcctaacgtgcaaagaaggaaaaagactctttaccggctcctttacccaatactaattgtgtttcagacaaataagaaaattaatttcagggagctagagcatggtgatttatcatacacaaaccagtttatatataataaatacactttttaggtttatgatttatcatatacagaccattatttcatttgaccctcacaacgacgttgtggttaagtgagcattcctgctttagatacaaagagacaggttcaccggggctctgtgatgagcccaggtcccttagacagtaggaggggcaaagctaggactccgggcagcatgtttgaccccaagtccagcaggcctggttttgtcctcagctaagagatgacagtgggcgtgtcatcctcccgaggacgcacagatagcgccagggcaagctttccctgtggcagtggctgcacacttggtcgtaggtgttgggctgagccttcctggtcatatcgttttccccctttccatggggtttgtggtgagcaaggagggaccaggtagagtggaaggaggaaagttgggaggcgccgagggaggcatttctctttctgccaaatgatgagtgtgcgaccagactgcggcagagaacgagccatgctctctgagtgtaaaagctgcattgtgagcacacgtgacgatccgaaggagttaattctcccccgggggctgacttgttccacagaaggggcgacaggcctggagagcagtttgaagccttttcctccacgagggctgtgggatttgactcccgcagtgctgttgttgacagtttctctgtgtgatgggggaaacctttgctgaagccttttgaaacttttgatggccgatcaaagaggagtgattcgtgaaatcggttatttttcccatctgctgaatgtgaacagtaaaacgtttttgcaaaaccaaaacggggagttcatctggcttcaaaacaaggagaccagccctgcaaagcagcgttgactttccactggacccaaaaagtgccgttttgacctcagccaagcattgcaggctgtgaacagcagagtcagcttttgaggatcctccagaaccctctggaagccctatgaggacacttcttaggttttgatacacttgactctatccaacacttacctccttgccttgggtctctgggtttaatttcctgctgtgttatagcaactaaagggaaaggaacgtaagtaaaggctctgaagttgcacttgcatggcaagaggctgcaaggagctcaggtgtctgggtctgcagtacccagtgtgtacccagagctcggtactgactcagtacgtgcctggacttccaaacaccttcatgctcatacctcatgtttttgtcatgtcattcttgtgggacattagggctggggagaccgggatggggagaagcgaattgccctgtctcaggtaccttaggaaaccaggggaaagctgagctctcatttggggtggcctgacttccccatcctggtcagaccttgtggattgtgggccactttgaaagagggaggtctgcacgttggaggtggtgagtgcagcagggtggaaccctgtctgcctgcaccaggccttggtgaggggtcctgctgtctctcactggtgctggtgagtaaccaggtgggatccagagagcaaggaggggttgcgcattcccgctgggttttgggcctcatttcgttttcccttctttgcccataacttgtatgatggtttccacgtgcacttttttttttccaaactaatttttttttgtttcttttgcttctgtggcaaagcaacaaactgtaggcctttcacaggccccctccacaaagcccctgggcccacctctgctttgtcttggctgtttctctatgtaactcagcggcaccgatgggaagatcggtgtttgatgtttgtgtgcattgggggcgaggtgtgaggggaatcatgaaaaacacgaacatttggtattttcaaataacccttctcccgggctgttctctcctggcaggatgacagtgccgatttgaggtgccagctccagtttgccaaagaggaagccttcctgatgcgcaaaaagatggccaagctaggaagggagaaggacgagctggagcaggagctccagaagtacaagtccctctatggggatgtggacagtcccctgcccacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacatgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggaaatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcaggtaagggggctcgtggcttcgcctccctgctccgccttgctcttcctccttctcgctggcattgctgcactcgggctcacgctgctcacggctgcttggttatgatttcaaacctgcattgtactaaagcctccggggcaaccggatcctctctcttggttgggctccgttttttttgttttttttttttttaagttctcttgtattgccttgtttctttttcctttctcctgtcttatttttaactgcgccgcggctcatggtttagaggccctcccagacacgaggctgagcccagtggaagcgatagggctcgacgcatgccggccttgctcctctcttggtatctcaaccaaccagccacccgctgaagaagccgtgaggaggctaagacaa

SEQ ID NO: 88774 - DNA, 1067 bp, Homo sapiens
ctcttagatgcgggtcacccgacccgggacagaaagaggggatccccgaggagctgttgaatgaggaagcacctttaaaagtccaaatgctgtgtcagtgtaaagtatgaataatagagaatgcaatgtcttgccattggggactgtcaagggggaaagcgtgtcacagcccgcctagtcaggggcccagttttcccttcccactgtagctctttcttctttgccatgggctgtttctggaaccacagctccggctacacagggcggcccccttccctttgatggctggttttacaggaagtgcgtctcccttcccgagtgttccgtccttcaaggtgtgtcacacatagctgtgtgcagttagagcctgtgtcagagagctctcctcctggattcttcctaggtccttattgtgtaacctggagcagtgataagttgtcaccatcatgaatgcatcgcatagcttcagaaactgggagtgatttgggagagagaagcatacttagttgaagcaaaccaaatactgaggagcaataaagcttcacaagaagtagattagcagagtgagctggtgccatgtgacagcacaggatctccaaacaatgcagctcagaagggaacagcaggtcttcagatgaagtctctcattctgcggatgagaaaagtgaggcctgagaagtgaagcggcttgccagtaagccctcctcctggttggtggcagaactgggtctagaacagcctccagccagctgcagcccccgctccccagcacatccccggaggggcctgatctgcagtagtgggacggctctgcactgacccctgggtgtgtttctaaagagtcactctaacgactaattgtacagccgctgtcttgccatggaatggcaccttttaaaaacatccatctagtttcttttaattttctatattttaacaagagagctaaaaatctccatagtgaaaggccaggtctagggagcgtcatttcctagaaggggaagcagtatgaatcaggagttttaagcaaacatccctcattctgatgttttttattcacaaagaca

SEQ ID NO: 88775 - DNA, 1713 bp, Homo sapiens
attagcgagatgctcacactgtgcactggactcttccctgacttcactccctggggttcccatcaaatgtgagacaatcacatttgttaagagagagtggtgtgtagaatggtttggaatgtgcgaggcaccttaaaaatagtcctgaatgagaagtagccatgcacggacgctggtcagatttcaggtataaaggagaccaggcctgtgcccagaggattgagtttctgggtcagaaatctcaaagagctcttctcctcagtgcctgcttttatccttcaatcaaggaagcacacaaagcactcacaatcccacgtgcctcagctgtgaaatgccagccacaaggaagttacgtggggttttatgccaagtatttgcactcatgtgttggcctcatgtactgcttttgaaataagtggttgcaaaactggccaggacaaaatggaaccctccagaaaatgaagccatggtcatggtgatggaattgtcctaatagaggagtagcattgctaggcactctagtgatggccatgaaaagccttccttttctgtttgtgtttgagattgtgaagttatcttcttaagtgtgggaagtaatttgtaagccactttctctggaggtagggaagttagcctttgtcaatcagtgtgggatgcagctctattggggaagacatggacgggagttccggaacactgacgtggggagaatggttacaattgtcaagactagtgtctcagcagcctcggaaacaagtgagggtggtggtggtttagataagctgctttaatagggagatcaagatgaatttgatgtataatcagaatcctaggtaagtgaacaaaaaaagggttttttttagaatcaaacctttggggattgggtggtaaagggaaatatttatttttttagaagacatttatgtgtcatgtgaaacttttctccaaatgtatgtggttgtatgcagttgtgtggcagtagagtaattctaggctgaaccttttgccatagcacgttttgtatgttgttttttgtaacattggagtgacgttggcatcccagctaggggcagttgtccgtgggagttttaatattgcattagcaaaaatggacaataaaggaaaatgaaacttctgataatcaggaggatctaaacctgtctgctgttgggcaggcagcagtctccagagacaacactggagccatcgtaggtgagtccgacttccccagtgaactggctcaaggacctccctttctgtgactcttcaaaggtgtggttcaaacagaagagcacgttttaaatccaatgacactgaagtatgagcttcatatattgtttcagataaaaatggcttcttaacatatatattatttattaaaattaaaaccaaactaaatagttcatgcaatgtatagaaactaaactaatagatctttgcttttcttaaacaataagcttgattaggatgtctgtttttacacctaataaagcttttggctagcacctaatgcattaaataagaaggatttttacattttgagtttatagagtaatgtgtagctggaaagtaaagctggcaggagagcagcctaggtgacctggaaacagtcctgcacggaacacctgagagaggagggaagccccaagggcagatgtggccgctgtgtttactgctgtatcccccacgctttagatgatgcctagcactgga

SEQ ID NO: 88776 - DNA, 1031 bp, Homo sapiens
aaataaggtcctggtatatctaagaacttattttggcaaggaatgtgtgctacacataagcccccatgttgactgaggccatgtgatttaaatgggtcacaaactgattaagggagtgagctccttctctgcaccttgcagcttagggaaggcagggccgaatgccaagatgtaaatactttctgccaacttctaccactacatgtatgactctttttaagtgtttcatttaggggtcaagttgcacatcttattatcagaggaaaataattccatattacttgaaagatagattcctaagtaattaaaaaaatgtttgcatggcaccaaaaattgtttgaaaagtgagtttatcactgaagatgctgctagcacagtgtccatggcccacgtgtttctagtatgtgggttaatgatgaaggagtattgcggaagaggcttcggatggtaggagatgtcctccaggcttgttcagaagggaagggaaagtgtcccccaaggtacccagggggcagaagactgagctctgagaattaggaagttcatggagccatggaacagaaggaactggaaagggcagtggagatgtgagggagagaaaagaaggctctccaggagggcctaggcgcggtgctgctgatgctgcctcccgtggtgcgggtccgggtgtctcagcgcctctccacagccaggcggggaagggtctcacgttaccttcacattgcccctgaggccagtgaagcttgcccagcatgagtcagttggctaagacatgtaaaagaaaataaaactacaggactctctaaattgattatgtcaagggcaaagttaagtcctggagactgagtcatgaacatgtttgcagttttgtttcttagattataggtgaactctgttcctcattgttcttgttctgtaaatgactaagagaccagagaccagacctcccttctttttaattactgatctttgttatagattaactgcctcttttattgtcatgtacctaactcagaccagatggtgcaaaa

SEQ ID NO: 88777 - DNA, 1556 bp, Homo sapiens
ctttgttcctagatgtggaagcctgtcctgcccacacagttttaaaaggatcttttctaagcttcagatgagtcactttgccacctctggaatttgtatatgttcttcctgttatgcctcgattcccaggtttataatagaaacagaagcgagatctttgccttctgtttgcttttgtattgattaagtcagagtggccgtttgcactgcaggctccttcctggccttgcttcctggcacacccggggctggcgccactggcgttctgtgtattctgtacatcactgaccctggcttcttggccagctgcttcgaggcattgtgaatacttggtttctttttagctcccaaagaccttttgtctggttttcactctagggaacagtgtatgtaattttaagttctcatcctaggaatgggaaaatacagtgattctctttcctcagagtgaagaaagtcttgaaaaactaattccgccagcttccaactatccgtgacatagataaccattattaagcaaagcctagaaattgttttaaagtttcctgttgatcagtactctggagttcctcctcctttaacttataaaaccatagctattagcaatactaatttaaaagcagtagaattaaaatttctccctaatgtcttctaataagctgagcatccaccctgtggtctttaaatgcagcaagtgccaatgagtgagatggccaaaatgagcattttaggggtaaggactgagaagtataggcgttgataatccataaagtagatggttatcctcagacagtgaaaatcaggctgtacagcaaaagaatttggctgaagctgtgatcgtcacctcctgcctgtttcagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtgggtacctcgacccgagcctgtcgccctgcccacaccagggagaggaggctcctaagctgcatttgggtcgttttgtttccagtgttggcattcaggtagcagaaaattccaccgcctgactgcggtcacctgttgtcatttgtgatgctgggtttttcctagaaatcacctcatcaaaccttttccatcttaatgtcagcccactctttcatttgagttgccatataaataaggactgtagtaagggcagatcaatgctgcgtgtcgctgctggggccagtgaattgacctcagagggtctgccattggcaacatcattcgtttggcagcataacgtacaaggagcaaaggacacgttttaaaaaaaatcccccaacatggacaaaatatttcaagttctctttggcccacttgaaacataatgctcccaaataaaagtatttgatgacactttgaaaaaaattaatgtataaagagaggtgagacttcagtgttatt

SEQ ID NO: 88778 - DNA, 1704 bp, Homo sapiens
ggatgtgacctaattatcatttagtaaaacaactaagtaaaaaaaaaaaaaagtgtgaagaacttaatataaaattcatagcaagagctgaaggaattgtgtttcatatttaagtcttcacctgctacaggccactgaagagcctcatccagtccagcctcaggactgagtagactccacttccctggacctctgctccttgtcggggcttctgtgctgcgttagggccttcgggggctgcctgagaagtcagcctttctcctgcagacagagagcccttggctccctgggcttccggggctgtggctctcccaggccccagcagtcttcctttctggccatgcaggctgcccacctttgcttgcccaagatgaaaaacttccagaaagagcacccttgccagaggaggcctcacatcagaactgtgatctgcctgactttttttttttttttaattagaaagttatcttgagcctagatggtatttacatttcaattttgtacgtcataccgtgattcattcttcagtttatcctgcaactgggaggcctcccctataaggcgtgctactctttctgtaagaggaaccagaccagagcttaggatctgaagcgttttatctttgccgtgtacttgtggtggcagttgttctgtcactctttaagtagcccctgcgtgaggtaaaaattcacatgtgcagatgggtgcttgatgaaaggactctccttgccccatcctacctcccagagttaaccatggcctgcagtttgccacaggccttccaaagtgcgtaactaagcctgggacctcacaaataagtctcttccctaatggccacctgattttcatcagacttgccctggtttcctaagcctttgggctgataactgtgtttacagcttgttaaatatgtgcctcatttattctttcccggatccacattcattcttgggaagctctcagtggcatttgtggagaccacagcccagagccctcctggacaggatcaccgggcagactcttggccagagggcagaggacttctgtgtgtaaatgactctaattcccatgatattaatagattatattttcagggtctgtcttgagtggcccattctctgtaggggataatggtttttagaaaagaacttttctggatgtaacaatgaaggttacattgaggagaacgacaaatggctcatttataaaaatgctgctggctgtgtgaatgtatcaattctagctaatctcacagtaaagaatttgtccagggactcctgctggtggaggagttgcctgtgttgaatgctaagtgaggtctcaaaaaggagctgtgcgtgccttgtgggggtctgggcagctaccacatcattctggaattctcctgcctctgtcaaggagcctgaataaacgtggatgctatcacctctattttgtgactggcgttttgtgggttaacccatagcagcaggtcaatatgtctgttccagctttagattaatcctatctccaaagttagtggctgtgatgcaagcaaagtagtcggtggtggtttagctcttttgtggagctgtgatttcacctgctgaaatcttagaaatcttaggcaagaacaattttgaaaattagccagcattgcatcacagataccttgatacgttaccttatctacaaacttccatttcactttctattagtaatact

SEQ ID NO: 88779 - DNA, 1895 bp, Homo sapiens
ggcagccctggctttggggttccctgtggcctcctgcagtttccttgctcctgctcctcagggcccacagcacctctgtggcaggttcccacagtgccagcccaggttccggcgtctgaacacagctgccaggtcaccagggcagccttccttctaccctcctcctgatcaaacaggccctcagtctcaggcccaggagaccgatggccagcaacagggaccctttctttgctccccggctaactgcagactccccacccaccctgcacccactgccaacaacacctgggaaacagcccccacactaccttgatagccagatcctctcctcttctgacctaaaaaatacgcttaaaggaggtggtggagcctgactcagtgttcccgcaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacaggtaccaccctcccaggtctccctcgatcctgactgtgtgtctctgctgtccaggatatgtggcgggggagcgggcacagagagattcagaaccatgggcttcttgtccaggaaaaaaagagaggagtggctgcttgtgtctcttcttaaagtgcagagtccccattttccctgatgtcccctctcccaagtatgcagtacggcccccaccaagcagcattttcagagcagcatgtattctcccattctgcattaaacaagcttgtatttagctgcatcagaggacggccaggctgaagctgtcatcacactgagctgacataactctagacaggagcaaagcaaaagcagactgtggtttagttgtctttgaaaaaggtaaatgcatgctttcattgagatttttcaaaatatcaaaagaacttggagacctcccactgcatgcccaagaattctaatacatttcagtctccttatttatatcaaaggaaactgaggcccagaagaaacagctcagctcagatcacagagccatgtagtgctagggcaggaagagagcccgggtttcctgcctccacctcacaccacagagggaagccccctctgaagtcttacaccacagccataggagttaagatcagacataacaagaaacatcctttcctaagtgtttcttccttggaaaccattgaatgtcatgtgacttcctacatggtatctgctgctgagagcgtctctcgaggtttcttccagccccttgatcatgaggagggagggaaggtctgtgtatccttggtaatctatttcctagactctattttgaggcaaaccataaagtaagtaaaattttgtagggattggcctggtcatgaaaggaaaagaattgcctggaaaggagacccctgtcacatggtcttgataaaagatgaaaaagacttgatgtgtcaaaaaaaaaaaaaaaaaactccagctctcctggtacccacaagttcccctgcatttccacctggccacagcaagcagtgatgctgagctgatagccctgggtggggcagggacacagccttgcaggcctgggcatcaagtgagagagcagctggcctgattgtggctcctgcctgctgcccgcgggggatttgacctagatgctctgtttatcttagtccccggcctgcagcatcagcagcggaggagaaatgactaaggacagtctctgatgagctgtctttaaccctattaaaaaaaatatgtttatagggggagttaagtgtttccaaagcccgaactatagctaaggaagggaggtgtaatcttcgatgcaagccagtttcaaaacat

SEQ ID NO: 88780 - DNA, 1189 bp, Homo sapiens
gtcatttttccctgtctttaagtcttctctttggttttcacaggtttgagtacataagatgtagaatcttgtttggttttgatatttaacctcctgggtatttgacaaatatttattgaaaactattaggttctgtcactgtcccatccctaggttccatataggagctaaggatatagggacggacatggtacctgcccacaagcagttacacagaagtacaggcaagagatagtggtgacttagactaggaaagtggagcagggaagctggccatgggaagctcagtttactcaccgcttaacattctttgtgactgtgtcaaacgctcttaattaggactttaaaaataaaatttgtttatactgtgggattggtcaaatcttggtttaaacatgtttccagggatcacatgtaaatgtgctgagacttcatccttgaatgcaagacttgtcagagagggaattcctaagtctcttctccttgacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcaggtaaggaggcaccccggggccctggagcataggcacagagtgtagactgctcagtggacccagaaagcaaaagcactaggctgcttcatggtccttgcagcatcaggatgcatgggcttccaaaggaagagagagaaattctagaattgcttgtgttggagaccaaggctcatgcctctccatgacacagatcttttctttgcaaagttcataggtaactctcctatgtgtacatgtggtagtggcagagcagggtgggtggggcttgtgggagcggggggataactttttaaaggaatttaaagactaaactggaaagaggaggttatttcaggtcttattcaattgaaaacaaactataacttttaagtttgccactaaagatgtggtcacagtgactgctccaacttgaatggaattgttgtcattagaaaagaaattgct

SEQ ID NO: 88781 - DNA, 1123 bp, Homo sapiens
tgtcaagagaggtagctggtagctcatcatcttcagctaaacaaacaattcagaaactcagatgaatttggggaggaggggggtagtcatttttctgccaatataaccattctctgcattgcatcagacttagaacagtttgcatagttgcagtagttcctgagggatacacaaattaaattgatgaagatttggaattcttccctggctggatttttacatagtatatattttgtttatttcagccagtcacacacttataaatttatgaggtctcaaggaaatgtattaatcagtaagaaattgagctcaggaaaaataacctcattactctattttaaatacccatagagccttttgacaaatgtgctctattatccatagacatggtgcctgtgttacgcaggtacaatgacaaaggtgagtgtatgcatgtgttggatagggcgggaggcagaatgaactaaatggtaagaaagaccaagaggctttggcttggaaaccactaagaagaataaaatacaccgcaggtgagctatgatccccactgcattccagcctgggcgacagaccgagaccccgtctccaaaaaacaaaagaaggaaagtacactgcagatagaaaagctgaaactcttcgtaggtttgaccacttacacaaatgagtcaccttactaatctttgatattccccaaatcctatcaagaggaatgctggccatttcctttctggcttggaaatgcagcacttgtgaagagtctcctgtattaaatctcctgtgtatgtcgttgctctatggttaggtggaaattttagggatagaagtggcatatattctttgaaaatggccactaatttattatatccaacttagttgaccggtgtcacagtaactccaggcaacttgtcaccagggagcttcattcttggcccgtgctctagggccactcactttttacatccctcctgtaccccagtgaggccatcatgatccctgccatgccccctttagggtgcccttcgcctgttagccatggtggcttgttggacttgtcacaggcttcatttctttgggaagtcacaccttggatataaattaagcaagtcttttaggtttttatttt

SEQ ID NO: 88782 - DNA, 3929 bp, Homo sapiens
taatagtggtcaggagctgacctccaattccaggttatcagtattgaaacagttcggccaaactgacagcctcagaacccagtcctcaaggtggacatctttgagcatcatagatctgaaacacgtgagtttcgggcatgcatctgttcatgaaatctgtgtgatggatcccacagtctttgtacaatgatgtcattgctgtttttagaagaggattggttacaaatgaactgatgcttcagacatgcaatggtggctttcaaaaataaatctggccttttccccaaaatattaaacatttttaaagaagacttcttaaatctcagtgccccatccggaaattgaggtaaagcaattataggcattcaccagacttcctgaaaagaggatgttggttcaagtgtgtatgggtgtatatagattttgttcatttatcagttattgggttgcttgttcatttaacttttagctacatactccgtagataaatgagagatgtaactgaacattcttcacaatgtatactctcaacatttgactacttggtaagccatataatataaccttgactgtgataacctaatacagatggtgaaagcagtaacactaaatccattttccactttcagaacacatgcttcatacttgtccgctgtcattaaattcctacataatttctgcaccacatgaggcatgttatgtgatgtatgactgtgggaatgtggctaaggtcatataacacattttatctctcttatcagcgtctcttgtctcaatccaagtttgattgcggggtgggggtaggagacttttatggagtcacactacatttctccttagaattgttgagttcccagttaacatgcagatgatgtaaaacttgctgttatatttgctgtacttgtcaagcaaaaagggtcatccattcattctccttccagtaactttcttaaatcagctgccattcttttaaaaactccattcttttaaaacctgttacaaagtggccttttttctttctaccagtctggggaaggtgacactctcgagggtttattgtttcctgtattaaaatacaaatctttaaaatgttcgacttgcattaaaagttgttttactgcaagattgcaagtaggtgctgatgctggctgaaatgactcctataggaaaccctccctctctgaggactcgttctattacaacaccccagaggcatcttagcagcagatatctccaccacaaccactccagttcaattttaggaaacctaacacttagcagcttgagtacaagttgctcctggctgcctgggtttatttttgaaatcctactttactgagttagaaggtgcttgttcatagccctcctctttagtcattcttttcccccttcactcacaccctcagtgcacatttgcagcttcagatgggattcttgcattttaatttcttgcccaaaatagcttagagatgatcatgtgttgaaactaaattgtgccgacatgcattaaatgaacatataaaaagccttccctttttttttttttttttttttaaagaaagcagttagcatctttaagacaactgcaaagaactgtgtcatcatcagggaggtggaggaggagagagcagaggggcaaagctaaaacgtagagtttttaggttttgctgggtccctaatttgactgtgaactgcctcagatgctaacgtgtcagctttggctgaatcagactccatctttctcaaaggtaaagataaatctctgttctgccaccttagaaatcactaacaatgagcaaacgtccttttgtctttactgtctcatatggctttcttcctgactatacagaaaccatatttacgtccaacttgtggatgaatgctccaattaggacacagagatgcagtttgtagtgatgcttaaaaaaaaatgaattgatctgcattcaaggaggttttagaatttcctggaacggtctcagcacttgaggacttcaaatcattatttggccactccttcaggtcaaatccaaatgtcactttcatcgttcagatactttgcttattcaaaagagcagtcaatccagtagtgtgagcttgtcatccaataaaggcaccattaaagattcataggcggaaatagcttcaggtctcagttgtgctttctgtggctgttttagaaagggaagcaatgaggagggatcagaagaatggagtggaagctggtgagggctcctctggggagggaggccgtgcgccctgcaagccatttgcctgcctgcctcagcagttccttgtgatttcatatgggctcccttcctgagccacctccacgaaatctccatctagtgccgcaaaacagcccagaaaggcataatgcccttatgtgggctgggctcccactagacggcatgactccggtgagcccacgtgcacaacccatcttacagataaggaaactgagctcaggagagtcgggaacttgcacctgcctgcaaaccagcaagccacacgttaatggttccaactcaggtcttctaactccaggtggccctgtgcttgcccactaccgcttcttgagttcaaccaagtcagggaaaaaagtatgactctaacgtaatgtggctttttttttttcttcactcagtcataccagatctttacttgcgttatagctaagtttgtatcctctcaaataaagtgtaagttatgtttaacaccaaatggttacaaactcaagtttgctcacttgaattactgataggacctgttccacatgccctggggctagttaggaaaatcagattcacactcagaagtttgctatcactgatagtattccactgagtatgtcttcacttctgaaggaagttccaaagagagttttaaacatgttctttaacagtattagattaaaaaatagtaataaatgtaaaatttcccatgagcacaacactcagagttatgtacaataacacatatattggtgtcagaaagagttcaccatactcgtacgtggttaatgcagattttctgggccagataaaattgtgggttttgtaaagcatctgtaatgttgtgttacattttgaaattaagatcagaactttaagaacatttgcttctcacaatatttttcaaactgacctatgtgtaattgcaaattgtggagaaacgatgttcttagggagaccatcagacagaaaagtgaggctaattattttcatttttaaaattctcaagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggtcagccaggttttgtccatcctagttaaccactgtggaatgagggagccgtcatgaaacctaagaggcatctgccagattcctctcctggcaggctctagcacttttgcatacagcaacctccgaattgagtaaaaatgaaatcttcacaacaccaagggttttgcttcaccctaaattagcatgctctgctgtcagtttaactttgcccccttgtttcaggtttagaaatactggactagagtcctatacaaaaggaaggtctcacaaataagtgtgtcccataaaacacacaagaggaagtaaataattctgggaagtgtatatgctcaactttttcttttttcttttgatttttttggagatggaggtctcactctcttgcccag

SEQ ID NO: 88783 - DNA, 1102 bp, Homo sapiens
aacaattccagagccacgcagagtccaataaatgcccgcagggtaagtctgtgagtgcagcacatgagcagctgacagtgttctcctggtgtgggtggcagcgggtgccttcactgacacttctcatgcagggcaggacatgggtgttgtggtgtgtcagaggctccctggcaggtactgacaccctcttttctgcttttcccagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaagggaggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttc

SEQ ID NO: 88784 - DNA, 2060 bp, Homo sapiens
catggaggtaatgaatgctgagtgccccacacccttccccaccagctcttccctttagctgtggggcaggttgggacttgggattgtgctctgtcatttgatctcaggaatcgtccatgattggttattgggagctggggaggtgttaggtttatgggagaatagaataggcagaaaaagccctgagcaacttttttgaagaaaatgttattttattgtccttgggaaatcatatagtacatggtttgatttgggttctgtcaccagtcttaagtgattgatccttatttatcagggcattttatttggggtcagtttgccttctttctgtgtgaattcgtgcacatgtacaaactatgggatagttgtgtcaggcttgctgcatactgcagaccttcatatgtgacagcatgaggtgagctggagagggtctggaccacatgagcacgagcacttctcatcaggagccacaagatctcgattcctgggctggcttccttacaaaacagccatctggcagctcacaaatcacttaccctctttgtggccatgagcccccctagcagtaaaaccaagtgaaacatatagacaaaatcaaaatcctaccctaatacaatatgattatcattattgcccttgatattactcacaaatcaatccactgtgaattgggttctgatgcacatccacatgtggtgtttttgtacaccactttacaaaacgcttcccatttccacttcaacaatgagcaaaatgaaagcctgatgttgatgctggtggtgatggctatggtgatgccactttgtggttcgtgcagcacagagaggacgtgtctgtccagcgagtgattccaactcgccaggagtccggatgaacaggcttcacactgggaacacctggccccatgagcactctccgagccaggctgctcccgcagatggcgggggtcagaggaggaggaggacggcagcttgctcctggtctgcccgctgcttcctcgccaggacccaagcagccctggcttcatgggcagggagaggaggaaggtgtattgcctgtttcacctggcccacgtttcccacaagagggtaaatgatggctgtcttcccagcctggcccaccaatgaatgtttaactcagaatgcaggcttgaaatctgaataggtcagacctgtggaactgccaatggcttacagaagtggcaattccatatggttcacacctaatacaaatattgatactacatggcctacatgttccaagatctgagtctttgtgataaagttgtttgcatgctctgaggacaaactgctggttgaatgttctcaggtgacaaatggtgtcttctttgggctactgttaccccatccttctggggtcctcaggtaagtcctcctgccgtggaacggtctgtttatatgtgagtgccctgccttcttagggctctgaatctcagttgaaattggggctatgtcacaaagcattaaccggctgtgtctgtattgtctgtttatattacacaccaaatagaaattattctttaagaaccaaaaaaatgctttgaattacgaatagtgaatcctgcaagcaaaaataggttcttgatggaatcccagcattatggcatgaaaacggttttatcagtacaaagtggcgcccaaccccttttgtcctccgtaaagtattcatttagattttctcttcacttggtgtgtttgccaccaaaagagatgatgtgaagggagcacagttgcagggcctcagagcgggcatggagcactcatcggcagcatctaaatgccacgggctcttttttccatttctgttggaattttcctcgttctagattccagtgggattgttctgaattgatgtaatatattcaggccattgcaaccccttcccattgctccatgaattatgcagtagttctcggtatgcgttcccaaatccccaggactacttctgattccaagcccacccagtgcgctgttgcggaatctttccccgaatgttcactcaggcatccacacccaggagtgatgcaggtgacaagaaat

SEQ ID NO: 88785 - DNA, 1153 bp, Homo sapiens
gttttagataccagtcatgcaatttccatatctctgtttgccaaagtgctgtttgaaatgttaaatgctaaagggtgactcggaagcatagaaactagagggaggtctgtgactcctccatggagtttccttcttctctctgggcagatggcagagggcaggcctgtgtgcctagtgcctggccacttccccacacctgccttggagtgaatgtgctagatctgagagcccgcaagtctctcctggtggctacccctgagcgagagggatggtcctctacctccgggcttgctgactttaaacctttattgttctcctgtttaaaaaacactttccaaccttcttgcttttcttttctttctctgtctgttctgtccagaaccaaactgtcttgctaactgccccctggggactctagccctgcccgcctcacgctgtaagtgcttccttccttgtttcccaactgtctggagaggtcgtgttgtgtaactcgcagttggcacctgacgctcatcacctgagggagttctgcccggtggcggtaccctcgctcaccccaagttccaggaggttcgcctaaacccaggaacagattgataaggccagagactcatctgctctgctagagggttgaccactcaatgcaaagaagggtttttaggttatagagattctgctgagatttctccgcttttgtacatttgcagccaatatgctttcagagaattgagtagatactggccaggaggggacatcctaggcacaggggtcttgcctgagggggtctttgggcccagccacccaggactggtcaacattttggttatacgtgcactggcatgtgctgaaatgaggtgtgaccctaatgtgataaggcttttgtttttcatttttcaacaaccataccacaaggaatgaacccaaatatatcttgtccttccaagtgagcaccgtgggtgacagagtaaatgctcaataaatatttgttgaatgaataaacaacaaaatcatccccactccaaatatcttgagaccttccctcagaattgctttcagagtctgagtcaaagcacatgagaaaagatatactttttgatcaaggatatagtcatccacccacctcatccactggccttgactcgaagccagtagt

SEQ ID NO: 88786 - DNA, 1797 bp, Homo sapiens
ctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaaggtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttacgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggcagcatgtctcggtctctcatttcacacaccctccatcttttcctaaggactcagatggaaagttttccatagctaggggaatgagggagagaggagatcatgtaaagaggcaacagctgctaatatatcttgctgggaatgcactctttgggtacgtgatcatgttgcagttttactgttccccgtaagagagtcctaggatagagagacagctttattgttgaaaagccaaaactgtggtgtgggcagggatgtgaggaaactggttacctacaagtcagagtgtgcccggcctctctgcccgctctgctcattaggagagagggagtggccaataactctagaagaggcctttccatctctgatcctgagatgagcccgcctctcagtgtttggtggagtagaaagaagtgatgctactgaagagcccaaaaagaatgatttcaggctgaagcttctggctttagtatttcatttagtgcttcattaacccaacaattttcttcttatatagatgagctgctaatgtaataggctatcctagcattaccacagcttcatccttaaactgaaatattttcaaaaaataaaaaccaacaagtgttggcaaggatgtggagaaattggaacccttgagcactgttggtgggaaagtaaaatggcccagctgctgtggaagacagtatgacttcctcaaaaagttaaacataaaattaccataggatccagggattccacttctgggtatacacccaaaaggaccaaaagtagggactcaaacaggtgtttgcacacctatgttcatagcagcattattcataatagccaaaaggtggaaacacttcagttgtccattgacagatgaatggatcaacaaaatgtggtatatacatataaagggatactattcag

SEQ ID NO: 88787 - DNA, 1035 bp, Homo sapiens
gccaccgtgcctggccaataaaaacttccaataaatgcaaaatataaatatttcactttatcactctagatatacctgcaaacaaacaatcagcaggtcagtaaatattcattgcctattctgtgcagattgcaaatgctgagaggtacattggtattccttcaattggaagcaaccagccaccaacaagaagggaagttgtggctgtcacgactgagagcctcaaaccgtgccatcaggactttgctcagtctcctaactctgtctactctgtatggctttatactcagacaagcatcacaaaaattggcaacaatggtccctagctgctgctattagtttagcaactcctagagaaaggggatctcttaccaggagctccagtgaaagcccaggaccgatgattctcatttggtagggattaagtctcatgtctggctctgagccaatcgtggtgacgggaagacccagcaaaggaaaagcagggtacgattagaatagagggcgtcagaaaggcagtaaaggcgtataccactgtgggacaccccaaaattgcaaggaaaaagctctgagcaccacagaacttgccaactggttggaagagataacattcccaggcacaataacaataaaatgaaaaatggtgtggtagaaattctaagtacagtagggcttgagttaggcttggcagtacgggaagcattccaatgtgcaggaggagaagcaagtgggaggtgggaggagcagaggtgtgaggggcagtaatagacacaggtcgcattgggcagtgatgcagaaaccaggctgggagcagaactttcatcaaaaaagccacatctggcagcaccagtgccttgaaaagccgtctgggaacttcttctcacatcttattttctaaaagttggacatgtgtattcttaagtctagggtggaagcactccaactgttaaaggccaggcaagacagtaggatgaaatcattttccacaccactgtccagatgaatgccaaggctgctatgtgggtcacacatggt

SEQ ID NO: 88788 - DNA, 1133 bp, Homo sapiens
caccattacgcccagctaatttttgtgtttttagtagagacagggtttcaccatgttggccaggctggtcttgaactcctgacctcaggtgatccaccgcctcggcctcccaaagtgctgggattacaggcatgagccaccacgcccagccaagacttatttgaaaaacagcaacaataatacttcccagggctattgtaaggattaaggtttgttgtttacctattgtgtgcaagataccattctaagaattgcaaacaccagagataaacagaaaagacaagctccctgccttgtgaagcttagttatgagaaacacatagcaaacagggctaagtgggatagagaactaagaggcttccctgggtaggtgccgtttgatctgaggcctatgaacaaaaatctgtctaccaggtagagggaagagctggtggaaagttgagatgggttggggggcatgaacttggtgtgttccaggaagtggacgaaggccactgtggtcacagcaaggtgggcaagggcaccagagaggggcaggaggaggggtcagggagcttaaaagaggcctagtggtccacagtaaagggtttagattttgttctaggtgagggggaaaaaaaagccattggaagataaaaagcaaggagttacaaaatgtgatttgcatttttagattactgtgttaaggattagaagtggatgagattggaaggcttccagatgcaaggctgtggtgttgacccagggaagcaccaacgatggcttgaacaggttttctgctgctgttatcagcctcaccaccaccaggccagccgcatgctgcttggcaggaaccacgatctagcaggccctgctgccaaactccagaatctaccccagctgttcagctagaaactgaaggaagcccttggttattcttctgctgcctctcagtccaggccagtcttcctgcaaatggccttgggccaagaagaaccttccaaaccccattctcttcagggcacaggattgcacagcaagcttcacaggcctttctaccttgtctttttaaggtgcaaacgccttctccaacttttaggttggggcttccaaactattatcagtcatttataatttggtaaaaatgagttcct

SEQ ID NO: 88789 - DNA, 1050 bp, Homo sapiens
cttttaaacttaacttcctcataaagcaacctttttcgattacctactccaccctgactcattctgattacctactccatcctgacttattctgattacctgctacctgctctgctctgactcattcttcaccctgcataaccatttttttcccgccaaagcagtcaccatcactctctttaaattagccaatcagaactaggttagcctgtgcggtctatccctagccaataggggaacaatacagcagcaggggccacgtgcatcagggatgagaaccccttcccctccctagtccaagtgtgcattcaccattgctccatctgtaagggcgcacccttccacagaagtaacttgccttgctgagaactaaaagaaaattttatatttgagtgctatttcttttgtggcactgaaactttatatataacgttagtcttatttacgtatgcatatatttatttttagcagacattcattcactgccaaacacctactataagtcaggcagcatgtgttggagacaaagaggtagtaagacagatgggacttcaggcttcccaaagcttggatcaatttgggtaaattaatggggactaggcatttaggaaacaacccctattgtattttatgggaagaactgagttggtagtgttataaataaaatttcggtgccacaaaagaaattgcactcgaatataacatcttctttttaattctcagcaaggcaagttacttctgtagatgggtgcacgcttacagacggagcaatggtgagtgcacacttggacaaaggagggaaaggggttcttatccctgatgtacatggcccctgctgctgtgtcattcccctattggctagggttagactgcacaggctaaactaattccaagtggctaatttaaagacagtgatggggtgagtgctttggtgggaaaaatggttatgacagagcaggtaatcggaatgagtcagggtggagcaggtaatggaaaaaggttgctttacgaggaagttaagtttaaaagtagaaggcaaagaattaaaca

SEQ ID NO: 88790 - DNA, 1354 bp, Homo sapiens
caaaacaaaaccaacacaatcaaagcccccttgtgcacctctgactgtatccctccctgccttccaattatcctgaaattgatatttatcactcccatcttttgtacgtgtgtctcacatcctgtaccttagtcttttcttgttaattaaagcagatgttccatgtaaacttatttattaatatttcttcaactgaaatatcatttggacctagggtaaagttaaatatactattgtgttatattactccgtttactttcttctatgtttgcctttgaattgtccaactctttgctagttccatgcttggtttaacccagccagtgttctgccgtctgtggttagtagaactcagaaattggaggaatccagaacagtagttgaaatacttgggggcgggggacagggtaggagtggagggtaggagcaagagggcaaagagaaatgaaatgcagctgagagaataatcagattccttccaaagcaactgaacattgtcagtccgcatagcatcataaatagctttctgaaactacttttttttttttttttgagacggagccttgctctgctgctcaggctggagtgcggtggcgcgatctcggctcactgcaacctctgcctcccaggttcaggcgattctcctgcctaagcctcccgagtagctgggactaccagcgtgcgccaccacgcccagctaatttttgtgttcttagtagagatggggttttaccatgttggccaggatggtctcgatctcttgacctcgtgatctccttgccttagcctcccaaagtgctgggattacaggcatgaaccaccacacccggccagaaactactttttacggctggagtttcagaactaatttagtaaaggattgaaaaggaaggaggatacagttgactcatttgtacagagtatatgactcatttgtacagaatgaaaacatgtttatgaaggttcacactaagtgaaagctggcatccaagttgattcagacaaaagtgaaagtcaagaagttaatagtacattaattctccaaatgcatgccagcagagcgtggcaggaaggtacacaagtcagcagatctgggttgtcctggttctcctattgactcgtgtgtgtgatgttaggtgggtgaatcttggctttgaatctccatttgtaaaataactctcctgaaatagagatggatagggtagaataccatatttcttaagatcttttataagttgattccattgttgtaaattatgaatcctaaagtatttctttatgaaaaattttttaaggctatgatttactaaactttcttaaaattttaaattttagggaagacatgtaaggaatt

SEQ ID NO: 88791 - DNA, 1011 bp, Homo sapiens
agaaatgctatggatgacccattttattcaaagttactctattcatataatattcatttttcctaatagttttgagcagtaatacaaatttcaagtttattcgtatcctgttaatacaaataactacatttgtgtggtgatgtattacagcatatcatttataaagtgccatacacaaaccacatactatttgattctgatgagaatcacataaccattaagctgtgttatataatggaaaatatttttgacttagaactaagacacctgatttttctctgaacttcctcattggcaatgaaagttttgaaccaggtagacctcttctaattattaagttatgatttctgagcggtagtgctaggactgaattcatttctaaatcagtgcattttctacttgactgactataacagagattttgttgtacttcattcttaccactttctaaacttaatttggttataactcttaggctagacaatcatctttctgagagaataggaatgtcctcaatttatctaatagaatcctaaatgcaaattttagatttagtttattgatattttattttatttgcattgtatagtactataacactggtttttccctatgaaaaatattataaagcaagtttagtgagttactatcctgagtaaacataggtggttatttcttcgataaattatgtatttcttgggaagttacttaacatttttttaaattaaaatagccaactttataatgatttaggtatatgtttctaattataatgttattattttgaaaaaatcatatttttagtaatggtaagcctgttggaaatcttgctgagtggcacgttagcagagcaaaataaaaataaataagaaactgaaagtgaaaacatttaaaaaataagacaggcatggtggtgcatgcctgtagacccaggtactcaggatgttgatgtgggaggattgcttgagcttaagaccagcctgggcaagatggtgagaccctatctcttaa

SEQ ID NO: 88792 - DNA, 1031 bp, Homo sapiens
tgataatggttatctctggggataaaaggaagagaaaaagatttgggatggagtatttcacctgtatctgtagcttatttctacaaatgatgatgatgatgatagtatctgaagtaaaatgtggcaaaatattactctcagttaagtcctgatagttggctacactaggattattttctgtattaatatccaaattattaaatttttcataatctaaagttttaaaatttgtcttctgaagttaaatgcaaaaatgtttaaagaattttttaaaacctggatatttatggtaaccatttcttctaaatgagtaattcagaaaccaacatctaaggacacaaaatcaaatatttaaaatgttttaaatatgacatcatacaactttaacttgtattacctgaaatactcacatagtaattgtcatttatttgaaccattggtgcgttcacacaggcccctaaacattccacttctataagagtgaaaagtttgtcaggtgtagtctccccaacctttattcctaaaaatacaaataaacactctaaggaccaggttatattttaatagtcatttggtttaaaaaaaaaaaaaagaatttttatagaggtatattaaaagtttaagactattaagttttttaaaaagaggccaggcgcggtggctcacgcctgtaatcccagcactttgggaggctggggtgggcagatcacgaggtcaggagatctagaccatcctggctaacatggtgaaaccccgtctctactaaaaatacaaaaaattagccaggtgtggtggcgggcacctgtagtgccacctactcgggaggctgaggcaggagagtggcgtgaacccaggaggcggagcttgcagtgagccgagattgcgccactgcactccagcctgggcaacagagcaagactccatctccaaaaaaaaaaaaaaaaaagttttttaaaaagaaaaaaatcctaggccaggtggagtggctccgtcctataatcccagcaccttgggaggccgtggtgcgagga

SEQ ID NO: 88793 - DNA, 1021 bp, Homo sapiens
ttaatctctaataatatgcatagattggggaattgttaaccttttaaaataaatagtgggttttttgtttgtttgtttttgttttgtttcactatgttgctcagactggtcttggtcttgaactcctgacctcaaacagtcctcctgcttcaccctccctagtagctgggattacaggtcttagccaccttaccttgctatatagtctcttattgtaacaatagcaaagagttacaatagaactctatagcttctcagatttcagattgttactcctacataggagttttgtcagcattctgacttctaatagagaacaaaaaccatttgtggctctcttttctgcctagaaatagctatattgactctcaaaagaaaaatagtaacttaaaaattacagtgctttgtagttcacacagtgctttttacatctgattctcttttgaacctcacagctcagtagcagaacaaggattgtcagctaatctgatgatactgagccatggattgaatccaggttaaaagtatctggagtaatgttagattcctttgaaactcacttatgaaagagaagcattagcaaacctaaaggaagagaaaggagagacatgcacttctattttctcccaccaaattcatattgtacacaactttctattctgtttacccgttctgaaacagagtagaggtaaacattaaaaacattccttatacagctttaataattagtagtaatgggccaggtgcagtaggtcactcctgtaatctctgctctttgggaggctgaggctggcagatcacctgaggtcaggagtttgagaccagcctgactaacatggtgaaaccccctctctactaaagaatacaaaaaattagctgggcgtggtggcgcacccctgtaatcccagctacttgggaggctgaggcaggagaattgcttgaacccaggaggtggaggttgcagtgagccaaaattgagccactgcactccagcctgggagacagagtgatactgcctcca

SEQ ID NO: 88794 - DNA, 1142 bp, Homo sapiens
tagcctcataggttcctctttaacatgtaaaaccccttggaattttttctggatcgttcaggcataaacttgtcataatcataagctcttaggagaatgtttgacctattatgcttgtagaataggaaagagaaggctgaacaaattggaaataaaataatgtatacagtggtgattacagtacaatagaagtatatcagtgagtagtttgataaagtgactaaatggctgaggatgttcagtaaagaaaataaactactctagggattttaaatgggaaggatttaatgtagggaattaggtgttgtaaaattactgatcaaacctaacaggttcttggttgggtcttcagaaatgacttccaaaccaacacaaaactacaagggcatcgattaggagctcccattatggattcctactgaaaagagaaacgttttgtcactgcttccactttcactgcttctggatacccaaaactggagatgttacttgtctcgagaatacaggaagaaatttattaaagtaattctcttttcttttagagaaccagaagctaaaataaggtgaaaacttactttagcttaggatagcctctttgagaaaataaggtatcttatgaaaacagagagaaaacaaattggactaattgtggtgcgtaacctattgtatatatattcaaataacccttatatatctattctttacagatccaggatgagaagactgataaaagaagaagctagctgaacagctgtaaaatgcccaaatctgggttcacaaaaccaattcagagtgaaaattctgacagtgacagcaatatggtagagaaaccatatggaagaaaggtatatgattatactaaagatttgttgactttttgaactgggaaaaagactcccaattaagtatttttagtgatttctcgtaagataaaaaccaatatggatgccagataaatccaaaccatttatgccctttagaaataaattggattcctggggaagtgattgtttatcattccttaaggtgaacacacaactactaagtaaaacacaattactaagattgtgcaattaagaaatattgagagagggaaaaatttttattattagtcattgtcaatgacctgtaattctgtcttt

SEQ ID NO: 88795 - DNA, 1058 bp, Homo sapiens
ttattagtaagcaaatagtttactagtttttttcgctttttttttttttaaggtgatacagagtgtcgctctttcacccaggctggagtgcagtggcacagtctcggctcactgcaacctctgcctcctgggttcaagcagttctcctgtctcagcctcctcaatagctgggattacaggcgtgtgccaccacacccagctaatttttgtatttttagtagagatggggtttcaccatgtaggccaagctggtctcaaactcctgacctcaattgatccacccacctcagcctcccagtgctgggattacaggcgtgagcaaccgcgcccagccttttttggcattttaaaaagataatgtgttatgagaaaattcagagaacacagtatgatgtgttcacaaagtctacagaggcagctgtagaatatgttgaaattttattaacaaaatctctgccagccagccttagttctattttcctaagactttagatgccatttaagggtttaccatattataatgtgactcagtcaaatttgaggagaggagcttcttttaaaaacaaaacagatagatataatttttctgggaactatattaaaatagataaaattagtgctttgcttagtaagaataatcacctttggtgattttttcatggcagttattcatgatagatttacttctgcccccttcctgatatttcattataaaaatttcaaacatacagtacaggcttttaaaattatttttggtatttttctcttatttccttgcaacccaagcaaagtattaacttaaaaagattggttttaaaatacaagtgtcacttgttttgcctcgctacaaggaacatatgtgggagagagaatggctctgcttagcactcagtgttttgcatcaatctcaatctcataaacagtggtagtctcatacagcctagtctcagtacagcataaaaggaagtagttgaggaaggggacagggaaatgttaatagaagctttaattttccagttcctgagttaaagctttatagactattcagatgcccccaa

SEQ ID NO: 88796 - DNA, 1021 bp, Homo sapiens
aaagatgcagacattcaattggagattcacgtagatattttagaaccagagagtaatggcaaatttttttttcagaattgaagtatgtacattgcaaacaggattgacttaattatgttcatctatatttgagttgtgattccattgtttgattcttatagtgactactttgtgggaagatgttgtattctttaatttttgagacactaataggtttatgaaccaagttccctaagaaaaacaattttgtctcttctccttaataagtacttaacacttaattgggatgtgaagatgttgagctttctatttattctggcaagacctaaaaagaaagcattaattttcagcattataaaactggaacatctttgtatatctgaagatcctctaaaccttgaaagaatgttggagcgttgaaaagtccatttctctgtttgctttgaatagtctttaagtgaatctcttgtatattttcttaaaaaatccctaggctgtctgaatggaacttaagtttatagtagactatgctaaatgaacacatttgtcagtatacttacatttaaacttcaaagttcttgtctattattagggcaagtaaatacattttgcaggtactgaatcttgagaagtagctaactttttaagtattatttaatcaccttcctgacaagagaagtagctaactctttataagatatataatatattatcatttttttacttatgatgggtcagaggaaacaaattctttacaggacaaatcccagatagtcttgttgactgcttttaacttgaaaacgcatactttgggacatactagtctaacacagttttaacacacagtgtagttgtctctatcctagctgccttacaccggctgctgttttcttactttgctgtctcatgcagaatatgaactcagacatatgactatggtaactgaaagaaaatagagtttatattggatgctagcatctgattcgaattttgttttaaatatttggaatatatccaattt

SEQ ID NO: 88797 - DNA, 1050 bp, Homo sapiens
tttgtatagggtttcccaagaaatagatggacaggtaatagccagacctctgcatttggttgcacagagcacctgccttaactcccagagaagtcttacagaaaagacaaacatctgtatctcttgcttatagaattcagttcagtctgaatttgctgacacttaatggggaacgcaggctgcgttgctaatgggtttcccagatagttaaatctgaaagctaacttgatgatgggtcagatctctttgaaaaggtccttgaaaatttttggatctttgcaagatctgttaacccatagccacacagaatctttaatttgcgcattcttggctttgactaatgtcatttcatgttcagctatcctatgactggaataaaatgatttggtactttttttcgatagttgttctgtgtgataagacttgtcttaaatatttagctcgttggaagtttgtataaatcattgctggaattaaggaagtaatttgaaggagcattgctatataggcttatcagcaattacaaataaaattatagtgaataaaagaggtttcaaagatgtaatactaaagaatgtctgcactgttatcaaggaattaaattttactagaacaagtcattaaggtaaaattttactagtaataaatttcccaagtattactaattttctgaaaacagtggaattaagaatatatttttttcaaagcagtcaggaagaaaattgtttatataatataaaacccattgtgcttttgtctggctactactagttcatatattgtacacatttctcatatatatgtacagcatctatcaaaaaattcatcttaaacttgcttttgagtacttggatttgtttcaaattcttacatatttgttaataattccagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccaggtgatacctacc

SEQ ID NO: 88798 - DNA, 6022 bp, Homo sapiens
gaaaaatgtttcatagttcatcacatcattcattaaggaaacattttagagtacgtatttgatactttatcattttaaaccaattttatgaattgacaaaacattttttttaattggctaatgatatttgataaccctgaagggaagatctctgtgtatttgggtcattaacggatcatccaagtcaaggtttaggttgttagggtgagaaggcattccttgtgtttcaggagattagcatattaccaataaaaacatttaaataagtatacagaatatttagcctagaacttctgctaactttcttctttcttacagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggtaagactagtaattcaatacctactattcaggcactaaaatttaaacagatcctggttacaatttaatctacattcttttattcattttgctgaaatgaaagagttctaaaaatactctttattacaaaacttttggagttcgtacataaaacccctgatttctactacaattccatgtcaataattactcatatttttatatactaaacttatactttagttgacatattacttgctgtatagttctttatccaagttaggttttgccctagatgaatttgagttatatgttttcaaagtagttgattcattcataagtattttaagaacatttattaacttgaaccatgaggactgtaagagtgtggtgttattactttcattttcattattcaagtagcataccagtacattcttgctgtaaataattcaacagtaaaagtatgtagggaacaattcaaaaattttctttaatttcacatactgcacaaccctaccctccctcccacacaggttctttctcttccatagaactatggttaacgcttaggaggttactcattcagttcatttttattatatatgtataaagcaaatacttacttatatattggctttttaaagtgaaatcattccatctgtatcaatctgtagttctgcaacctgccttaatgtcttacagatatttctatatattcttacagtatatataggtaggcctactccattaatttttaatagctgcataatattttctggtatagcattccgtaggcaacactgtagtaaatacctatatagaaacatctttgtgtatatttatggaagtatttcagtagaagtgaaattgctaaatcaatggagatacatgttttagatttttgaaataatggaaattgccccccccaaaattctgtatcaattcatactaccatcaagagtatataaaagagccattttcctcatatcttcagtaaaactggatattatcaacttttaattattaacaatctgaagaatgaaaaaaatcttaatttggattttcatgatcagtagtgatggtaaacatttcttatgtttattataaacttatgtgtattttatgaattgttagatccactcctttgctcattttcttttggtttagtcctgtttttaatctacaagagcctttatttagtctagattttctctatcaaatatgtaaagattttcacagtctgtggcttaggttgaatacactctcattacagtgtttattgtactacagttttcatcttttatgtatcatatcaattgagctttatgggttcttggtttggtattttatttaagaaggccttgtctttctctgtatcataaaactattcctatattttctgtttttcaaatttggtttctgttttgtttttacatgtagccctattataatacacctggaatttatgtctttatttgctgtgagtggggaatggtgtgatatacagtatctaccttaaagagtgagacttaaaatgcatggcatttattctagaggaaaacttgacattatttatcagaaacctaaaaaatatttctttcatctgacaattccactctcaaggatttattttaaatagttaatcatggatgtacatgaagatttagttgtaaggatacttgttacagcattgtttctaattaaaaactagcaacaatctgtatccttagtaataggaactcgttgaaggaaattatggtatatttgattagtacaatactatgttgtagaaaagtataatgacatagggaattattttcactttagtaagtagaggaagcaggttgttattcatctaagttttataaatatgtgggagagctagtagatattatgttggattcttcaaattattatttctgggtggtgagattatggacagtgtttattttctttgtatttttaagttatctaatatttcttttgtgaacatgtaactttttaattacaaaagtaattaagtttattttagttaaaataagtattaagtccagaaaatattgtatcaacagaataaagcccttaagacatcaggatttttgtttactgaaagactctaatcaagcttactaatattttgcctctttaaaattctttttcatagtttaaatgattattaaaaattatatcaagcttatatttattggaaagcttaaatatttaatacttttgtcaaataatttagcacagtggaaatactgttgacccttgaactgtgtaggtctacttatatgtggatttttttcagtaaatatatttgaaattttttttgagatttggaacaatttggaaaaactcatagatgaactgcatagcctagaaatagtgaaaataggaaaaaattaaatacattataagtgcataaaagatacctacatactagtctgttctatcacttactaccataaaatatacacaaatctgttctaaaaagttaaaacatatgcatacagacataggctatacatagcaccattcagaatcaggagaaatgtaaacaaacataaagatgcagtattaaatcatagctgcataaaatttactgtagtacatattatactcctgtaataattgcatagctacctcctgttaccattgtggtgagctcaaatattgggactatctgcttaaaacaccatgtgactgacacaaatcatctccacataagcagttcgtctctccagtaagttgcatgccacagtgaaatgtgtgattcttgcatatttttcatcgtgtttagtagaatactgtaagccttgaataataccaggggacccattttaagtgctcctagtgatactagaagtgctcctaagaaacagaagagttacgacattaaaagaaaaaattgaattgcttgataatgtactataaattgaggtctgcagctgtggttacctgccatttgaagatgaacgaatccagcataaggaccagtggaaaaaaggaaaggaaatttgtgaagccattgatggagctatgctagtgggtttgaaaacgttgcacttttttgtaaaacattcttttatctcatgcagcttttatgcgaatgcaagattgctataaaaaaggcgtacctatagattagattgaagaaaacatgaagtcattatacaacaattttaaggaagatcagggatctaaagctggggaatttaacgccagcaaaggatggtttaataattttagaacaaggtttcgtttaaaaaaatgtcaagataacaggagaagtggcttcagtccactgataggcagcaaataaattcccagataccattaagaaaatcagtgaggaaaaaagaaaatctgcctgaacagttttttaatgtggacaaaagtaccctattctgggaaaaagaaaaatccacaaaggacatttattagtaaggaagagaagcaagcaccaagatttagggcaggaagggattagctaactctcctgttttatgtaaatacagttgggtttatgatcaggactgccccctgaaccctgaagggaaaaggtaaacccagctgccagtcttttggttgtataacaagaaggcctggacaatgagaactcttttctggattgatgtcatcaatttcttcctgaagtcaggaagtactttgccaggaaggaggctgtcttttagtgtcctctggcctcccagaaccaattgatttcgacaccaaaggcattaaagtggtgtacaaacatggtgtttctaaaccagcctctaattagagggtcataaggaactttaaagctcattacacacggtactccagggaaaggattgtcaacgctgtagaagagaactccgatagaatgtcatgaaagtctggaaggattacaccattgaagatgctgtcattgttaaagaaaaagctgtgaaagctctctcctcctggagaaaactgtgtccagatgttgtcatgacgtcacaggatttaccacagaaccagtcaaggaaatcatgaaagagattgtggatatgtcaaaaaaggtagcgggtgaaaagtttcaaaatatggatcttggagaaattgaggagctagtagataccacatcagaggtattaataggtgacttgatggagttgaatgcttccaaaacagtttcaagtgatgaggaagaagacagaagaagccatgccagaaaacagattgaccttagagggttccaataatttaaggctgcttttactttttttttttttttttaaacaccaatccttgtatgatccaggcactgaaactaaagcaaacagtggaagaaggagggtggcactgtattaaaacatttttagagaaatgaaaaagcaaaaaagtgagacacaaatttacaatgtatttttgtgaagttacaccaaatatgcctgcctctcccacctttacttttacctcttctccctctgccacctctgagacagcaagaccaaccccttctcccttctcttcagcctactcaccgtgaagatgatgatgacctttttgatgatccacttctacttaatgaataatagatttttcttacgattttgttaaataacaatttttctctagctttattgtaagagtacagtatataatacatacacaaagtatgtgttagtcaaactgttcatgttactggtaaggcttccagttaacagtaggctattagtaaagttttggggagtcaaaagttatatgtggatttttgactgcatgggggttaacacccctaaccttcaccttgttcaagggtcaactgtaatattatcttgaatgaaccttcagtaaattgatattgttcttatttatttttagtagcttcttcatcactcctttttttttgcacgatgtgcagttttagaatttatatgtcacacattggtatgtatatgaaaagcatatattttgaagtagcgcaagtgaatcatgttaaattaataatctaactttaggttggacaccactgcatgaagcttgcaatgttggatattacgatgttgctaagatacttatagcagctggagcagatgttaacacacaaggattagatgatgacactccactccatgattctgctagtagtgggcacagagatgtaagtatgatagaaaaaaatcaataatacacatttgcaaaatataaattcaacccaaagtaatttcattcacttcttagtcatatgatctgtgtcatattccactcattgcttgaacaactcatctatattttgttttcccttttttctactaagtattagttcatagtcagatttagcattttcttttcataaaacccttttaatttgacagttgattaaataatttggcaaaatttttatttcaaggcattctttataagacaattggatgtgttaaagcagtctttatatatagtaaaaattgtacagtgttgaattgcctatcttttgaagggcattttactttagttgagacaaaaatagaatttggagtaaagatagata

SEQ ID NO: 88799 - DNA, 3013 bp, Homo sapiens
tcaccataaactattgcacagccatggaaaagcatgtcagtgctgtgcctggagttgtagggttacttgaagacatttttataaggtattgttgagttcaaaaaatcaagaatagttatatctcatttttgtaaaatgaacagtgtttttaaaatctgtatgtatgtttacgtacatgtttgtgtaaaattttattagcatggagcgaaatctggaaggatgtataccaggccattaaggagacgtgtcttaggtagctagtggcagaggagatgatgatttggatggatggaaaggtcaaagtacagtcggacacaatcattgataatttttttacacatatatttacaagactcaacaaaatcttctcctgccctgcatccccgtttatttaatcatttatgcccttcccttcacaactaagcttcttaaggtacattgtagactgactcctccatggaacctagttttactaagattgcacatgctgtcactgccagacccctcagtggtatttcagtccttatcctttgaaattctccatagaatttgacactgttgaccatattcttcctaaaattctcttgccttggttcttgggacaaagttctccttggctttcgtccagctccccagactcttccttctcaatttcctcctagattcttgtcttcgtaacttcctcatttcctttccataaacacccctgtgttggttttctcaagatttttactttctggaccctcttctcatgctgcatactctctcaagtaaatttcacccacacttagagtttttactaccatttatgtaatgattttaaaatacatctatctcagacatttctcttaagcttcaaacttacatatttggctgttctctgaatatttccacctggatttcctcagcaaaatctcaaaaatcagcatacccccaccattacactcctcttcgtgttctatcttaattagtgtaacatcattcatctgcacatataagtcatacactcgagagtcatctaaactcctcttcttccttttccttctttcaattattcaacagctgtttttgagcactcattataggttaggcattgcttaggtactgaggatacagctgattaagaaaatggagaaaacataaaacataattgactcctgtcaatttcagctttcaaaatttttgtaagtccatcttccagctaaactgagagtcctttgaacgtttttgtccagtctaaactggaataaagatcataatagctgaaattgcattaacttcggtgagaaagagagtaatattttaaggctgggtgcagtggctcacgcctgtaatcccagcactttgggaggccgagacgggtgaatcacctgagtccaggagttcaagaccatcccaggcaacatggtgaaaccccatctttacagaaaatacaaaaattagcagggcatggtggcacgcaccaggagtcccagctattcgggatggggctgaggtaggaggttcacttgagcctgggaggtcgaggctgccatgagctgtgtttgcaccactgtactccaacctggacaacagagtgagaccctgtctcaaaggaaagaaaataagattttaaaggtaaaaattgtttatatgatatgttaactgttatgctattctaaatattacatatttggctgccctctggatattaagaaatctcaaaaatcgctactaattcttttaattgctgtcgcttctgaaaattgtagctatgaaaagcagctttgttataaacttgcttttagaaagaagtgctgcaacaaattttcccacggaagaagggaggtattttatttcaacttacatgtttaattagtgcagaacacaccttctagaacctttttgattttcactgatcttgattgtttcatgtgttcatcagctatgtattgatttttcagaatatttattttccacatggtgaatgtgcctgaattattgcttggtcaaagtccctcaaggaatgatacaaaaatcatcagtaagtatcatataaagattttggagttgctgaaaaagactgatgaaaatacccaaaatttattacttaatttacatgaggtccttgttagatttaactgtaccaaacttcatccaatctaaattcagaacatactaatatataatcatgtaactgcccatagatgtttgtatatatgaagccagatagcattatctaataatatagcacatcatctatgtgacagatacactttaagtgttgaaagttaaagaataaccaagattattaatttcagaacttaataaatttggagtaactaagagggtatcatgtacgtagcattctaaatgtggtttattcattagtcattgtgctttatgccagtgctactcagagtagcctttccattaactgtttgttaccagccctcaagataaggagcttgtgccagaatgtctgtcagtacattgcttccttaatcagaaaggaaaaaatattatggaaaaaaatgtccactaaaataagtagtgtgctttgtgatgtaattgatttccatgtttggtaccagctctttattttatgatggtttagtaataaacaatttgcaggtttgcctgtctttatggaccacactttgagtagcagttttatgtcatgtgtatcagacatttatgatattgttgcaggaatacatgtcctgattaatacagcttatttgtgtataaatgtttggcacttttaaatttgcataattctttagtcttttttcccctaacttctgcctttttccattagtctaagtccatgttaccttcctctatagaaattctgtccagcaatagtgtttgcttcaaatgattgcttcttgctacggtgcgagaactcagtcatattcagaaaaccagatcttgctcataaaccataatcgtggaaatggagaagtgggtaacttgtcacataacacccctcccgcatacttactgacactcattaattgccaaagtagag

SEQ ID NO: 88800 - DNA, 1035 bp, Homo sapiens
gtactattataaatatattgtcataatttgtacaacttatttcctcagttttatatttcaggaactatgaaaatacaactgttggtacttacttacaatggagttctaatagttaataagagatccaaaaaaaattatttaagtcaaaatgtaccagaattttttatcaaatggattatgtgatgttaacagttcaccataagtagggagaagcattagcttaggaagttttaaagtaaatttttttaacctagaagcataaagactacaagaagaggttacatcgggtgtttttagtatgtccaaatatatatatcaacaaatttgatgatcgggaatctagacttgatagagcattttatagagtagtttgcatatgagtatacctataataaaagatttttcatttaacatgtagttaaaatgtaaatagtattttatttttgtcctttttaaatgacgtcttagtagcttccagtgtatttattagataatagttcaagtctcgtacaaaaaaattgcaatccattagtaaaccaagaaccttgttttatttaagcaggactattagctacctccttgattaagcctatttctgaggttgttgaatagcagcaagcatcaagtttggtgttcagcacctttgtcacatatccctgtgatgtgagtgcttagaaaaattaaataggcacttaggtatctgttatgtgcagagggctgagcatacagcatggtaggcaatgaggtattctttaatgaacacttcaagtgttttgcatgctttagttttcctcctctgctttctaacgtatgtggtgtgctttacacacagatttctgaatcttagttttttaaactttttaaatgtatatatcaccaacttgcttctacctctgtcttaagcaaacagaacacatacagatgtaaattaattatatcagcctagctccaaagcccaagagttttaaattccaggtagttttttttttttttcaaaagaaaaatacatgtcaatgttacctagaggaaaaaagg

SEQ ID NO: 88801 - DNA, 3761 bp, Homo sapiens
aaatgcggagaaaggggaacccttgtacactgttggtgagaaacagccactttggagaacagtttggaggttctccaaaaaactacaaatagagctaccatatgattcagcaatccaactgctgggtatacacccaaaagaaaggaaatcagtatatcaaagagatacacgcttctatgttgactgcaggactatgtttttatactatatattgtgattttaacatatactgtgcttttagaagtgtcaaaaggagcctcaccataaagcatattctctagaaaagctgttctacaacactatcagagttcttacacattgctattacattatttccatataaatctgaagtgattatgaattgtttgaaatatgtattgtataagctatatctttttctcagaaaaaaaaattatttttctggcagttgtgttttgtttgacccacaccacattttcttttttttattctagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcagg

SEQ ID NO: 88802 - DNA, 1907 bp, Homo sapiens
gagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacagtaagtaacatcatcacttgctatacacctgtaacactgcccaatagaagtataatgctagccacatacgtaatttgaagttttctagtagatagataatttcagcaaaataatctgtcagtgagtcgagatataaagctagtaacgttcttgtttctttcattccccaactttattttcccttaaagagtaagaaattttagccgaaataatatgtagtgacataggcttcaaatacaggtataactataaagaacaaatttaaattagaactttatacaaactatttcagtaaaaatcatttcaggtgaaccatattatgttgctgccttaaatcaatctgttgactttatatatgtatacatttgttgtataaatttatccaggaatttatacacatttatgttaaacacgtgtttaatgtaacaaacacatttacgtgtttaacaacataaacacatttatgtgtttaacatagacacatttatgtgtttaacata

SEQ ID NO: 88803 - DNA, 1028 bp, Homo sapiens
aaagtttgaaaacaatttctcagaccatttcatctgcttttataaaagaattaaatgtaacactcaggactttagtgtttgatatttatcatgtctgcagacagacctcactatatagataccaattgaactgctttaatctttactagtgtttcctgcatgtttataccagcttttctggttttgtgactcctccttccctccttgtctgtgagctgtcacttactgatgatctaaaatgtgtctcgctggaataacttccatagtccttctaatttgctctttgaaatttgttgtggccttagaatcaaaacatctaaactgtgctcaatgtttccaaacagaagtaacaatcagttctataactagtgctgtattatttaattcacaggacatcagaatttgtttttttatgcactaaaagggtttaattttaaaagaatagcccattattgtaaataaaacctaatattttaaactatatatatctttttaattagattacaccaccaccttcactgtcagatccacttaaagagctttttcgacaacaggaagttgtaaggatgaaactacgtttgcaacacagtattgaaagggtaagaaatgtttaaatttacacttatgctaaaaataactggtttctagcaataaattaaaatggcctataattttttattagtggatttttaaaatttagaaccattttgagaagtgatttggttttatcttgtgtttattagatggaaaaattttaagcctattttaggatagctgctcccatattataatttatgttgagtatatttttaatatgtaagtctctaataacttcttgttatttgttgaatttgtagaactatagcagtagattcctagtggaacatttggctttccaagttttggaatcattgcttggtaccagctgttttaaggcaaaagggcaaaatacttataaaggctatgcttatttgtccacgtaggtcggccttagtatgtgccttccaatggttagtcttggcgtgaaa

SEQ ID NO: 88804 - DNA, 1021 bp, Homo sapiens
gaagaaagaaaggcagctgtggaaaagtaactaaaatctactggacagctaaaggaagatgaaagttattttaacaaggtctgtttgtacagaattctcttggccttgattccctgtcactggtcacaagaatgtttctttcctcctggtttcaggagagcatctttcccatgggagttttatctctggctttcaggtagaaaaggggaggtcagagcactcttgagcctgctgacttcagattgcctttagctcaaaataatgtttatgccaaagtggcatattttggggtagcgttttctgccacccttcaagcccaaatgtctatcaactgatgaataaataaaatgtggtatatccatgcagtagaacatacttttcagccacaaaatgggataaagtactgatgcatgctacaacatggatgaaccttgaaatcattatgccaagtgaaagaagccaatcaccaaagaccacatattgcatattatgtgattccatgtatattaaatgttcaagataggtaattcatagagacaaaagttagattgttggttactaggagcatagaggaagggggtggagggagtaaggaatgactgctgatgggtagcaggtttctttttggagtgatggaaatgttctggtgatggtggaacatcttgataaatacactaaaagccactattttataccaccatacttggaaaaataatttaaaaatagagaaactggtagttttggagagagaaaatgtatttctacttttggaacactgggagttctcaaatttctcaagcctactgtgaagaaaagactactctgaaatttgggttacttagcttgtttgtttgtagagatggggtcttgccactatgcctggcctaacaaattgtttttgaataagataaaatgacttaaaatatgttggccaggtatgtgggttacacctgtaatcccagcgctttgggaggccgagaggggaggatctcttgagcccaggagatggtgaccagcctgg

SEQ ID NO: 88805 - DNA, 1015 bp, Homo sapiens
gattaagccaaggagttcgagcctgcagtgaggtatgattgcgcccgctgcactccagcctggatgacagagtgacaccctgtttctttttttttttttttttttttttttaagcagagtctggctctgtcgcccaggctggagtgcagtggcacgatctcggctcactgcaagctctgcctccctggttcatgccattctcctgcctcagcctcccgagtagctgggactacaggcgcccgccaccacacccggctaattttttgtatttttagtagagacggggtttcaccatgttagccaggatggtctcgatctcctgacctcgtgatccacccgcctcggcctcccaaagtgctaggattacaggcgtgagccaccgcgcccggccgacaccctgtttcttaaaagtaaagtaattaattaaattcattaaaaataaaaacaaattcatagcagagctggaaattgaggtgggaaactgttagacaaaaacattaagaaatttctgataagatttaaaatagatgaaaacatattggtaatcaaatacagcagagttgaggaatgcccagtatcatacaggttaaaaagagaatttaaaaaataaatgcgttttcctagaacagtataaattttcagttataaagggattttgataacttgagtaattcattttccctgccccagattttcttaatgatccagaccacctgactttagattaaattaagcttgctgagatccttttgtggatcataagcctgatgattgggttttcacactgtgtgagacaggcctctctcaaaccttgttgcattgtgcacacattacctgtctgacatgggggaagaaattcagcttgatgagataccaaaatgtgaggtgtattctcttgacagagagaaacttatgctaaaaacatttctgcatttttggtgacttatttaaatatggaactgttatccacccttttacagctggctttagagtagaaggtctcaagtagcatgcg

SEQ ID NO: 88806 - DNA, 1966 bp, Homo sapiens
tgtagtctcagctacttgggaggctgaagcaggagactcgcttgaacccaggaggcggaggttgcagtgagcccagagctcgccactgcactccagcctgggagacagagcaagactctgtctcaaaaaaaaaagaaagaaatggacttgtaattcaaatgctttttatgctcctgatgtgtccattttagttcctaaagaaactggatgagattaatttttaaacaaagcaaagttaacagaataatcaagtaactcttctcttcttttaaatagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttcc

SEQ ID NO: 88807 - DNA, 1054 bp, Homo sapiens
actgagggtttagatatactcactctactttcacagtcaccatttctggatagtctgaggaactgtagagttctaggtccttgaagatggctatgaagccattattatacaaaattattgtttatttttgaatgtttatataatctttcattgagaatgatctttaaatgatcactcaaaagttttttgaaggccaggcatggtggtattgtctgtagtcccagataactgggaggctgaggtgggaggatcacttgaacccaggaattgaaggctgcagtgagctatgatcacaccactgtacttcagcctgggcaacagagcaagactctaaaaaagaaagaaaaagtatattgacacaaacaatgagtcttagtttatgttttgtttctcatttttatatttgtttttaccctagcacttgcctttgaattaaagttgtgtttgtttgtttagtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggtaggactaagagtacttttattaatatcaaaatatattgtagagcagaaacattatgtttatatacagatatagagtgcatatatcatatagagtaagacctgagtattgggtcagggcctgaggtactgaatcatgacacacaggtctggatttttaccctcatagcaatcaatatatataggcaaggttagattcaagaagttcaatactgagtataatatcctgttgtataaacatgtcattacaaggtgatgagcactctattcagatgatttaatctgtgtaatctaattaacatagcaaagaggttcaatgaatgtatttagaaaaaaaattagctggtcaaataatagataaattgttaccctaagtatgatgtattagttgtccattgctatgtaacaaattaccccaaaacatagcaacttagtgcaa

SEQ ID NO: 88808 - DNA, 3469 bp, Homo sapiens
tttttttgtttttcttctttcttgccctgaaatcttaaatttttgtttttcagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgacgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattattatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttgagatttagctcatggatatattttttggtagggaaacattagggtctccttttcttccttttacctagaatgcctcatttaaaagtgccttgaaaacatttagctccccttcttcatgagcatctgtagagctgaaagtattctggaactttagacagaaagctgaaaggaatctgcagtctcctgctgcagttcaactctgctgtttttcagtcatttcctactgtgagtggagtgatgtttgtgtgtgtgttggcaacatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgtaaagatcttttgccttcaaatttggcttattttttctgatttatgagggtttgaaagaaagaattcacctaaaagattccatttccagttttataatgtatttcaggttctgaataacaatatttttccaaattgaaagtaaatattccagaagttgatagcctggttaaaagttagatcctctattaccattctaagcacattcacttctatattgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaattgaaatgagtgagtcatattttttgttaacttcagcatagacataaatttgacattctgtctaaagaagatagtgtttaagtgatcagcgggccgggtgcggtgtcactttgggaggctgaggtgggcaaatcacttgatctcaggagttcaagaccagcctgggcaacatggtgaaacctcgtctttacaaaaataaaaaaattatccgggcatgttgatgagaggtgaagccacctggacttcttgtttcgagtggggacttggagaacttttctgtcttacaagaggattgtaaaatgcaccaatcagtgctctgaagctagcaagagcattgtaaaatgcaccaa

SEQ ID NO: 88809 - DNA, 2025 bp, Homo sapiens
aggagtttgagaccagcctggccaacatggtgaaaccccatctctactaaaaatacaaccattagccaggtatggtggtgggcacctgtaatcccagctactcgggaggctgaggcaggagaatcgcttgaacccgggaggcggagattgccctgagctgataccacgccactgctctccagcctgctgacatagtgagactccgtctcaaaaaataataataataaaggcaagagtccaaagtggatttttccttctgatacttaatatatgtatagttatgtgtcacataatgtttcagtcagggatagactgcatatacagaggtggttgcctaagattataataccataactgtacttttttctgtgtggaggtatgtttatataccaagtattcagtacagtaacatgctgtacaggtttgtagcctaggagtaataggccataccatatagcctaggtgtatagtaggctctaccatccgggtgaaaataatttgttaattttcctactttcttgtcattaatcgtttttaaaaacttttttttttttttttttagacagggtcttgtgctgttgcccaggctggtgccatcataactcactatggcctcgacctcctgggctcaagtaattcttctgcctcagccctcccgagtagctgggactatagacacatgccaccacactcagctaatttttttttttttttgaaatggagtctcgctctgtcaccaggctggattgcagtggcgtgatctcatctcactgcaacctctgcctcccaggttcaagtgattctcctgcctcagcctcccaggtgtctgggactgcaggcgcccaccaccacgcccggctaatttttgtatttttagtagagatggggtttcaccatgttggccaagatggtctcgatctcttgacctagtgatctgcccgtctcggccttccaaagtgatgggattaccaccatgcctggcccacgtttggctaattttttattttctgtagagacagggtcttatgatgttgccaaggctgatcttgaattcctgggctcaagcagttcttccaccttggcctcccaaagtgttaggattataggcactagccactccacccggtcgattaatcttttaatagttgtcgtcagcatgaaaagggcattcatacattcatattcattataatgaatttgagaatttcacattttctaaactgattataccggcatatcttgtctgaagcatgtgagtagggcagaagctaaaataaagattaagtctcacggtatagaagaagggtacagaaaataacccaaataaagagtaaaatcttgattagagtacaagcctaaacaaagttaatagatatgaaaggattaattatacagctactaaattggataataattgctctgtggaatgtacatgagaaattatttttgagcctgtatatgtgagtagtttgcatttaatgggtcccggtcataaacctcaaacatattatcatgagaagaatttcactgttgatatgaaatcttttaaactttatctgctcagtctgaaggattatttctgtcccatttcagcttataaatgtaaaaaaagagaatgtgctcctcatatctaatgagctgctggtagaccacacttcacacatgttaactgttgatggagagattgaacctgtccagctttacacactgggagaggaccctaggaagctggagaggacctaggaagctggtgtctgatttcctctggacttcaccctatgtgcttcttcctttgctttttttgttttgtattctttctctatggtagatcttagctgtgagtacaaactatatgctgagttatgtgaatccttctagcaaatcaccagtcctggggggtacagcccccaacacagtaataaatgacttaaaaaggaaaacactattccctgcctcatccttgcacctctctcagtcttaggtttttttttttcttttaggtgtttcttttgctatttgtttcct

SEQ ID NO: 88810 - DNA, 1148 bp, Homo sapiens
tctggtctcaagtatttcagataagggatactcaacccgtagtatgttagaggacacgactcacgtgatgaaaggatgctcggtctactttagaaaaggattcattccattagccctctatgtagagcctttcaggtgtatctctaatgtttggtttgcctgaattccacttacacacatatgtaatataaaccctgtttcccctcctaatattgtaaggatggtaactgctatctatttgtccccctcttgtggtcaagagatgtcactgcaacatctctttttgagaagaaacccatttctttgctgggagtgcccaggaggaattggccaagaagtgaaaagctagattagctggtgccaggtggcaccgttttttggttctgtttttagaaagcatatggacagtttgacattaaacaaacatataacttatactgtctctgtttctttggcagctgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggtactgggaatgtgcacttcacttgatggtttttaataataacttcagtttcatttttcgaaggaagaaaaattattgtgaggaaaatttggcctggatcctaagccttattcatttccttgatcctaccagttgcacaaaaatccacccctctccccagcctttctttggtgttctggcatttgtttttttaatatttccttccattaggaggatttcacgttagttgtt

SEQ ID NO: 88811 - DNA, 1081 bp, Homo sapiens
attgaatttgagtttataactccttagtattatataaatatatttaaacaaatatttgatttttatgaataattggctaggcatggtagctcacgcctgtaatcccggcactttgggaagccgaggtgggcagatcacgaggtcaggagattgagaccatcctggccaacatggcgaatccctgtctgtactaaaatacaaaaaattagccaggagtggtggcgcacgcctgtagtcccagctgcttgggaggctgaggcaggagaatagcttgaacccgggaggcaggggttgcagtgagcaaagatcgcgccactgcactccagcctggcaacagagcaagattctgtctcaaaaaaaaaaaaaataaataaataataataataatatactgaattgagttttaaacatttaaacattaataacataagttgcttctctcacatggtcttaatagccatgaattagttttgttttaggtaaaagtttttctgaaaattttccacagctttgttcaaaggattctttttgtctctgacctacttttaatgtctgcattttttttggaaattcagagtcatagaactcttctctgtgtgtaaaagcattcagacagagctgctgcccatccttgcaacagctaggggctgaactcctgctctgctgagttttgggtttattctctaacctgtggcaatgtgctgtagtcagcccgacttatgctactgtcatggacagtgctaataataatactgccttttgctggagatgttagttctcacttatgcattttaagaccttttgctggaagtgttagttcttgcttatctaattttaaacgaatatgaaagacaatttaagtgattttgtacattttaatttactcatctacattttcttgtattttttggattaaagtgtacctgtatgctctttctttctgtggaacacttcatttgtagtgtccaatttttaaaaagaaaacattttgataacagtttcagagtaatgacaaaccaaacacacattctaattgtctacttgtacaatttgttgggtaggtactatagggggaagaatt

SEQ ID NO: 88812 - DNA, 1051 bp, Homo sapiens
gggtgtgagccactgcgcccagccaagtgtagtcttacatgttagtgtttacagaggaactgtacgacctttgtgcagataaatatttcataacaagaggttcgttattggtcaggttgctgttctcatctccttagcaagggtggggataatggtaaagaaaacttgtgtgtttgattttcttttctcagtatcttctctcttctgaatttgaatgttttaaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcaggtacatggtcttctctacacatataccctctggtactgacattggggaactggggtaattttctattgctgagtcacatgtaaagcagtgaacttgaggagataggtaatggattagcttgaatacgggtcttttcctttcataatttggacagtgtcaatgtataagataacatacttgccctttagcttgtagtgatgtaatttgaatgcggtacagtctttgatgtgggtttataaacaagacctgatgacaaggatccttcattaggggaggaggagcccatggcatctacagttatagagttcgtgtgtagaattttagagatcccagttatttaatcaatagcattattgcttcgttagatcacagacacacatcaaactcaggcacaaagggacctgtcattaattgtttggtcaaagatttagcctgaggatttcattcataaggatggatcctagagagacatgttat

SEQ ID NO: 88813 - DNA, 1082 bp, Homo sapiens
cctgtaatcccagcttaccggggaggctgaggcaggaaaatcgcttgaacccgtgaggtggaggttgcagtgagctgagattgtgccactgcactctagcctgggctacagagcgaggctccatctcaaaaaagcaccaccaccgccaccaacaacaaaaaacacacaaaaaataagatgtttaaatcagttaatactgtgatagaaaaaataaacaaatggatggcatcaacttctctatccttttcttgactttttttcccttcagatctttctggtgcttgaatacatgatttaactcatattttaccattttcttcttaaattggctattaactagcaaagactgtgttgtcattactgggtagaattttctttatgtgtccaggattaaaggatatattatgtaatagacacaaataagtgaaatagaatgatagttttaatggttttcttgtaaatctttttttcttagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggtgtgtgcaccctgcctgccacagcctgcctctgcattggctgttgtggagtccagtggtgatgggctcttgtttcctgaacactttctgtgtgtctggagctatgttaggcacactgaagtcagaaattcccatctggtactgtttcatgccaaataagtcagaataccatggtggaaagagcatagtttttggaatcaaaacacctggctttaaattcttgctctgatctagttaactgattttaggcaaattcttaaccaccttaagcactggtgttcttgctttaaaatggatcctcttataggattgatgtgaagattaccccaaatgagataatatatgaaacatgccaggcacgttgtaaatagtctaaagatgtttgccttttcttgacaaggttgctgtcatcagccatattttatagataagaatattaaaattc

SEQ ID NO: 88814 - DNA, 1092 bp, Homo sapiens
agaatattataatgtcacttgaagtgaacttctctggtgggacatttattcactaaaatgtttctagtcctatattattgatattgcagcctggtgtcagtcacatgtttcagtgtaatctagaaagtttttttttttttttttttttgagacaggatcttgctctgtcacccaggctggagtgcagtggcacgataatggctcactgtagcctcgacctcctgggctcaagggatcctcctacctcagcctcctgagtagctgggactacaggtgtgcgccaccatgctcggctcattttttattgtttgtagaaatagggtcttgttatgctgcccagactggtctcaaacttctgggctcaagcagtcctcccaccccccaaagtgctaggattataggcataagccaccatgcctggcctagaaagttttgttttaattaaaaatgattttactaaaaaatttgtcatttcctgcttggttatacctgtaaacagggctttctatggatgaaaaacaggctggatggtgacacacctttggggactgctggggaatttaaggcatttagaattagtcagctctttggaaatgtagtgatgagggtcacctggaaggccttgaagatcaggagagattctatttatgtaataataataagagtggcctgcaatacctgatgagtttagggtatgccagtcagacttttgagttccctcttgtttagtgtgtgttgcttggttctgggactgtgagtgtaccagccacagcaatggtaaaatcccagatctctggatcaccttaaaatccacattgcagatcaactgcagcatctaaacagcacatccaaggaacattagttagcccttgcctgaattggggaacatgatagtaggtctctgttgtggttgtgttaaagagacaaagacaacctgaatacttctgtttctttgaggttagagatttgtattaatgtggaggatagctttgtcacacggggcacattcatgggacttttacacgtgcgctccaggatatgtaatgtagcagaagccctctgcgtatttttcttccttctttttcctagctc

SEQ ID NO: 88815 - DNA, 1042 bp, Homo sapiens
tctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccaccccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccg

SEQ ID NO: 88816 - DNA, 1364 bp, Homo sapiens
tgctttctcttcattaggcaagagacagatgccccatagtatttgttttgttggaaattataatctcttcaagattaaaggtggtttatttattttaatcgacccccccgccgcctgccgcccaaaacacctcataaatatagttgcacggatgaatgaagcacagaaagaagtttgtagtagatgtcaaagaataaggataaatgaatatttttttttctcctttttttttttttgtagttggtgtttggaagcatttttctttcactgctacttaatggctaagaagtgtgatgttttcatctatttattaatttaatattccttagctgtcattgaatatcatgagatttagtcttataaaaacaagataaatctcataactctttttattctggcactttttcttcctataacaaatcagtttggattactgtttatgtttcagtgtggcttgtttgtacttgtagaaatacccagtttaactgtttacactcgtacttgacggaactctgaagtgttccgttggactggtttcatctgtcctatgcacatgtcatttccagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacag

SEQ ID NO: 88817 - DNA, 2189 bp, Homo sapiens
actgtgacaagaatctttgtaattgccattgttttatgttggcagggtttgtgtgactgctcttctgctaaaatagcttagtaagtaagacttgccagtttgattcatgcactaccaaaacatagttaacgtttactgaaattgactccttttaataagccggaggcagctccagcaactagatagcatttctcttttcatactaacgcagaataatgtacagtagcagataaacatttttaatctcatgaaagcatattagttttctactttttctcttgaaggactaatgatttaccacagtagaaatttttttccagctttttgattgcagtgtcaaaaaagtatatatttcattgataacgtacagtgcaaatggagaacagccttgtaagaatattgcaattgtgtttctcactttgtccatttccttattttgcctgtagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgaggtaacaaactcagtaaagtgtttaccaaatgagagtagtttgaatcagaagtctttcattggggaatagttgtagctaatcacttttagtttgtatgttctgtttgttgctgattttttagctcttcgttttgcataaagtaattgttttcatcacatcctgtcctcgtgacattagtgtcatatgaaatgcctggaaaagtaaatcccacttctgtctatatgaccatttagtagactcaatgttaatgtagctcactgcagtgaaatagtcttactggaaacaaagccctttatcaagaataattaactcttcccttttctttttggagaggtgctttgtttctgatcggaccatttcactgcagcaagcaacacagtattctgagcagaagatcgggacttgaggccatgttgcggagggccagtgacattatctggactctggagtgtgagggtgggtactgatcctagcatcatcttcactgtgtacttgtagctgttctctatgatccttccctaatttcctgctgcatctccatcaagccagcattatttggtatcagtgctgcttagccattgtttatacaaatggggagaaggaatgcaccaccgattgccagaatcgcatggtcacagatcatagtggcttgaatgagaagctcaggaaagagtacctgcacacactggggatggcaggagggttcttagagctttagtgcatttctgttttgatttctgttggatggcatgtggtatagttagaaatctgtataataccactgctttggattgaagccctgactatttattggagatttgaatagtattaatatatctgcattttagaaggtgtttatgttgttgttgttgttactgtttttggctgttaacatatatataatttgtgaaattagatattaacagccaagaatagaaatagaagaaaaactgcatatgacactccatggtctctaaaacaatggaccaaaagaatcctctcagtactatttcataaataagctaatttgagctgtttggaccatttcaaaattactttcaaatattgtttttaattactctaatttttctggaattggttttcgtacacttgacaacctattcagcaagttagatttaaagtagggtaggttcttaggtatgtttataagcttttaaaaacatgaggaatttatatgtttattacttttggcagtcttgaaaggtaagtaacttagtaagatagcttaaatgaagatgtacagacaggacagctctttaagtagttattttttcctaacagaatatggactccactcttcactatattcacagcgattcagacttgagcaacaatagcagttttagccctgatgaggaaaggagaactaaagtacaagtaagtgaccaaaaaatgtgttcttttgtgggtgtgttcctaattcctcttttagagcccatttctgacctaatttgccccttctttatgatgagtgttctaaaaattgactagtgtgtcatattttccataaggaaatcgaagtagtagagagaggaacatggaagcacaa

SEQ ID NO: 88818 - DNA, 1026 bp, Homo sapiens
ttcccaccaaataaaacaataaaaggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaaggtatggaagtcaatcaagttatttattctgaaattgattaaaaatattagtgtctatcttaaaaaaatttcatttcagaaaaaattgtcatttaataatgtattatggactgggcacagtgactcatacctataataccagcactttgagaggttgagacaggaggatcacttgagaccaggaggttgagaccagtctgggcaacatagtaagaccccatctctacaaaaaaataaaaaattagccgggcatggtggcacatgcttgtagtcctagcaacttgggaaactgaggtgggagatcgtttgagcttaggaggttgaggctgcactgagctgtaattgtgcctaagttcaaatggtgtcaaaggatcatgcagcagcttgctctgatagttctccagcctgggcaacagagtaagaccctgtctattaaaaaaagaaaaaggtagtataaccatcattatcatgtatt

SEQ ID NO: 88819 - DNA, 1097 bp, Homo sapiens
gaaacatttactatcactttattactctttgaagcatttattgattccaaacatctgacttacacatcagatctttcactcaccctggatcaggctgttaatgcttctttgaaagtgctgataaagcctacttctcagaagcagagttgaaatactcaaatctgcattttaaaagtatgtaaaataagcattcgttatcacattgttctctgaatgcaccatgttctcttaattctccctgtttttgtacttgctgctctctgggaagcttcttgttccatccataccctcgtttaacaaagtgctgtcttagatgcactgagttgtccaggaagtacagagcttttgtcttcatcatcagtagcgctgtaatgagagcactattttaatcctatccttttggctacatattggcatctatcatccagtagcctcccggccatgcagtgtggcgtccagctcctccctttgtctccgctgggcctggcccgttggtgcacatattaatcctgaatgaattattctagggaaatatggatttgacctcaaaaatctgaagtaactaaaccacttttgctggatttttccagtttagcttaatgctaactatatgaaaaaaaattattagcacaaatttggaaatatttcatgaatgctaaaacttcattgagttaattcacagtacttggaaggtatcctggagcgtgtttgcttttatctcaggatacaatacctctttagccagatgttctacaagtcattttctccttgaaatacctgtaattaattttctaggcccatagtctctactaaggaactctgaagatattaattataaacttatgtaggcacaaaaagacacttaagattcctccttaagtaggtagtttctggactgtcctctggtgctcttgatacctacgtctcttaggagacaggataattcccattatacagagtcacaaagggcctcaattttcaaaaaaaaatttgtcttgtacaatagcatttcaaagtctgacaattaggaatatcagaattttagcattgaacagcttgattttgtattgactattatactttaccaggaaaaatta

SEQ ID NO: 88820 - DNA, 2115 bp, Homo sapiens
ctcactacagacttagcctcatgggttcacgcgcttcttccacctcaggccctgccgagtagctgggaccacaggcatgcgccaccacgccctgctaactttggtattttttgtagagactggatttcgccatgttgcccaggctggtctcaaactgctggactcaagcgatctgcccagctcagcctcccagagtgctgggattacaggcatgagccactgcgcccagccagagaaaatagcttgtaagaatttttcagtcctagctaaagttctgaatctgggcttcctttagaaaagcttcattattatcctaaacatacttcggcatttgaaagtagattattaaatatacataatgtgtgcgtatataattctttttcaaaatgattcctttattattgtcctttttatcttcctaggttcgccaagcagcttttcagtctctgggacctttcatatctacttttgctaatccatctagctcaggccagtattttaaagaagaaagcaaaagttcagaagagatgtcagtagaaaacaaaaataggtataattttgaaaccattttctaattttaaaaccttgttttctaattttactgcttttaaacattatttccactattctgcaacaaatgttattttttgatagtttgctatttctcttgaatataaaaattggtgaatatttttatagagctttactttaagcgcatttgtttgttaagtatctctttggttggttacatattgaatgagtagatgcatgtaacacaattagctagatgcctcgcacataggaaactctaaatggtagattatgacttttaaaaaatgtttatttagtacattatttagtcaatcattcattgatatctacaatatacagggtaattgttacacactgtgtagtatttgggtttttttaaatttgtttttaaggagtaaaacttaatttaggaatatgttttattgtccttttctgtcaaataatttagttgcgcatcttggattctttgtcaatggtgattgtaatctgtcagttaaaggagaaagccagtatattagccagtatatcagttttaagtatatcagtctcataaggaaaccaaagttttaaataaagcttaaagagtcggctgtgatttttatttttaaatgtttttgcattgaaaattttctattaaatttaaattttaaaaatttattataatatatatttaggggaaaaactaattcaagcctaacttactagtatgcgggaaatgtacacaaacttttacagttatgcacttgaagtaattttagtacaaatatttgaaacagtccctgctataatgcttgagttaccatagtgtcttttccctcccttgtcatgatgctaatggacattttcttctgtaggtcttgatactgtgctatttgctttcttggtgttttgatttggcagttcttctttcttctctgctgccttgttttacctttttgcccgttctcctactgtcctgctgaatagccaaacaaacctgaggtactgttttttgtaaaggaagaaaatcactcaaacctgtcttcctagcaagcaaagtctgtcagtttttttgaaaacaggtgctgccaggactttgacaaaagtgatgatggtgggtggggaatgttatctatttttcatttttgaaatcagcatacttaaaaaattacctgtttatactgaagactgttacataacttctgttttaaaatctgaaatgggtctagtaagaaactataaatttgcagagaactgtataggacgagctggtaaactttcttctgtttcacaactactcactcggcctttgcagtgtataagcagccgtagacattacataaatggacaagcttggctgtgttccagtaaaacttcactgacctcaacagtgtgcctatcaaggccatgtttgccgcctaccggtgtgtagcattactgcaatagctatttaaaggtagttcaattccttgattcttcttccattgtaatgaggtatgtcttaatgtccaggcaatactacttgtattgctgatcttcagtaatattagagcttattaaattatgttaatgatatggtagggg

SEQ ID NO: 88821 - DNA, 1138 bp, Homo sapiens
ctgacctcaggtgatccacctgccttggcctcccaaagtgctaggattacaggtgtgagccaccacgcccagcctcagtgttttaaatgttggattgtcttaaaaagtaggatctattagtatttatactcaacaattttcaataaatcacatctaatttactgtctattcctaaaagtataaaaaataatgtatcttaaattataaatatataacatataataatatatcttaaattttaagttatttcttatgagtcaaaattatgtttgctttaaaacggacagaaatgtattatttcacaaaagtgataatcaaaaccctacccaacatgaaagatcactgataaattaataaaaagtgctgataatttggtccgtcggatttctggctatgcaaaagcatactggattgtcttatgcaatatttctggctatgcaaaagcactcccaacaatcatagcttaaatgttttacaagagcttgcccctgaacttaattattttgcataagagatggcttcagaaactctttagatatggtgacttatacatcaagtataggcatcttgtgtactatttaaaactaacttgctatagatttaatatgtcatcaacattcttgagggttgcaataaaattaaaggttcaattgaataagtaagaattgatttgcttaacagaaatggaagaggtgaaaacagatcaatggttctgaaacatatccatatttttaataaatatcaaaaagataattcaaatgcccagattacagatatttaaactcctaaattcaaaattatctttctggtttatattcatggaattgtgttaataaaactttggagtaaatgtgtgcatttcaaactttatgtactactttgtaacacacactgtttactcctttatatctgcaatacttaccaacatttcttcagtagcttgctggccaactacactgcaaatatctccaaaattggcagcacagacctgacaacaaaagcatcattgacatttcaaaatattacacataaggttcttctaagataatcttttaaatatcatgtatcagtacattaaccactagaactatgttcttaaacagcagaaaaaaaacgacaaaaaaatacctttcgaacg

SEQ ID NO: 88822 - DNA, 2221 bp, Homo sapiens
ttttagctttcttctattaagtgaagttagataccagtttcattagctttatcttccacattgcaggactaactatattggtgcttgactttttgtgtgcctattcacaagttgttagtgtcttgattgaacatgttctcaagactggtcactttcctgcatactgagtttctgtagcctctgacctttgtgcttttagagccaagtagaactttgtgcttatagagccaagtagaacatatctgtaggaaaaggagaggaggtatcttttagttatttgtggcttctggattgattctgagagtctcttgtgattttttttttgtaccattccagaaacagatttgtactgcttcagacaggcaaggggtacattttagtttcaaagtgttataaggagtatttctgatgtctctgatagttggtgtggatgactacagctcagagtctgatgtgattattataccttcagccctggactttgtctcacaagatgaaatgttgacgcccctggggagattggacaagtatgctgcaagtgagaacatatttaacaggtatgtgcatattctttttgttaaagtggaagtggaagggtggttttattaacttcagtagggaaaatgaaagtatccactttaaaggaggtattattaacaggcacaatctgagtcaccaagttttattcataatcacagcatgagcagttttgtacttgtttattctttgatcctagtaagcatacaacatgctttctttgcaaaaaaaaaaattaccattaattaccattgcttttctgccactggacataattttggtattcatataaattgcttattgggaagtacattattccttcaacacatgatgttgtatacctgctgtatgacgggtgatgctcaagatcattgggtcacacagcagtgaccaagagccagcactcttcctactgcattgtgtttgtccagccatgatcccagaccacctatatcacacttttctgggaaatcaaaaagtcttggttcagattttttgggtatagctatgcaaaactcatactactaaaaatatgtaagggtaacattttgtataatgaatgagtgtgttttttcattgtgataattgaaggacaactgaaatgaatttttggtgactttttaccaaatcagttagataaagattaaaaaaaaatgttgtaaatattcagtctcatcttgttaaaataaaatcaatactgccgtttgccacttaggaaattatagacctaatatatgttttaataatgtaataagaaaaaattttcttaaaaaatatacagattttgtcttttaaaattctagatatcggccaggtgcagtgactcatgcctgtaatcccagcactttgggaggccaaggcaggtggattgcttgagcccgggagtttgagaccagcctgggcaacatggtgaaacagcatctctactaaagatatttaaaaattagccaggtgtggtggtgcatgcctgtagtctcagctactcaggaggctgaggtgggaggattacctgagccagggaagtcaatgctgcagttagccgtgatcacaccattacactccggcctgggcaacaggaatgaggccctgtctcaaaaaattaaaattctggatattagctattgatgccattgaacatacataattttgttttttttgtgtagacaaatggtggcccggagtttgctcgataccttgagggaagtctgcgatgatgaaagagattgtattgctgttttggaaagaattagcagattggccgatgattcaggtatatgtggagaaagtgaatttactctattctagaaaggcttctttgatcaaatttgtgtttctaaaaactaatgaacaagttaatgtgatatgagatagctttaaaatatttcctaagtaattatcaaacccatcagtgacaacaaaagtaaaatttgttactgagacctggacattttacagtgggctcatttagtttaattttagaaatttctcatcaaaacaaatctaaaaacattgttttgcatcatgtatagtaatattttaggattaataaaaatatatagaataattttgaatacattaaaagagatggaggaggctgtaaattattttaggcaactatagaaagcttgctttctgtgtggtttctcacttgcaaaaaaatgttgattaaccatttgtaaaacta

SEQ ID NO: 88823 - DNA, 1582 bp, Homo sapiens
ggtacttaaagatgctgccaatgctcgcaactaaattttttttttttttgagatggagtttcactcttgttgcccaggctggagtgcaaaatggcgcgatctcggctcaccgcaacctctgcctcccgggttcaagtgattctcctgcctcagcctcccaagtaactgggattacaggcgtgtgccaccacgcctggctaattttgtacttttagtagagacggggtttctccatgttgatcaggctggtctcgaactcccgacctcaggtgatccacctgccttggcctcccaaagtgctgggattacaggcgtgagccactgcgcccggctgcaactaactttttaaagattctgtttcctgtgcattttaatttaggataaaacagacattgaaggcacaatagttatttgcatattcataatttggttgaaggctttgttagagtaattgcttatttttctcagttactaaagtttttacaggtgatacctttacccagaatattcaggaacaaaggacttttggacatatggccagttgaaggaccacttcccatctcttgtgaagggagaaagaatgagggggaacactgggccatggtgcctccttagagagcaagatggttggtaaaggactgagacagctgtcacatcctggagaagctggagaaggtagaggacccaaaggtagaggaacggagcttgggctgcccttataacacggttgttatctcgtgagcctgagtttctctgtctatggtaaaactccagagtatggagcccaacctccagagtagttgtaaacaagtcctactacttcagccaagctaggtgtaagttggcccttgggatgggaagaaattgttttctggtcaagctctagaatcttggttgaccttcctaaatgcagaacctggactatgagggaagagacagtaagttctgttgtgcagatgatctaggaaaggacctagctggagtctaggacttgaaagaggggcattgccagacattgctaagagtctcaggtctttcgatttgatttgttttaatcccgtctctgtacagaggcacagagtcggggaaaaggttggtcaaagactgacttgactgataacctttggaggaaaaaaaatcctaatgagggaaaaatggatggtatttgtgtgtgtgtgtgtgtgtgtgtgtgtgtacacataatttcattgaaggagtttcattagaacttaaacttttatcaagtaacttataaaggtaagtaaatgaaatcattatcaggtactcttaaatttaggagaataggctgggtgcagtggctcatgcctgtaatcccagcactttgggaggccgaggtgggcggatcacgaggtcaggagatcgagaccatcctggccaacatggtgaaatgtctactgaaatacaaaaaaaaattaactgggcgtggtggcgtgcacctgtagtcgcagctgctcaggaggctgaggcaggggagttgcttgaacccaggaggtagaggttgcagtgagccaagattgtgctactgcactccagcctggcgacagagcaagactccgtctca

SEQ ID NO: 88824 - DNA, 1004 bp, Homo sapiens
ctggtgtccccttcccccgtcactctaggaaggaagaggctcgcgcgggaggtgtgtttccttagagtcgctcttccaggagcgcccgggggtcagcctgggccccggctagccgtctgggctccccgacccggttttggattgtttgaggatgacatacctgtcattttactttggctggtagcagttttcagatgctcccgatttgattagtggattacgagaaggttagaaggtgtggcctccgcaggaattactaggtttggagagcatatttctttaatgcggatgttcagaaatcacccagccctccttcagtgttaacagtgcagctttcctttgaggtactgaagtttttaaagagttgacgcttttatttttaaaaagacaaagtttctgacatttcctgatggcgacggaattgatatttagaaaggaatttttcgtcttatatgtacttttctaagcctcagaaaataatttgggtcacgatagaaaagacaaaagagttaagcaggtttgtattgaaagaagtgacaaattgcagttaacttaaaatagtttctattcttgctaatcttccaaaatagcgacccatcaaaaaatcaataggttttgagatgcattttaaaaatgcagagtgtgcaaaatatataagcgaagatcatgggatacataagggaccaagaaattgttctgagttgagatgataaccatagtaggattgtggtctgtttagtggaaagcctaccggatgctgagattgactgtctagtacctgtataagtaatttcagagatggctgcagtttgaaattactcttttaaatactctgtagttaatccttagcattgtctaatgtggttcccttactcagagtaaacttaatttttagattcctggttgttttgagtaaagtaagggggatttactatttagatggattatctgaaacgagtaatttatctttaaagtaaatgaaccacatccaaacttttgctaag

SEQ ID NO: 88825 - DNA, 1009 bp, Homo sapiens
gtgaatttctaactcctttgtcattctgagtgtgtcagctgaattcacataagggcattcaccaagggaggaagagaaaggcctttagttttaattattttatagttgagaaaattagacacatactcggggttacggggtctattctgatttttattactcctagaaatttcatacagattataatctgtctatcttgttagtaatatctgactgaattttttggaatagctatgtgtagaacccattttattacacagatttaggaatctcagaggatctgattccttagtctcttaaatcttcagtggcattaaatgccaacacattgtccttggtcaagactacaacgtagaaaggaacaagctaattaactacttagaattccctctcctaagagaccacatcgccaaagtggcaccatgacacagcttggtgttttgttggtcactttaggagaacaccattttggaggccttgggtggagctggagatagagccatggaggtagaatcgtgtcggaaaacctgggtttagccccattttgtacttgggcgtttgagctaatcgcttaagtcacgtaaaacaacaagactaataaagtctgggatacagactttaacacctcaagtgctgccaaaagtatttagaagacaaagcgaatcataggcacccttcaccgagcacctcctagacatcaagaaccatgctaggttccctacattcttcatttaatgccaataaccccacgaggcagttatcaccttcattctacaaatgggccccactcctaccaattaactggctgaatcaggatctgaccccgggcctgccaacgctcccgctggtggattgcccgccttgtcagctcgagttggcaggacgtgggagtaaaaacccggcgccccagccttcaccgtgctgcacgaggaagctggctaggcaggcatgactttgtcagtcaaccatcccgcagccgggccctgggctttgttagcagccacttggc

SEQ ID NO: 88826 - DNA, 1052 bp, Homo sapiens
tagctttgtatgattctaaatcccaatgcacataataacttaactgtgccacaaaccagttatttttgttattgttatatgttacaaattatttgttcaaaactggcatgtagtagggagagcaccactggtctgatagaatggactttttaaaaataaggggtcttgtattaaaaacataatttaataattttattgaataatttgaaccaggtttgaagcatttccgtggaaggaaaacatgcaaattcccacaatgttagggtcctggtcaggttctttggagttacaggtaactgtttgtcatttctgggaatgtatgagatgtgcagaggcaaagtccagtatcagagatggtctcaccttgatggcagtaaaaggctcaaatgcgtttataataataccaacagcagcagcgacaacaatatatttgtttagcactttacagtttacagtgaactgtcctcatgttatttcatttagtcctcaaataactctatgtggttggctttttgtcttcgatctgcaggtgtgaaggacagaggcttagccatgtgaaatgtttttgctcaatgtcataaaggccatgtgggaagtggaccctaagccaggcagtgtgactgctccagggttcccagctccacagtgcaggaggcaaccatttccagttcttttcttcctttactttctcataggatactttttaagcactataaattgggttcaggaaatgtcagtttgtgaaatgtgatcaatccagaaggccaacctgctggactgcaggggactgttagagatcagaggttcccaggtctgctattacagctgttgggtcactgtgcaagcactgctgtcagggtggcacagtggagggcagatgagccctggcagcaggtggacttgggcacgtattcgctgtggcaaatcatgtaatctctggggctcacttttctcattgcaaaatactgacagtttgcgtagataatgcctctaacggggaaccttgcctggcatgtaatattcaagatattaccttagcagcctcttctccc

SEQ ID NO: 88827 - DNA, 1068 bp, Homo sapiens
aaaggggaatttttctttcattatcattttgatgtagaaaatcagtaacatcttctttgccaatatgaaaacatgtttttctttaagcagagtcttgctgtcagccagattggagtgccatggtgagataatagcttaccgcagtcttgaactcctgagtacaagggatcctcctgcctcatcctcctgagtaggtgggactacagacatgcaccaccaagcctggctaatttttaaaatttttgcagcgatggggtctcactaggttgccccggctggtctggaactcctgggctcacacaaccctcctgcctgagcctcctgagtagccgggatcacaggtgcacaccaccatgcctggctaatttttcattaaaaattttttttagagggtcttgctaggttgcccagactggtattgaactacttgcctcaagtgatcctctcccctcagcttctcaaagtgatgggattacagatgtgaaccaccatgcctagcctgaaaacatttccttttgattctagcatttagatcctaaacctaaaaccgttgccctagaattgcgctgcccacttttgctgctgatcttattccctgtccagacctttgaggaccagagttggttgggcctccctcccagatgatgctcagggtactggatgctggagtgcagggactttctctggtgactgtggggaagcccctgccctctcccctccctttttttttcatttgttgattggcaaagctgagatttcccagtgtatgtgaatttggtttggttcatttgtaaaccccttgacaactctgtacatcagaataatggcattcctcttgggagtattttgtaattatttgctcagtgtgtaatatcccattaaatatccaaagtcaattcagcaaatgtttattaataataagatttgccgaaagcaagagaagtcttaagtgggttatgcctacagtttctagaaagccttcagattgtggtggtaaaaaaacttggctttgtaaattttgtgtaattcgtattagaagatgctaatttattttaaaagcacagtact

SEQ ID NO: 88828 - DNA, 1034 bp, Homo sapiens
agataatgaggaagaatagagtctgtgctgttaaaatgtgtgtgctctgagatgtgcctgtccgtgttctgcgactgatgtggtgcgggtggcccctcccatttacctgctgctgtcacaggaggagggagggagctgaagactgagctgcccagagagcccatcaaaggcatctggaatctttcttaatttaaaacattcttaaagaagaatatataaaacaagcatatcgtaaggaatactgtggtaataaaatgaacagccgtgtaagtgtgccacagagaacccttccccaatcgtatcctcttctctccacccagaagtaaccaccctgctgactttggtgataaccacttgttttcgttatgctttacacctacatttgcattttccaagcagtagatttgcccgtttttgaactttgtaagcggaatgagactgtatgtgtcacgtgatgacgtgtcgttcactcagcatgtttgtcagattcacctgatgggggttagctgtggtttctacatattcattgctgtctactgttccgttttatgagtggaacacagtttatctattcattctattggtggatatttgagttatttctggcgtggtgttactatgaacattgctgcttgaacgttcttgcacatgtgtaagcatttctctggactggggtaggtaagagttgaattgctgagtttcagggggtgcacaccctcagtcttactaggtaatgccaacgtctttcacggtggcatggaatatgccaatcgtgtgtgagacttcctgaggctctgcctccttgccaggcttcagaattgtgatccttcagggcatatagtgctatctgacagtcatttcaatgtgcattttcctaattacctataaagttgtcatctttttatatatttattggccatttaagtttcttcttctgtgaagtgcctgttcaaatctttgccatttttttctattggattgtttaccgtaatcttgtttatttttaggatttaaaaaaatatatacttgatgct

SEQ ID NO: 88829 - DNA, 1028 bp, Homo sapiens
ttggtctctgtcttgactctcccgcctccaggcagttgtcacctcctgccaagcatcttccacagtttccctttccatctgtgcttcctgcttccccgtggcacacttaaggctcacctaacccctgacctgggctttccaggcctcctgacctaatgagcttcccacctgagaatccattccggtcctttatagcatgtagcgcgttcctctttatcctaatattcagggccttctagtaatcctaatattgtcttctttatggcagcaagaggacagtgatagggaataacttcaagtagcatgtgtgtgtcccccagttctgcattattagggcgatgttccatgatcgtgagtcattgctgtgttccagagaccccctctctacatggctagaggctaaaggtcattatcaagagtgaatactgccaagtcctagcaaacttggtcaagttactcatctagatgattcagaaaatcaaatcaagaaatggatgttacacagcaactgccagcattgctaacaccaaacaaaagataaccaagccaagtaaatactggaactggaatgaaaggagagaagaattacatacagtggaatggttagcgggagaatcagcgcttgcgcaggaaatggctggtccacggggaaagggaacagccccagctaagcttgctgttttatttttgttgtgtgtaaatgcatgacagcccagttccgagccaggataaaacttacaggctaggaatttgttttcacatactgtgttcctgtggaatcatttctaaaacctgcgtttcctctagactgtcaactttcaggaaaactgaacttaaaaaaaaaaaagtcttttaaacttctcctagacagcatcttacaaaatccaaaccctattaaaataaacactctggcctcaaatttatgctcaaggacaacttgttctggaggctgactacttagagcacattttgtaagagtggaaacctacagactaggctcagagccttttcagatgtttttgtatata

SEQ ID NO: 88830 - DNA, 1034 bp, Homo sapiens
tggatacccaggaaaggagaacagaatatgcaaaggccagactgacatgagcgtggctcattgcaaattgtagaagaaaggctgatgtgttatggtaaataaagtgggtagtgagtagcaggagatgaggctgaaaagccagattatgcagattgtttcaggccatattaaggatttgagtctttatcataagaaaataggaaaccatcaaagggtttaaacaatagagtcatatgagcaattcttaaaagttctcttgactacaatgtggtgattggattagggggagtaagagggaatatggggagaactgtttagattagtgctataattcagaagacagaggatgatattacagaggatggtattgcagagaatgacagtttgggctaaggtagacacagtggagatggagcaaataaatacgaacagatttgagagatatttaggtggtagaatcaataaccaatcagctattgattagatacaggggtggtaagagaaagtaagagagtgaggaatcactccccttcttccggtgtgtgcaggtgaatgaatgatggtactagtcacagagacagaggaccagattctgatgttggggtgcagggaaggaaagatcactaagccagtttgatgtaagatgcctttgagacattcatgaggaaatgttaaataagcaatagagtgttctggtgggaactcaggagcagcagctctgtgctgaaaactgaacctccaagtcttgagcatgaatggtcacgggcatgtaggaggtcacctaatacagacagagaaatgaccagaacctcatactccttcttgggaaactgcaactttcaaatatctcattaagtagaatgagttagcttgggtggaagaaaagtggccagagaggtaagtaggaaaggaggccatggttattactatggatggctcagttgtccccattcggacttcctccagggttgccttactgtattgcggaagccactcctttgcatctaggctcttttttggaatgagaaaaccct

SEQ ID NO: 88831 - DNA, 5924 bp, Homo sapiens
gccgccgccgccgccatcttgcggtcccgcgggggcgcctcctgggcgtccggtcccgcccgcgccgcggtccgcctgggcccgcgtccttggccccagaggccgacggcgtgcttcggcggggcgtgggcggctgggcacccgagggcgtgcgctctgggctgcggcggggagtgggctctggaggtggcgcaagctgcgtctgtcgcccgctcccggctgtcagcggcgcggggaggctagggcacggcgcgggaccccttgggagtgagagccgccccccgacccctgccccggcccggggagagctcgctgcagccggccctcgggttccgcggagggcgtcgcttgtcacctttccgccaggtttagaactcggccgtcaggtgtaggacgcgccggggaggtggagagtccttggaggtgcctggcgagggctgcccggtgctgttggcacggacccaggtgcgtgcgggcaggagcgatgcgtcagccgcaaacggagagttgtaggttcatagtagcggggcttcctgccttctacgacatttcagtgtgccacccgcgtgcttttatttagccctttagttgagctcctctgctgagaaaccttcagtgcgtgtgacttttttgcttttacgtttgcggtttccgacagatcctgagaaggctgataaggtgtcacccagctctggaactttgtaggtttttgtagtactgcctgtgataagttttttagtctgacttggtgatcctggaagaatcccaggggcttttggtcggtttccttgtcaatatgtagtgtactttaggaaagagagttaaaatgtacagatttttattttttttctttgtttttaaggaatactgaaagagtgtgaacatctaatagaaagtaggttccttcctatctttagttaagtgtaaagtgagtcccgttttggaagtctatgtcttgtatttcaattgttgaatgagaacaatttttgtgaggtgtatagcaattctagtgctaaaagaaaaaattaaatcctttattgttgtgtaaggctgagtccaagagaaagccaactacattgttttccataggaaaaacttcaggtttaggaatttaaaatatattctggaattatgagattaatattgcataactacattgcaagctttttagtgcgtttacaaatttctttgaatagaagtgtaagtgagctacttgttgggtaaggatttggttttaaggtgcagtgaatgtattttattgcaagtttatgtaagttgtgtgatttttacgtagttgtagctgggggaaaacctttgaggaattatgaagagtcctgactcagccattatcttgagataatttaatgtaaatctgtatggtgtgtttttttttaatatttcgtttttatcttttgattggctgtgtttacagtgaacatttcctctactggataactatgtgtaaattgccattagggatttataagcctttacaaccagttttaggccaggaaatgtccacagagtttgaagttttctccttagggaagttgttatgttgctatagtaagggagtaataatagtggagaagcaagtttaaaaaacaagcaaaagccctacacagtgacttactcatatatttccttttttgggggtgttggagaattacagctatgattatagaactcattgtttttgtgttgccagtaaaaataagactagccagggaagcagaaaaggtgtgtagatggtataacagagacacaaccgtgtctgaggaaagaagccctttctctatgtgccccatccctcccttaggaagcatttaaggaaaaggcttgtttttcatttcaggggaggtttaggccaagagagtggttgagtaaacacactgctgtgagagaatgcctggtacttaaatgcccaatagtttgttgtgtgtttcagtttaaagatggagatgatggggaggattgggaggtgacatttggtgtttgattccttaatattatcgttttagtcaaaggtaaattgttggctttgatggaaacctttgtgtatttaaatgcacagttcaacactgaggagattcatttagaatgtacagtctacttgggcttagtttatgatagaaaaaaatcatttaactgacttaccctaagtcattcaaaactttctaagtgaaggacttttagaagacagttttgcaaaattctttgtcatcttctagtaggtttattttagttattgattctgagtttgagatggtttctccaggagtgactcaggtaatcattctgagattggatggtttttcttttatacacctaacaagcatcttgaagatgaattaacagtatgttgcacaattttgcaaaagcagacaccaactatttcagtacatttttctgtatacctcagtatttaaaaaaaagtttgttttatacagtcgttaacatataaaagtgcatttacgatgtaatgaattctgaagtagatcacttgtgttagtaaagaaaaagaagtagacgctgctttacttcaaattctgtttaaaccttggaagtaattttacctagatttcagatttgaaacttggtattttatgtgaaagattttttttgtctttaaaattttttacatgataaaattccatttataatgtattacacattttatttttctacctattagcagtttttttaaatttttttattttttgagacggagtcttgctctgttgcagtggctcgatctcggctcattgcagtctctgcctcccgggttcaagcaattctcctgcctcagtctccagagtagctggaactacaggcatgcactaccatgcccagctaattttgaattttttgtagagacgggattttgccaggctggcctcgaacttctgacctcaggtgatccgcctgccttggcctcccaaagtgctgggattacaggcgtgagccaccgcacctgacccctattagcagttttgtagaaaagtttgaagaagaaagtttataaaatgctaaaataaatttcaaatatattcttaatgatcagagagagacgaaaataaaccaaaatccttatgttgagagtggccgataacaataaatcaacaaagaaaattaagctctctgagggatcgagggacgtatggtgttaacatcagctagtgcatctgcatagaagcagcacggggcgggggggaaattagagaatactcctctggatggatatttagcacatttttaggtgtttccagtcggctcttcatgtttcccagtggctatacaaaacgcctggggctctaaagacatgaatgtaatctttaatcatatattactccattccttagtttttaggtaactctcaattgctcacagaataaaagtcagatttttttttttcagtaagacataccatctcttccatgatgtgccttcctcttgtaacacctgttagtctgtacacatccatactttcttccctgagaaagaaaaaccctgctcatacccaaggttctttgttcctctatttttgctggctaaggtaaaattccttatgactcagaccatgttccatgagatgttttcctgctggttttcaatcactggctgcattgttttaacatataaatacaccagagtctttgattttaaaaacaaatgagcagacatgtacttctttgaccataactctttctagtatgtgtctctccctgtccttcatttcctttgcattcagactttttggaaaaatagtccatattcactgtttttccagttactcaccttttattctctccttagtccacggtacttttatcctctcactacttattgctaacttaatcatttccagtttttatcttacttgacctccccctggctcttgacagtaccgacagtttctctaaaaaaaaccctcaattcttctggcttctataacagcattgtcttctaattttcttatttgctccatttattgtcttatttgtggcattttcctcaaatgctcatgtttctgagattctgatttggtttcatttatctcactctgtgaactttctttgttcatttcattgttttgaggttttctctttatcttccttgctctctgcaggtattgctacacccccaagtctgttttaattcacattttaccgtcagtcaagagcacatactcaaacaacttattcactatttagatttgaatattgcacagatatgatattctaaactcaaaatatctcaaaatttttactacccatgcctactcttcttcccatattttttatttttatttttgagatggggtcttgctcagttgctcaacctggagtgcagtggcatgcacgttcttggctcactgcagccgtgacctcctgggctcaagtgatcctcctgaatagctaggactataggtgcatgctaccatgcccagctaattttttacgtacatatgggggtgccgctgtgttgcccaggctgatctcgaactcctgaccttgcgtgatcctcctgccttggcctcctaaagtgctgggattacaggcctgagccattgcacttggctttatttttattttttagtggcatcatgattactcacaccagaaacaatatgcatatctaataattaaaatctgtgtttctatttttgacataatccctttgtccacttcaatgtgtttctacttccaaattcatttatttttaaaattcattcaattatggatctaatttgattagatttgagtatctgctacatgtcaggtatgatgaataaatattggaactacagttgtgagtgaaacacaagccatgttttcatggggcagttctaacaagagagatagatactaataaaataatcagaagaataaagtgtacccctgaagagctatatagtgctacgagaatgtaaaataagggtcttcgatcaggctgtcacagttgaactaagattccaacaatgagtaaaagttatcctggtgaagaagaaaggaaaatgcatgttcaaatatccggtagcaggagggactgtgaaacatttaccatactgaaagaggtcggcgtggcagtggtgaaaatagtcaagatgaatgtagtgctggtttagtaggtcaagttaggagttttgtttttatcctgagccactagggtttttaagtgaggggaggagcagtaaagatggagggaatcgaataacatcacatttgcatttaaaaataattctggtagcaatgtaaaattatactagaggggagaaagagatgaattaggcggctgcagcagtactggcaagtggtgaccccttggactgaggtcatggtattggaggtgatgaaaagttaggttgaatctgtgagacttggtggtctctatgtgcactgagagaaaagggtatgaatgtctgagatttctgcttatataactggggaaatggtggtgctatttgagaaacggtggatgtctggatgaggacgaaatgcatcttatttgggggtgtgtgagagagatggaggaggaggacgtatggtagatatgtttaggtctttcaggatattaacatgaaggtggatttggttaaatgggtgtgttacttaagaaaaggtctgggctttggataatttccttacttcaggtccttttatatttactagtcagcagacatctccttttcttttctttctttctttcatttttttcttgagatggagtctcgctttgtcacccatggtggtgtgcagtggcgctatctcggctcactgcaacctctgcctcccgagttcaagcgatgctcctgcctcagcctcccaagtagctgggattacaggcgtgcaccaccatgcctggctaatttttgtatttttagtagagacggggttttgccctgtgggccaggctggtctccc

SEQ ID NO: 88832 - DNA, 1050 bp, Homo sapiens
aatttatgagagttcaggccctagagtcagacctggtttgacttcccactttcattgctttgagttatatgaccttggactactgtttaccttctaagttgaatcatttgtaaacttggtatattaaaatgtaatgaaagtatctacttcatggacttgtgagggttaaataacatagttcatacaaagttattgatacatgagtgcccaataaacgctagctgttccgttagtagatattctgtgtactatatagtattaatatatgttttgtatatatgattaccttaacatgatgccacagatactcagcagcataacccttgtgtaactgggaaacagtttaatcagtgatacaacttaattagctaaaacctgttagaaacattgaaggtagtcatcacctgcattgctgtggctacattgtttgtgtatttgagcagagcacccagccttcctcattagtctgcactgcatagctaagaatttacaaagaccttgtcaagaactgtgaagggactgaaaatttagcctgctgcagttttgtagatgttggtagaagacatgagatttcctgagttagacagtggacatcattgttcatggcactgcaagtggaatgggctttatatttgtgttgttttccttgccctcctcaagttccatggaggtgacagaggtgttcgggtagatgctactcacatagtgagtttgcatcataactagaaaccctgagcttagagaaccggaatctttcatagtgggctgcacagaaacctacctgacctttgttccagtagaagaccttatcttgattatattggtcagtgaacaaacctgcccctctcctcagaagggaggtgttgtcttctaagacagttcactatttaatacattcttgaaaagatagcctgggtaaaaacccccaggactacttcttgcaagatgtgcagaaatgctagaggcccatggagaattgtctcctaaacacacctctgagtaactagcctaaatgggggtcacagagttcataaattaatgttcatgtgc

SEQ ID NO: 88833 - DNA, 1122 bp, Homo sapiens
tagaaaatattttactactaacaaactttaagcatagcataaaatcattttgcttcttagggcttgaaataagtgtcttttaatgactttgtaaaattttaaaagacatgcttattcttaagattgaaataaagaaaagagagcctttataatagttgtctttgattccagccttctagcttttttaaaaaatacataactttaaacgaattgtttttagaacgatttaaaattacttttggaatacttagaactgtggttattgttcccaactggaacatgtttttatgttcttcctccaaattaacaggtatttattttgttgtctaaattaatctgcataatttttcttcaggcttttcttcagcaaaatggatcagccttttgggttctttgttttgtaattttatgttgtttgggtgcagaaccaaagcttaaaaactttgtatctagagcatatggcataataaacacttaacaaatatgtgaatgaatgaatggattgaatgaatgaacaaacaaaattgaggtgaagcaaaagcactgatgtcatagggtgtagggtcttcagatgtagagatttttgcagttggcctagtaaaatgaacttgaagattgacactggtttgcagacaactgggaaattctgttattttcagcaacgtattaacaacatactgtaaaaatacagttgtaaagttcatagatccaaagtttcatagtacttttttgatagaaatcatacatgtttatggtagaaattttgtgaaatacagggaatgaagaagaaaatatgacttgtttttaagtctgccacctcgagaaaggcagtgttagtagccatttgggatatttatgcctacaaatgtcagcacttaattaaaattgaggttatatattttcagttttgaatccttcgttgttgagaatccaattaaattttgttttctctttaatttttaaactttacaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgttt

SEQ ID NO: 88834 - DNA, 1175 bp, Homo sapiens
gctatttaggagcctgaagtgggaggattgcctgagcctagggaggttgaggctacagtgagctgagattgcgccactgcactgcagcgcagcctcagccacagagtgagaccctgttttaaaaaacaaaaaacagatggtagtgaggttttaagttactgagtatttctcctttaaatatctcagttgtataattttaaatcagaaaacactaaaatgaagcctaaattcatagttttaataacttatatttaatctgagcttataggcattatagttaacgttggcaaagttttgaaaattttcacaagctgagtttagaaagggcaaaatcatagattcatatttaatttttaattgtaattgtttattttgttggttgtgcaaaacttagtaaattagaaagacagacaatttaaaaatacttgggatccattaagttgattcttaaacattccagtgtttggtttcttgaacccttcttggttttttttaaatttgcatatttgtgaagtagtaggaatgatactattgccagatacggtttaaggcaaatcccagacttagtataatttaatctgtaactgtttcaatgtatgtctttcagacatgcaggagacaatataatatatcctttttttcttatttagtaatgctacagccctttgactatgatccgaatgaaaagagtaaacacaagtttatggtacagacaatttttgctccaccaaacacttcagatatggaagctgtggtaagtatagaagaagaatttgttttgggaagtggagtttaaactgtgggtgttgtttagcagtcagtagaaaaacttaatttctaaaaactaaaagttaaatttaggtttttaaaaaactgccaatttcttcattatagataatcctaacttaaagaatgaaagaatttttaaatagtatttttttttagaaacaatttagaaatgctgctactggcctggtgcagtggctcacacctgtaatcccagccctttgggaggccaagatgggagtatctcaagcccaggagttcgagaccagctcaggcgacatgacaagaccctgtctctacaaaaacaaacaaacaaacaaacaaaaaacaaaaaaaaccaccacaacaaaaatgagctgggtatagtgttggacgcctgtagtcccagc

SEQ ID NO: 88835 - DNA, 1053 bp, Homo sapiens
tgtttatttttagtggaaagaggcaaaacctgatgaattaatggattccaaattgagatgcgtatttgaaatgcccaatgaaaatgataaattggtaagtaggagaatgtaaaaaaaattgggagctgttgagctctcagttcctttgattaattttgcttttatttttgacctttgaggtatgtgtgatatggctattacacttcataagactcagtggttaagttttaaaaaacttggtatgccttttttttttttttttttaaagtaacattttgtttatccaagaagaaagaaagactcacttttaggtcaagactgcatcctggagaagaatcatttaagtctaccagattttttgtgacgtaaaccactgcaggttcttttttagaatgagatgtgtatacataatttaaaaatacatataaattgctttttggccactatgtaccggcagtttggggataaattcacttacatggacagtttattccaggtttagttattcctaggtattttgctcacttttgtttttagtcaaatccatctgattgtattctttagtaaataattattatgttgcttactcattagtgtaagtctaatacaatttgggggactgagggatgtatttgtttattcaaaaacaaacaaaaaatagtctgtgaatgtaccgagtgggttgtagtcacttaccttgtccatttccctgtctggattgcaaatttgaatcttttcctatggtgagagagacttgaaagataaatttttctgtgtgtgtatgtgacttaatacatacaataatatggataaatagaatggtgtggcacaatttggttacaatctgacatgactactgccttaatctagtggccatttgctctattgaaaagtaaacatgcagattaaatatgtgggctcagttattgtgttcctctttcaggataagcagaaatgaaaaggtctctggtaattaggtgttgaccaaattatattttgaatttttaaaatgcctcttttaagtgatttttgaggtatttgccaaaagcaaaa

SEQ ID NO: 88836 - DNA, 1036 bp, Homo sapiens
ttaaacatatttgagttttaactcttggtagtttattattattgttgatgctcaaattgcctggtaaggagactttttaaattggttcttgagtttgtttgaccctcatagtctttggtaattttcttgtctaatgtggcaagatttttccaggtccagacctggaaagaagctcagggccatttcagtgggagatggtatttcacaactataatcgaccgggtacctgtgacaaaattgatttttaattttatcaaactttctgttcatttttttgaccaaggtaagagtggaggcccatttttcacttgaaggtgcttcttcaaatggtaaaattttaatgataaaactgtgtcagcagcatataggatgatgtggatccttttatttcttggggtaatgattgcattttatggttggattatgttgggtaattcaaaatgtgcaaaatccaatactgatcctgagaagaatgggcgggtacttctatgaaccagctgaagtggtgtttcaattacagcaatacataaatacagcttatgactttgatggctcactggcctcgtcattatgatttttgatggatgtttttgagtgtttataatttacatttcaagttttacacatagaatgagacttaaagattgtaatatatcaccatttcaaatttatgtaattcaaacttgcaaaaattgtgtctatactatttaggctggaagtggccttaattgattaatgtgtatgttaaagagaggctaaaacacaattgtgtttttataaggcagtatttcccagtgtattaggttggaagtgttctgtagacaggtgagcttggaaaaatactgtaaatgtctccaagaggaatcacattgcgtatttgcctattaaaggctctgagaaaacgtaacggtaaagaaatatatttaacccagtattttttttttaatttaaaataacctaattaacttaggaaatatctgatgttctgaaaaaatatactttgggaaatactattcctgcctaaactcactgttgt

SEQ ID NO: 88837 - DNA, 1064 bp, Homo sapiens
aatatactttttatcttatagttatgattgtgatatagagaattctttgagatcttttgaccctttattttagtttattagtatgttgtaaaaagtatgttaacttaagcaaaatcagttcagcttttaactgcgttgctggtaacaacttagtatttaacgtagaactctgtggatggcatttgtatttttttattcagctttatttagtgtttagagcagtggacaagttcataggggttccttacacctttattttttgttttaatatatgcatacattattaaatgatcaccacagtcaagctaattaacctatcaatcacctcagataagcaccatttttatgggtcactttattttaaagagtcgatcaaaatttcatttttggtagtcaacttagaaaaatttggttagtgttcaaagcagattctgcaatagctatcataattgttgatgcactctcctcaaatattgtagagataacaagtcttgaactttatgatttttttttagtgtgttttaaccccactccctcacttccccagcccccccttcctgtatctctttgcagaaagaagtacgctggtatttaagtactgtattagtctgttctcacattgctataaagaaatacctgagactgggtaatttataaagaaaagaggtttaattggcttacagttctgcaggctgtacaggaagcagggcggcttctgcttctgaggaggcctcaggaaacttctagtcatggtggagggcaaagggggagcagatgcctcacgtggtgggaacaggagcaagagagagcgaaggggcagtgctacactctttttaacagctagatctcatgagaactcttatcatgggaacagtgtcatggggatggtgctaaaccattcatgaaggacccaccctcatgatccagtcgcttcccaccaggttccacctccaacactggagattacaatttgacatgggatttgccgggggacacagatccaaaccatatcaagtatgttgtatgcgtataccccacttgtgtgaggattttgatctttttat
